United States Patent 11,739,335 (NUCLEIC ACIDS ENCODING CRISPR-ASSOCIATED PROTEINS AND USES THEREOF) - sequence listing, part 7

SEQ ID NO: 5199 - RNA, 3630 nt, Artificial Sequence
  Cas9 variant
augaagaaagacuacauacucgguuuagauauagguauaucaucaguaggauggggauuguuagaacuggaugacaauaauaaccccuacaaaauaauagacguaggaaguagaauuuuuacuccaggagaagucgagaaaaccggcgauucaagagcaaaagaaagaagagaaaaacgaggagcucgacgaaucgcacgaagaagagaguucaggcuugacagagucaaaaaccuacucuaugaaaauggauaccuaaaaggaaacauaaacucaaauauagucuccgagaaaaacgaagaacuaucaauaauauuuaauaacaugauuaauaacuacuacaauggcaaaaacaccaauccauauauuuuaaaaguugaagcacuugaccgaaaauuaacagacgaagaacuaucuauaaucuuaguacauuacgcaaagaaacgaggcuauaaaaguaacagagaagaagcaagugauaaagaaaguggaaaaguacuaacggcaauaaaagaaaaugagaaaauaaugaaagacaacaacuaccgcaccauuucagaaauguauauaaaagacgauaaauucaaaaacaaaaucaaaaacagcccaaaugacuauaaaauuuccguaacaaaugaaauguauuuagaagaaaucaauaaaguacucgacagccaaauaaaauucggccucauaacagacgauuucaaaaaccaauaucuagaaauauacaacucaagaagauccuacgcuaaaggcccuggaggaaacuccccuuauggaggagaucucauugaaagaaugacaggaaaauguaacuucgacggaaauccgagggccccuaaaagagcuuucagcagugaaauauacguugcauuaacaaaauugguaaacuuaaaauacaaagucaacgacggagaauauaucaaacucucagaaaaagaaaucaaaaacauaauugaaaaagcgaaagagaagaaaaguauaucguacaaagaccucacaaaaaugauaggcaauaacaucgauuucaaagaccuaacauuauccaagaaagaauacauaaaauuaaucgaagaacuuaaaaagaaacuuaauaucaagaaagauacaaaaaucaacauaaacgaacuaaguucggaagauaaagaauuguauaacaaauuauguaacgacaaauuacuaucaaagacauugauagaacuaaaaggauaccacauacuaaaagacuccguuauaaaagcauauagcaaagacauaugggaugaagucaaagacaauauguaccuauuagacgaucuagcacuauauugcacaaacuauaaaguaaacgaagauaucuuaaacaagaucaaagaaagugaaaacauagauaacauuuucaaugacauacacuuuguagaacuacuaccaaauuucaaagaucaucuaauguuaucaacagaacuaaucagaaaacuaaucccaauuauguacggaggaaacacauacgauaaagccaugaacauacuggguuacaaccauucagacauaaauggcgauaaagaaaagaaagacuuauuaguaccuaucuguguagacgauaauaucaccaaucaacggguaauacgaagccuaacacaaacccgcaaaguaauaaacagcauaauuaagaaauaugggaugccgaaaauaauaaacauagaaacugcaagagaauuggcaaagucaagacaagaacgcaacgaaauugccaaaaacaauguagaaaaacaagcagaaaacgaaaagauuaaaaaccaacuuguagaauuaggacuauuuguaagcaccgacaaaauaucaaguacagauuuauugaaauauaaacucuggaaagaacaaaaugaauuuugcggguauucaaugaagaaaauaucaauagaagaccuauuuggaaacaacaucguacaaaucgaucauauucuaccguacagccgaacguauaaugacaacuaucuaaauaaaacauuaguauacacaaaagaaaaucaagaaaaaggcaacagaaccccauaugaaugguucgggaaaacagauaaaugggacgaauaugaaacuuacauaaauaaccucacaauaucacaaaagaagaaagacaacuaccuccuaaagaaacuagauuuugauaccgaaagagaaaugcgaagccaaaaucuaaacgacacaaaauauaucaguaaagaacuauccucacuaaucaaagcauaccuaaacgucgaaaaaguaaacauguaucccggugcaaucacugcaaaacuccgagcccgguggggauuuaacaggcuuacacauucguaccuaagcaaaaacuacauacuuccgaaaaacauaaaagaagacauaaauaaggauagagacaaccaccuacaccacgccauggaugccuuaguaaucgcgucaauaacucccucauuacagcagaaaauuacccuauacgaaaaauucucacgcuauauagaugggcuuacagaacuucagaucaaaaacauaucauacauaaagaucgaagauagcgaaggacaauacuauaacgacgacaccgacgaagucgaaacgauagacaucagagaauauauaaaacaacaauuagccgaaaacaacaucuauuauaacaggcauaacauauccaaacuggaguucccauugccauaugaaaacuucgauaaagaagcaaaacuuagaguauaugaacaagaccuagacacacuaaaauggaaucuaaaaucauauaauacauauacacaaaaagauauugauaauguucacacacuaauaccaucaauagcuaaaacaaaaguauccggaaagaugcaugaagaaaccuacuauggaauaaaagaaauaggaaaagacgaagauaagaaaaucuauaaaacccucagaacacccauugaaaaaguaaaaagaaaagaccucgauaauauaccagaccgcuugggugguucuaaagauguauacgaaucauuagucgaaugguuuggugacuacgaaguuggggaagaaguacuaaaagcgaacggaaauaaauauccaguuagcaaaucagacaaagaacacaaagaaaucaagaaacuaaaacuuuacucugaauauaaaaacacugggcauaugauaaacaagucaaauguagaaaaaggcggaauauacagaauagacguguucaaaagcaaagacaaagaagacgacaaacucuacuucgcagcauacgauauacuugaaauuaagaaaaucaauacucuuaaagagaaaaauaggguagacgacaacuucaacaucaaacuagacuacggacaagguaaaaauucaaaaauaaugucguauacagauaucaucaacaacuaugaucuauacauaagccucaacaaaaacgaccuaaucaaaauaacaaccaacgacggaaaagaaaguguagcauacguuguuggaugcaguagcggaaugcuagaaguaaaauccaaauuaggcgacggauacgauauaaucaaaacagaucuuaacgaaaacaacauuuucuccaagcaaagagcgcaauaccaaauuacaguuucaaccaucaaagaaauaaagaaauuauccauuagcguacugggagaaauauccggccuauga

SEQ ID NO: 5200 - RNA, 3633 nt, Artificial Sequence
  Cas9 variant
augagaacaauauuaggauuagaccuaggaacuaacucaaucggaugggcgguaauaaauuccguuauuaaagaacaaacagaaagaauauggauagagauggcaggauccagaauuauaccaauggacgcagcaauauuaggugacuuugacaagggaaauuccauaagccaaacagcagaaagaacacgauuuagagguguaagaagacuaagagaaagacaauuacuaagacgagagagacuccacaaaguucugaaaauacucggauuucuaccugaacacuacuuaaaaggaauugacuucgagaaacauacuggaaaauuccuaucgggaagcgagccaaaacuaccauggguaaaagacagauggggcaaauauaguuuuuuguuucaaacagcuuucaacgaaaugcuagcagauuucgcaaaacaucaaccaagccuaguuuucgaugguaagaaaauacccuaugacuggacuguguauuaccuaagaaaaaaagcacugacggaaaugaucagcaaggaagaacuggcauggauacuguugaacuucaaccaaaaaagaggauacuaucaacucagaggagaagaagaagaagacaaugcagguaaaucaguggaauuuuacgcacuuaaaguccuaucaguagaagcuacagacgaaaagaaaggaagagacauaugguacaauguacacuuggaaaacggauggguauacaggcgaaguagcaauguuccauuagauugggaaggacgaguaaaagaauuuauaguaacaacagaccuuaauccugacggaacacccaaacuagauaaauauggugaaguaaaaagaucauuucgagcgccuaaagaggaugauuggaugcuuauuaaaaaaagaacagaagcagacauaacagguacacacaaaacgauaggaucuuacaucuacgacgcgcuguuacaagagccucaacagaaaauaauaggcaaacuaguaaaaacaguggaacgaaaauucuacaaggaagaacucaacuucaucuuacaaaagcagugugcauuucacgcagaacuacaagauagggaucucuacaugcgauguauagaagcuuuauauccaggaaacgaaguacaaagacgaaauaucgccaaccgcgacuuuauauauuuacuaauugacgacguuuuguuuuaccaaagaccacuaaaaacaaaaaaaucauuaauagcaaauugcccuuacgaagaaaacgaauacgucaaucggaaaacaggcgaaauaaaaacagccccucuaaaauguauagcuaaaagucacccacuguuccaagaauuucgcuuaugguauuuuuuaucgaacauaagaguauaccaaaaagaaagagaaguaaaugguacauuacaccuugauguugacguaacgacagaauucuuaaaaacagaggaugacuacguagcacuauuugauuggcuaaacucccgaaaagagauugaucaaaaagccuuccuaagguacccugcauuuggacuaaaaaaagaaauaaauaacuauagguggaacuauguagaagauaaauucuacccaugcaacgaaacaagacaugcuauacugagcagacucgaaaaagccggaauuggaauugauuuuuugucugaugaaaaagaaacagccuuauggcacauccuauacucuguaucugacaagcaagaaauagaaaaagcacuagcaacauuugccguaaaaaacggcuuaaacgaaucauucguagagguuuucaaaaaauucccaccauucaagagcgaauacggagccuacagcgcaaaagcaauaaaaaaauuacuaccauugaugagaugcgggaaauacugggauaugucacuaauagacggaacaacgaaagaaagaauagaaaggaucauagcuggggaaugugacgaaaguauuggcgcaaaaguuagagaaaaagcaaugaauuuauccgacauauccuguuuuaaacgucuaccacuuuggcuagcaugcuaugucguauacaauagacauucagaagauaaggaaaucacaaaaugggaaacaccggcagacauugaugcauacuuagcagccuucaaacaacauagcuuacguaauccaauagucgaacaaguaauuacugaaacacucagaguagugagagauauauggaaacaagugggaaaaauagaugagauacgaauagaacuaggacgugaaaugaaaaauccggcagacaaaagaaaaagaaugacuacucaaauacuagaaaacgaaaaugcaaauuuaagaauaaaagcucuauuagcagaauuugucaacccagaauacgguguggagaacguuagaccauacuccccaagucaacaagaaauucuaagaauauaugaagaugcaguauuaaaaggugaagaacaaauaccagaagacaucgacguuauccuaaaaaaauuuaacacuagcaaacucccaacgaaauccgaauuucuccgauacaaauuaugguuagaacaaaaauaccguagucccuacaccggagaauuaauaccgcuugcaaaguuauucacagcugcauacgaaauugaacauguaauuccgcaaucaagauauuuugaugauucauuuaguaacaaagucauaugcgaaucagcagucaacaagcugaaagauaaucaauuaggauaugaauuuaucaagaaucaccacggacagaaaguugagguagguuuugggaaaacuguugaaauuuuuucaguagacucauacgaaagauucguaaaggagcaauacgcaaaaaguggaauaaaaaugaaaaaacuucuaauggacgauauaccggaacaauucauugaacgccaacuaaacgacagcagauauauaucaaaagucguaaaaggacuacucuccaacauaguacgagaaaaaaacgacagcggagaauaugaaccugaagcaguaucaaaaaauauauuaguaugcaccgguucaguaacagacagacuaaaaaaagacuggggaaugaacgacguauggaauucgauaguuucaccuagauuugaacgccuaaaugccuuaacugaaacacaauguuuuggucauugggaaaauaaagacggcaaaaaaguauuucaaacagcaguaccauuagaguaccaaaaagguuucucgaaaaaaagaauugaucaccgacaccaugcaauggaugcaaucguuaucgcaugugcaacaaggaaucauguaaacuacuuaaacaacgaaucggcaucaagaaacgcaaaaauauccagauaugaucuacaaagacuauuaugugacaaaaguagaggagaugguaacggaaacuauagguggauaauaaaaaaaccauggacuacauuuacgcaagaugcaagagaagcucuaucaggaauaaucgucagucuuaaacaaaaccuacgcaucaucaacaagacaaccaauaucuaucaacacuuugaugcaaacggaacacgagucuacgagaaacaaaaaauaggagacucaugggcuauacgaaaacccaugcacaaagauacaguuuucggcgcggucaauuuaaggaaagcguuaauaccgcaacauuacaacuuaacucuauuuauaaguaguuga

SEQ ID NO: 5201 - RNA, 3642 nt, Artificial Sequence
  Cas9 variant
auggagaaaagguuagguauagauguugggacuaacagcuuagguugggccauaguggaaguggacgaugaaggauguacacuuuuagauagaggaguggauauauuucaagaagguguagcucgagagaaaaaucaggaaaaaccagcaguucaagaucgaacagaugcuagagccuuaagaagacauuacuuuagacgaagauuacgaaaaauagcacuccuaagagugcuaguaagacaugacuuaugcccagcccuaucagaagaacaacuaaacgcuuggcaagguaaaggaauuuauccauuagacgacgcauuuauaagguggcaacgaacagaugacaaugcagaccguaauccauaucgagaucgcuuuagauguuuaacagaagaauuggauuuggcauguagagaagaaagauacguacuagggagagcacuauaucacuuaugucaaaggagaggcuuucuuucaaacagaaaggaugcaggaaacgaagcagaagaaggaaagguuaaacaagaaauuaaaacucucagugcagauauggcagccgcagggugugaauacuuaggagaauauuucuacagacuguaucaaagaaaggaaaagauucgaaaacauuauacagcaaggaacgaacacuauuuagcugaguucagagcgaucuguagaaaacaaagauuagaugaagaauuaaggcaggcauuagaaaaggccauuuucuaucaacgacccuuaaaaagucagaaggggcuaguagguaaaugcaccuuugaaaaagacaaaagucguugccccgucucacacccaagauuugaagaguuccgaaugcuacaauucauuaauaauguaagggucacaggcccaggugaugcagaaccaagaccuuuaucaccagaagaaguugaaauagucagaccauuguuuuuaaggaaaucaaaaccucacuuugacuuugaagacauagcaaagaaaauagcuggaaaaggaaauuacgcaugcagaggcgaacugcuucaagcccccuauagauucaauugugcaggcaaaucgacuguaacaggaaguccaguuucagcgcuauuugcaagcguuuuuggagaugauuggcaaagagaaauauguucgcucuauacacugggugccgguaaaaaugaagaacaaauauuaaaugauguauggcacguauuauuugcauuugaagacgaagaaagauuacaagcaugguuacaggaaaaacuacaauuaagugcagaugaugcaaaaacccuagccgccuuuagauuaccacaaggauacgccucuuuguccuuaaacguaauaaacaaaauauuaccauacuugcgaagggguuauagauaugacgaagcuguguucuucgcuaauuuaggaaaggucuuaccagcggaaguauaugcggacccagcaaggcgaagagaaguagagcaaggaauaagugcucaaauggacgaccuaggagauggagaaaagacaaggaaagaagaacgcauaagagacuauuuaagaagauacuggggcguggaagagaaaagacucgaaagacucuaucauccaucaaugaucgaggcuuauccaucugccucaccaaaugggcaaggauuguuacaacucgguucaccgaggauaccagcgguaaggaauccaauggcaaugcgcgcucuuuuuagauuaaggguuuugcuaaaugaauuacucagagaagguaaaauugauagaggaaccaaaauaaauauugaauuggcaagagaacuaaacgacgccaauaaacgaaaagcaaucgaacgauaccaacgcgagcgggaagcugaaaaccgaaaauaugcugaggaaauacgacaacaguacguagaggcaacuggacacucuauagaaccaucagaagaagauauuuuaaaauacagguuauggguggagcagggacacugcucauuauauaccggcaaaacuauugguauuagugaauuuuuaggagaugguaggcgauaugacaucgagcauacaguaccaagaagccggggaggagaagacgcacaauauaacaaaacuuuaugcgaagaagaauuuaauagagacauuaaacgugauaaacuuccaagugaacuagcuaaucacacugcaauacucgcuugcguugaaaguugcggaugguucgagcgaauugaaggacuugaacacaggguauggggagcagaccgccgcgcaaagucagcgacuaccaaaagugcaaaagacuuugcgauccaagacagacauuacuggagaaugcacuuggacuauuggagacgaaagugcgaagcauuuacaaugacagaaguaccagaagguuuuagcaauagacaaggaguagauguggguauaauagggcgauaugcaagauuauauuugcaaaccguauuugacagaguauacacaguaaaaggggccacuacugcagcauuuagaaggauguggggauuacaagaggaauacgcggcaaaagaaagggugaaccauguccaccacuguaucgacgcgauuacaauagcaugcauaggaucaagagaauacgcacucugggcacaauauguccgacaagacgaacucuaucgauggggagaagcagauaaaccaagaugcgggaaaccuuggccuacauucacggaagauguaagggcaaccgcagacgaauuauuaauaucgcaucauacgccugauaacaugccuaaacaaagcagaaaaagacuaagagugcggggcaaaguacaaagaaacgacagaggagaaguaaaauauaugcaaggagauacugcuaggggagcauuacaccaacaaacguuuuauggugcaaucgagagggacggagagauaagauacguagugagaaaauccuuagaucaauuacuaccugccgauguugagaaaauuguagacgaagcgguaagacaaaagguuagagaagcgguagaggcuuauggauucaaggaagcaacugaccccacaaaacacacaguuuggaugaaugaggaaaaacaaauaccaauacgaaaaguucguauuuuaacaggggugaaaaauccuauacuauuaaaaccucacagagacguaucggucaaagaauauaaaagauauuaccaugucguaaacgacggaaacuauugcauggccauauacgaaggacgugacagacaagggagacuaaaacgaacguucgagauaguaaauaagcucgaagcagcccgguauuuuaaaagaagugcugaucgagaaucaagaccugaucuaguaccccucucagaugucaacggauauucauuaaaauaucuuuuaaagaccggaacaaugguucuauucuaugaaaacucuccggaugaauuauaugaguguucuguaggagagcucgcgaaaagauuauauaaaguaguagguauggcacaggacggucgaguacaauucuuguuccaccaagaagcaagagaccaaaaagcuguuacagcagaauguggaauggggauauccguuuuugaugcaagacauccggcgccaaagcuaagaaucagagugucaaauuucaaaauguuugucgaagguuaugauuuugaauuaacaguaacaggagagguaaaauuuaaacguuga

SEQ ID NO: 5202 - RNA, 3642 nt, Artificial Sequence
  Cas9 variant
auggaaaaacgauuaggaauagacguaggaacaaacucguuaggaugggcaaucguagaaguagaugacgaaggauguacguuacuugacagagggguggauaucuuucaagaaggaguagcacgagagaaaaaucaagaaaagccugccguacaagaccgaaccgaugcaagggcuuuacggagacauuacuuuagacgacguuuaagaaaaauagcacucuuacgaguauuaguuagacaugaucuauguccggcacuaagugaagaacaauuaaacgcuuggcaggguaaaggaaucuacccgcuagaugacgcauucauuagauggcaacgaacugaugauaacgcugaucgaaaccccuaucgugauagauuuagauguuuaacugaggaguuagacuuagcaugcagagaagagagauacguauuagggcgagcauuauaccauuuaugccagaggaggggauuuuuaucgaaucgaaaagacgcaggaaaugaagcagaagaagguaaaguaaaacaagaaauaaaaacacuaucagcugauauggcagcagcaggaugugaauauuuaggagaauauuuuuauagauuauaccaaaggaaagaaaagauuaggaaacauuacacugcaaggaacgaacacuauuuggcggaauuucgggcaauauguaggaaacaaagauuagaugaagaauuaagacaggcacuagaaaaagcaauauuuuaucagagaccucuaaagagucaaaaaggucuaguuggaaaauguacauuugaaaaggacaaaaguagauguccagugucacauccuagauuugaagaguuccgaauguuacaauucauaaacaacguuaggguuacugggccuggcgaugcagaaccgaggccauuaucgccagaagagguagagauuguacgaccguuguucuuaaggaagaguaaacuacauuuugauuuugaagauauugcuaagaaaauagcaggaaaaggaaacuaugccuguagaggcgaacuacugcaagcaccguauagauuuaauugcgccggaaaaagcacaguaacaggaagcccuguaagugcauuauuugcgaguguauucggagaugauuggcagcgggaaauauguucucucuacacacucggagccggaaagaaugaagaacagauccuaaaugauguauggcauguuuuauuugcuuuugaagaugaagaacgacuacaaacaugguuacaagaaaaauugcaauugucugcagacgacgcaaagacccuagcugcauucagauuaccgcaagguuaugcgucguuaucguuaaauguuauaaacaaaauccugccauaucuaagacgaggcuauagauaugacgaggcaguauuuuucgcaaauuugggaaaaguucuaccagcagaaguauaugcggacccagcaagaaggcgcgaaguagaacagggaauaucugcgcaaauggaugauuuaggagauggagaacaaacaagaaaggaagaaagaauaagagauuaucuacggagguauuggggaguagaagaaaaacgauuagaaagacuguaccauccgagcaugauagaagcauauccgagugcgucuccaaauggccaaggacuccuccaguuaggcucuccgcgaauaccagccguaaggaacccaauggcgaugcgugcauuauuucgauugaggguacuacuaaacgagcuacuaagagaaggcaaaauugacagaggaaccaaaauaaauauagaguuggcaagggaauuaaacgaugcaaauaaaagaaaggcaauagaaagguaucaaagagaaagggaggcagagaauagaaaauacgcagaagaaauaagacagcaauacgucgaagcaacaggucauaguauugaaccaucggaagaggacauauuaaaauaucgguuauggguugagcagggacacugcagucuuuacacagguaaaacaauaggaauaucugaauuuuuaggggauggacguagauacgauauagagcacacaguaccaagaagcagaggcggagaagaugcacaauauaauaaaacacuuugugaagaagaguucaaucgagauauaaagcgggauaaacuaccuagugaacuagcaaaucauacagcaauuuuagcaugcguagaaucauguggaugguuugaacguauagaaggauuagaacacagaguguggggagcugaucgaagggcuaaaagugcuaccacaaaaucagcgaaagauuuugccauacaagauagacauuacuggagaaugcaccuggacuauuggagacguaaaugcgaagcguuuacaaugaccgaaguuccggaaggguuuucgaauaggcaggguguugacguuggcauaauaggccgauacgcaagauuauaucuucaaacaguauuugaucggguauauacaguuaaaggagcuaccacugcggcauuccguagaaugugggguuuacaggaagaauaugcggcuaaggaaagggucaaucacguucaucauuguauagaugcgauuacaauugcauguauaggaucgcgagaauacgcguuaugggcucaauauguuaggcaagacgaacuuuacagaagaggagaagcagacaaaccucgaugcggaaaaccauggcccacuuuuacagaggacguaagagcaacugcugaugaguugcuuauuucucaccauacaccagauaauaugccgaaacagaguagaaagagguuaagaguacgagguaaaguucagcgcaacgaccguggggaagugaaauauaugcaaggagacacagcaagaggugcccuccaucaacaaaccuucuauggagcaauagaacgagauggggaaaucagauacguagugcgcaaaucgcuagaccaauuguuaccggcggauguagagaaaauaguugacgaagcaguacgacaaaaaguacgagaggcgguugaagcauauggauucaaggaagcaacagauccuacgaaacauacgguauggaugaaugaagaaaaacaaauaccaaucagaaaaguucggauacuuacgggaguaaagaacccaauauuauugaaaccacauagggacgucucuguaaaagaauauaagagauauuaccauguuguuaacgauggaaauuauugcauggcgauauacgaagguagagauagacaaggaagacuaaaaaggacauucgaaaucguaaacaaacuugaggcggccagauacuuuaagagaagcgcggacagagaauccagaccggauuugguuccuuuaagugauguuaacggauauagucuaaaauaccuuuuaaaaacaggaaccaugguacuauuuuacgaaaauucaccagacgaacuuuacgaauguucagugggcgaauuagcaaagaggcuauauaaaguaguuggaauggcacaagauggaagaguacaauuuuuauuucaccaagaggcaagagaucaaaaagccguaaccgcagaguguggaaugggaauaucaguauuugaugcgcgacacccagcaccaaaacuaagaauaaggguaucuaacuucaaaauguucgucgaaggauacgauuuugaacuaacuguaacgggggaaguaaaauuuaagagauga

SEQ ID NO: 5203 - RNA, 3651 nt, Artificial Sequence
  Cas9 variant
augaccaaaauucuaggaauugauacuggcacaaacucacuaggaugggcaauugucgauaaaacagccgauaacuacaaucuacuagauaaaggugucaacauuuuccaggaaggaguaaaaauagaaaaaggaaucgaaucaaguaaagcagcagagagaacagaacacagagcaaccagagugagauauuacagaauaaaauugagaaaaauuagacuacuaaggauauuaucagauaaccaccuaugccccccuuugagucaagaagaacuaucaacauggcguuuaaaaaaaguauacccaaagaaugaacuuuucaugcaguggcaaagaacagacgaugauacagaaaaaacaccauaugcauauagacauaaauguauacacgaaaagcuagacuuaagcgauguaaccgaucguuacauauuaggaagggcauucuaucauauaauacaaagaagaggguuucucagcaacagaaaagaacaagggggcgaagauucaggaaaagugaaagaaggcauaucaacuuuaacacaugaaaugaacgaggccggcuacgaauaccucggugacuacuuuuacgcauuauacaauaaaggcgaaaaaauuagaaaacauuauacagcgcgaaaugaacauuucuuaucggaguuuaaagcaauaugcgaaaaacaagauuuagagaaagaacucggaucagaaguaguaagaaacaucgaaaaagccauauuugaucaaaggccauuaaaaucacaaaaaggacaaguaggaaaaugcguauuugaaaaaaacaagacuaaaugcccaucaucgcaucccauguaugaggaauucagaauguuaacauucauaaacaauaucaaaaucaagacaccaaacgacgaugucuuacgaccauuaaacacaggagaacgugaaaaaauaaugccauuauucuuuagaaaaaguaaaaaacaauuugacuucgaggauaucacaaaaaaacuugcaccaaaaaaaauguauggauucuauaagaaagaagaagacgccgaaaugccauuucuauucaacuacccuauggacaccucgguaucgggguguccagucacagcagcauuaaaagacguguuuggagacgacuggauaacagcgauaugugaaacauauacauuaggagaggguaaaagcagauucgauauugugaacgauauuuggcaugcacuauauuucuauagugacaaggacaaacuugcagaauuugcaauaaauaggcuccaauuaagugaggaugaagcuaaaaucuuuucagaaauuucccuacccgcagacuacgcuuccuuaucauuaaaagcaauuuguaagauacuaccauacuuaagaagaggcuuaauauacucucaugcuguauucuuagguaaccugugcgaaguaaugccaaaauacgaauggagcauaaaagaaaugagagaaacaaucauagauaacauaaucauggaaauggacaaaugcgauacaaaagacaaaaggacauuugaaguauguauaaaagauuauuuaaaaggacaauauaauguuuccgauaauucgcuaaaaaaacuauaccauccuucaaugauugaaacuuauccucgcguucaauacacuaacgaacacggaguuuaccaacuaggaaguccaagaauagauagugucagaaauccaauggcaaugagaucaauguuuagacuaagaaaacuaguaaauagacuuuuaguugaagguaaaauagaucaaaauacagaaguucauauugaauucgcccgagaacuaaaugaugcgaauaaaagaaacgcaaucgcucuguucguuaaagaaaaccaaucugcaaacgaugaggcaagaaaacaaaucauaacuuuauuuaaaaaggaaacaggaaccgacauagaaccaacggacaaagacauacuaaaauauguacuuugggaagaacaaaaucacauauguuuauacacugguaaacaaauaagaauaagugauuucauaggagcgaauccaaaauuugauauagaacauacaauaccaagaagcguaggcggagacuccacuaaaaugaaucuuacucuaugcgauucccguuuuaauagagaaguaaaaaagacaaaacuaccagucgagcuuccaaaucaugacgaaauaauggaaagaauuaaagaauggaaaaaaaacuaugaauuacuagauauucagauccgcaaaaauaaaaaauuaucaaaaggcgcaacaacaaaagaacaaaaagauacaauuauaagaaaaagacauuuauuggaacuaagaagagacuacuggagaggcaaauaugagagguuuacaauggaaucagucccugaaggauucaguagaagacaaggaacagauauaucagugauaaguaaauacgccagauuauaucuaaaauccuuauuuaacaggguuuauaccguuaaaggaauugcaacgucugauuuucgaaaaauaugggguauucaagacauauacagcaaaaaagaaagaauaaaucauguccaucacugcaucgacgccauagucaucgcguguaucgguuuagaugaauacaacaaacuuggagcauacuaccacgacgaagagaacaauaaaugguacgggaugucaaaagcuucauuuaaaaaaccuugggcaacauucguagaagauaucaaaaaaauucaagacgagauuuuagucuaucauuauacucccgacaacaugccaaaacaaggacggaggagaauaaaaauagacggaaaaaaaauauuaugcaaaggugacgccgcaagggguucacugcauaaugacacauacuacggugccauugaaaaugacggagcaguaaaauacgucaaaaggauugaccuagcaagcuuggaggagaaggacguaaagaauauuguugaugacacuguacgcucuauuauagaagccgcuauaaaagaaaaaggcuucaaagaugcaauggcaagcacaauauggaugaaugaagaaaaacgaguaccaauaaaaaaagucagauguuuuaccccaagcauaacuaaaccauuaaacauacgaaaacaaagagauguaucaauaaaagaauacaagcaacaauaccauguagcaaacgacucaaauuaucuucucgcacuauacauuggcacagacaauaaaggaaaggaaaaaagagaguucgaaaucguaaauauucuacaagcagcacaauacuaccgaacguccaacgacaaagaggucguagacagacauauaguuccgauaaaaagcgaacaugacuauccuuuugcuuacacccuaaaaauuggcaccaugguccuauuauacgaaaaaucaccuaaugaaguuugggacgcaacgaucaaggaacgaaacagaagauuauauaaggucaccggccucucaacuaugagaaugaaagggagaaacggugaauacgcuuaugcaacagugaaauuaauucauaaugaagaagcaagacccucuaaagauaucaaagcaaaaaauggcgaauacgagcaaggagaagaauucagaccggcaauaauuauguuacacacucaauuaaacgcacuaguucaaggguaugacuuugaaauaaaugagcuaggagaaaucagaagacuaagauga

SEQ ID NO: 5204 - RNA, 3654 nt, Artificial Sequence
  Cas9 variant
auggaaaaacaaagaauauuaggucuggauccaggaacaaacucacuagggugggcugucuuggacuucgacaauagcaaacaggaauacaaucuaguaagaaaaggcgaaguaaucuuugaagaaggagugggaaaauccgagaggggagaauuuucaaaggcggcguaccgaacauucuacaaaucaacaagaaaacacuauuucagacgaagacucagaaaaauagaagucuugaaaguacuaguaaaauaugauuucugccccuauuuaucugacgacuuacuaaaacaauggcaugaaaaaaaaauauauccggcaguuaaagaauucauggacuggcaacgcacauccgacgcugaagguaagaacccauacuaugauaggcacuguugcuuaaacgaaaaauuagaucuaucucucaagagcgauagauacauauuaggacgagcucucuaccauuuaacccaacgaagaggcuuuaaaucaaauagauuaauacaaaauaacgacgaaaaugaagaaggaaaaguaaaaaaaggcaucagcgaauuaucaacugaaaugcaagaagcaaacuguaacuaccuaggcgacuacuucuacaaauuauauacagaaaaaggaaacaccguacagauccgcaaaagauacaccgacagagaaaaacauuacaaaaacgaguucaaugcaaucugugaaaaacaagagcuaaaugaaacgauagucaaagaauuagauaaagccauauuuuuucaacgaaaguuaaaaccacaaagacacggaguaggaaaaugcaccuucgaacccaacaacaggcguugugccauuagucaucccgauuuugaaagauuccgaauguuaugcuucaucaauaauauaaaaaucaaaacaccuuucgaagaaaaucucagaccauuaaacaacgaagagaaagcguuaauagaaccacuguucuacaggaaaaguauaaaaaacuucgacuucgaagaaauagccaaaaaacuugcgggaaaaaauaacuauugcuacaucaaagacgacagcuccaaacaguacaaauuuaauuacagaaugucccaaggcgcaagcaccugccaaacaauagccaaacuaaaaucaauauucggagaagaauggaaaaacggaauagcagaaacauauacuaacagaagaaaaaaggaaggguuaaaaaaacaagcagaaaugguggaugauaucuggaacgucuuauauuccgucucugaaugcgauguccuuaaagacuucgcaauaaauaaauuacaauuagaugaaaaaaccgcggauaacuucucaaaaacaaaauuggcacaaggauucgcaacauuaucuuuaaaagcaauaagaaaaauacuaccuuucuuagaacaaggguucggcuauacagaagccguauuccuagcaaauauuccaacggucgucggcaaagaauauuggaauaacgaagacauaagaaaugacauaauggaggaaauaaaaacaauauuuuaccauaacacacucaaaacaaaugacucacacaauacaauccucuucugcauuaaagacauacuaagcaauaacuuugacuuagcacccggagccaucgacaagcuauaccauccguccaugauaaauguauacaaagaugucauaccuaacgaagauggaauauuacaguuaggaucuccaaaaauagaugcaguaaaaaacccaauggcaaugcguagucuacacauaauucguaaagucguaaacgaacuauuacgagaggggauaauaaacucagacacagaagugcgaauagaguacgcaagagagcuaaacgaugccaauaaaagacacgcuauugccgacuggcagaaaaaacaguaugggaaacaccaaaaauaccguaaggagauaaaagaauuauucaaagcagaaacugguuuugaaauagaaccaaacgaaacagacauccuuaaauucgaauuaugggaagaacaaaaccauauauguuuguacacuggucaagagauaggaauaagcgaauucguaggagaaaacccgaaauaugauauugagcacacuuucccaagaagccuaggaggagacucaacaaaaaugaacaugacccuaugcgaaaacaaguuuaauagagaaaacaaacaaaaaaaacuuccaagugaacuagcuaaccacucugaaauucuagaacgaauugaugauuggaaaaaaaaaauauauaucuuacaaaaaaaauaugacaguauacgaacacacaacggaauggacaaagaaaauaaagacaaaaaaauaguuagccgacacaaaauuaaauuagaauuagauuacuggaaaggaaaauauaaccgcuucacgaugacagaaauaccagaaggauucucuagacgucaaggcaugggaaucggauuaauaucgagauacgcgggucuuuaucuuaaaacaauauuucauaaaaaggacaacccacaaaaaucaaauguauacauaguaaaaggaagcauaaccgcugaauuuagaagaauauggaacauacaagacgacuacgagaaaaaaugcagagauaaucacauacaucauuguauagaugcuauagucguuggaugcauaggaaaacgcgaauacgacuuaauggcucaguucuauagagaugaagaaaaauauagaugggaaaaaaagaaaaaaccuuucuuuaaaaaacccugggaaacuuucacucaagauaugcucucccuaaaagacgaaguauugacaguacauuucaauccaucaaauuuuacaaaaaaagcacauaaaaaaguguucacgccaaagggaauauucguagcccaaggcgauugcgcaagaguaaaacuucacaaggguaguuacuuuggagccauugagcaaaaaggcgaaauuaaauacguaaugcgaaaagaacuaagugcauuaaaaauagaagauauaaaaaauauaguagacgccgucguaaaagaaaaaguucuagcuguaguaaaaaaaaaagguuucaagcaagccauggcagaaccaauauacaugaaugaagacaaaagaauacuaauuaaaaaaguacgacuguucguaagucaagcuaauccacuaauagugaaaaaacacagagacuuaucaucgaaagaauauaaacaaaacuacuacguugacaaugaagguaaucucaugauugccauguacgaagguguaaaaaaaaacggaaaaauagacagggaaaucacaguugucaacaaucuagaggcugccaaauuuuuccgucagagucaaaaaaacaacgcggaaaaacagcuaauaucucaccuaucuccuaaaaacgguuaccccuuaaaaaccguccuaacccaaaaacaacuaguccuuauguacgaagacagcccuaaagaaauaaaacuccgggacacaaaaaacaugguaaaaagauuauaucaaguauuuggaauagaaaaagacggcaggguaaaguuaaaauuucaccaagaagccagaucagaagguuuaaacauaaacagcgccgcauucaaaauucaagauacaccugaaucacuauaucgacauacaaaaagcaaccuaaaaguacuagucaacggaguagauuucaaaaucaacauauuaggcgaaauaagccuaauuuga

SEQ ID NO: 5205 - RNA, 3654 nt, Artificial Sequence
  Cas9 variant
auggaaaaacaaagaauucucggucuagauccaggaaccaacucauuaggcugggcaguacuggacuuugacaacucaaaacaagaauacaaccuagugagaaaaggagaaguaauuuucgaggaaggagucggaaaaucagaaagaggagaauucaguaaagcagcuuauagaacauuuuauaaaucaacaaggaaacacuacuucagaagaagacucagaaaaauagaagugcuaaaaguauuaguaaaauaugacuuuugucccuaucugucagacgaccuguuaaaacaauggcacgaaaaaaaaauuuauccugcaguaaaagaauucauggauuggcaaagaacaucagacgcugaagggaaaaaucccuauuacgacagacauugcugcuuaaacgaaaaauuagauuuaagucucaaaagcgaucgauacguauuggguagggcccuauaucauuuaacacaaagaagggguuuuaaaaguaaccgcuuaauacaaaacaacgaugaaaaugaagaaggcaaagugaaaaaaggaaucuccgaacucaguacagaaaugcaagaggcuaauugcaacuauuuaggugacuauuuuuauaagcuauacacagagaaaggaaacacuguacaaauacgcaaaagauauacugacagagaaaagcacuauaaaaaugaauucaaugccauaugcgaaaaacaagaacuaaacgaaacaaucgucaaagaacuugacaaagccauauucuuucaaagaaaauuaaagccacaacgucauggaguagggaagugcacauucgaaccaaacaaucgacguugcgcaauuagucacccggacuucgaacgcuuucgaaugcuuugcuucauaaauaauauaaaaauaaaaacuccauuugaagaaaaccuuagaccguuaaacaacgaggaaaaagcacugaucgaaccuuuauuuuauagaaaaucaaucaaaaacuucgacuuugaagaaauagcaaagaaacucgcuggaaaaaacaauuauugcuacauaaaagacgacaguucaaaacaauacaaauuuaauuauagaaugagccaaggagcaucgacgugccaaacaauagccaaacuuaaaagcaucuuuggugaagaauggaaaaacgguauagcagaaacguauacuaaucgaagaaagaaagaagguuuaaaaaaccaggcagaaaugguagacgacauauggaacguucucuacucgguaucugaaugcgaugugcuaaaagacuucgcaauaaauaaacuacaauuagacgaaaagacagcagauaauuuuagcaaaacaaaauuagcacagggauucgccacacuaagcuuaaaagcaauacgaaaaauacucccauuccuagaacaagguuuugguuauacagaagcaguuuuuuuagcuaacauaccaacaguagucgggaaagaauauuggaacaacgaagacauaagaaaugacauaauggaagaaauaaaaacgaucuuuuaccauaacacacuaaaaacgaacgacagccacaacacaauacuauucuguaucaaagacauucuaaguaacaacuucgaccuagccccuggugccauagacaaacuauaucacccaucuaugauuaauguauauaaagacgugauacccaaugaagacgguauccuacaacucggcagcccaaaaauugaugccguuaaaaaccccauggcgaugagaucacuacacauuauacggaaaguugugaaugaacugcugcgugaaggcauaauaaauuccgacacagaaguaagaauagaauacgcaagagaauuaaacgacgccaacaagagacaugcuauugcugacuggcaaaaaaaacaguauggaaaacaccaaaaauacagaaaagagauaaaagaacuauucaaagcagaaacuggauuugaaauagaaccgaaugaaacagauauacuuaaauucgaacucugggaagaacaaaaucauauaugucuauauacaggacaagaaauaggcauuucggaauucguuggagaaaauccaaaauaugacauugaacacacuauaccaagaaguuuaggaggcgauucaacuaaaaugaauaugacguugugcgaaaacaaauuuaaccgagagaauaaacaaaaaaaauuacccucugaacuugcaaaucacucagagauacucgaaagaauagacgauuggaaaaaaaaaauauauaucuuacaaaaaaaauaugacucuaucagaacacacaauggaauggacaaagaaaacaaagacaaaaaaaucguuaguaggcauaaaauuaaacuugaauuagauuauuggaaaggaaaguauaauagguuuaccaugaccgaaauaccagaaggauuuucaagacgacaaggaauggguauuggucuaaucagccgauacgcaggacuauaccuaaaaacuaucuuucacaaaaaagacaauccacaaaagagcaacguauacauaguuaaaggaucaaucacagcugaauucagacgaauuuggaacauucaagaugauuacgaaaaaaaaugcagagauaaucauauacaccacugcauagacgcuauagucguugguugcauagguaaaagagaauaugaucuaauggcacaauuuuacagagacgaagaaaaauaucgcugggaaaaaaaaaaaaagccauuuuuuaaaaaacccugggagacauucacacaagacauguuaagccuaaaggacgagguccucacaguccauuucaauccuagcaacuucacuaagaaagcacacaaaaaaguauucacaccuaaagggauauuuguagcccaaggcgacugugcaagagucaaacuacauaaaggaaguuacuuuggggcaauugaacaaaaaggcgaaauaaaguauguuaugagaaaaaaacuaucagcacuaaaaauagaagauaucgaacauauuguagacgcaguagugaaagaaaaaguacuagcagugguaaaaaagaaaggauuuaagcaagccauggccgaaccaauauacaugaaugaagacaaaagaauacuuauaaaaaaaguacgauuguuugucucucaaacgaacccucuaauaguaaaaaaacacagagaucuuucaucaaaagaauauaaacaaaacuauuauguagauaaugaaggaaaccucaugauugcaauguacgaaggagucaaaaaaaacggaaaaaucgacagagaaauaacaguaguuaauaaucuagaagcagccaaauucuucaggcaaucgcagaaaaauaacgcagaaaaacaacuaauuucacaccugaguccaaaaaauggauacccacuaaaaacuguccucacacaaaaacaacuaguacuaauguacgaagauagccccaaagagauaaaacuacgagacacaaagaauaugguaaaacgccuauaccaaguauucggaauugaaaaagauggacgaguagaguuaaaauuucaccaagaagccagaucagaaggucugaacaagaacagugcggcguucaaaauucaagacacacccgaaucccuauaucgacauacaaaaucaaauuugaaaguucuuguuaacggcguggacuucaaaauuaauauuuuaggugaaauaucauuaauauga

SEQ ID NO: 5206 - RNA, 3654 nt, Artificial Sequence
  Cas9 variant
augaaauauaacuauguacuagggcuggauauaggaauuaguucaguuggaugggguuuacuagcacuagaugaaaacaacaacccuuacaaaauaaucgacguaggauccagaauauuuuccccaggagaaguggagaaaacaggagacucaaaagcaaaagaaagaagagagaaaagaggaacaagaagaguaauacgcagaagagaguucagacucgauagaguaagaaaucuacucuacgaaaaaggauaucuaaaagguaacauaacaaguaacaucguuucagucaaaaacgaagaauuaacaauuaucuucaacgacauggugaauaauuacuacaaauccaaagauacaaauccguauaaacuuaaaguagaagcgcuggauaggaaacuaacaaaugaugaauuaucuauaauauuaguacauuaugccaagaaaagaggguacaaaagcaauagagaagaaaguagugacaaugacaacgguaaaguaaaagaagcaauaaaagaaaacacaaaucuaauggaagaaaagaaauacaggacaauaagcgaaauguacauuaaaaacgaaaaauuuaaaaauaaaauuaaaaauggaccagaugacuacaagcuaucuguuacaaacgaaauguaucuagaagaaauaaacaaaguauuagacagccaaauaggauuuggacuaauugacgacaacuuuaaaaacgaauauuuagaaaucuacaacagccgcagacacuacuccgaagggcccggauauuauuacgcgaaagacgcaaacggaaauaaaguuaaagucagaagcccauacgguggugaccuaauuaagaaaaugacgggaguaugcuccuucgauaagaaagccagagcgcccaaauaugcguucagcucagaauuauucguaucaaucucaaaguuaguaaaucugcguuacaaaauagaugacgacagcuauaaacaacucaccaaagaacaaauuaacgaacuuaucgacgaagcuaaaaauaaaaauaaaguuacuuacaaaucacuaauaaaaauacuaggaaucaaaaacauuaaaguaaaagaccuaaaucucaguaaaucugaauauauaaaaguuauagacgaacuaaagaagaaacugaacauaucaaaagaagagaaaauugacauauacucacucgacgaagaaaacaagaaaauauaugacgauauauauaaugaaaaacuuuucucaaaaacacuuauagaauuuaaaggauacaaucuacuaaagaaagcaauaacacuaagcuauaacagcggcacuuggaacgacguaaaagacaauauagaguuccuagaugaacuggcacuauacuguacagauuauaaaguaaacaaugaaauucaggaacauauacauaacucacuaaucaucgacuccagauucgaugauucaaauuucgucgaaaaccuaccaaauuucaaagaccaccuuaugcuaucaacagauaucauuagaaaacuaauccccauaauguuagaaggaauaacauacgauaaagcgauggacaaaauaggguacaaccauagcaaccucuacaaagauacaauaaaagaagaucuguuagugccaguauauguuuccaaaaauaucaccaaucaaagagucauccgaucauuaacccaagcacgaaaaguaauaaaugcaauaaucaagaaauacgguagcccuaaaaucauuaacaucgaaaccgcaagagaauuagccaaaacacaaaaagaaaggcguauuaucgagaaaaaucaacaagacaaacaauacgaaaacgaacgaauaaagaaacacuuaguggaacuagaauuguucucagacgaaagcaaaauaacaggaaacgacuugcuaaaauacaaacuauggcaagaacaaaaagaguucugcggcuacaguaugaagaaaaucaaacuggaagaccuauucagcaauaacauaguacaaauagaccauauauuaccauacucacgaaccuauaaugacaauuacuuaaacaaaacacugguauauacuaaauacaaccaagacaaaggaaacaaaacaccauacgaaugguucggaaaaacagacaaauggcaagaauacgaagcguucauaaauagccugucgauaagccaaaacaagaaagauaacuaucuccuuaaaaaccuagaucaagacgcugaacgagaaaugagagagcaaaaccuaaacgauaccaaauauauaucaagggagcuauuaucguuaauaaaagcauaucuuaacguugacgaaguaaaugcauuccccggagcaaucaccgcaaaauuaagagcacgauggggcuucaacagauuaacccauuccuauauaagcaaaaccuauaucaugcccgaagacaugaagaaaggaauaaacaaagauagagacaaccacuuacaccacgccauggaugcgcucguuauagcaagcaucacaaaaucacugcagcagaaaauaacccuuuacgaaaaauuuuccagauacguagauggaauaaccaaaaacgaacuagggaaaauauccacgggaaacauaaaugaugaucuuuacaacuauuacgaugaagaaacuggagaaaucaaagaacuagaacucagacaauacauuaaaaaccaaguugcccaaaacaauauuuacuuuucuaaacacaacguauccaaacuaauauucccaacaccauauaacaacuuugucgaagaggcaaaacuuaggguauaugaaagagaucucgaaguacuuaaauggaaucugaaaaaucuaggaacauacaccagcagcgaacuaaacaggauucacguauuaauaccaaguguugcuaaaaauaaaauaaguggacgauuacacgaagaaacauacuauggacucaaagaaguggguaucggagaggauaaaguaacuuacaaaacccucaaaacaccuaucaguaaagucaaaaagaaagaucucgauaauauacccgacugcaaagguggaucaaaagacauauauaaugcuuuaguaaaaugguuuggaaacugcgagacuggagaagaagcacuaaaaaugcacgaugguaaauauccugucaacccaaacgauaaagaacaaaaagaaaucagaaaaauuaaaguauacacaaaauacaacgcgaccgggcacguaguaaacaaugguaacguugaaaaaggaggaauauauagaaucgauguauucaaaagcaaaaauaaagaagacaauaaacuuuacuucacaucauaugauauauuugaaauagaacaaaucaaggcuuacgaaaaaggcaaaaauaucaacuuuagcauaaaacuagaauauggccaagguaaaaauaauaaaauacuacuauacaaagacgugaaaaacgaauacgacuuaauaaugaguauauacaaaaacgaccuaauaagaauaaaaacaaaaacaggaaauaaauccacagccuauguaguaggcuucucaggagguaaacuggagauaaaaaguacaauuggagauggguacgauauaauaggcaauaauaacauauucgacaaaagcauggagagguauagaguaaccaguagcacgauaguaaaaaucgacaaauuaagcauaagcauacugggugaaguaagcgguuuauga

SEQ ID NO: 5207 - RNA, 3657 nt, Artificial Sequence
  Cas9 variant
augaacaaaagaauacuaggauuagauacagggacaaauagccuaggcugggcagugguagauugggaugagcacgcgcaauccuacgaauuaaucaaauacggagaugucaucuuucaggaggguguuaaaauagaaaaagguaucgaaucuucaaaagccgcagaaagaucuggauauaaagcuauuaggaaacaauacuuuagaaggcgacugagaaaaauacaaguauuaaaagugcuuguaaaauaccaccuguguccauaccuaucagacgacgaucuuagacaauggcauuuacagaaacaguacccaaaaucggaugaacuaauguuauggcagagaaccucagaugaagaagggaaaaauccauauuaugaccggcacagauguuuacacgaaaaacuggaccucacaguagaggcagacagauacaccuuagguagagcccuauaucauuuaacacaaagaagaggauuccuuucuaacagauuagacacaucggcugacaacaaagaagauggaguugucaagucaggaauaagccaauuaucuacggaaauggaagaagcaggaugugaauaucuaggagauuauuuuuauaaacuauaccaugagcaagguaauaaaguaagaauacgacaaagauauacagacagaaagaaacacuaccaacacgaguuugaugcuaucugcgaaaagcaagaauuaucuagcgaauuaauagaagacuuacaaagagcaaucuucuuccaacugcccuuaaaaucucaacgacauggaguuggaagauguacauucgaacggggaaaaccacgcugugcugauagccacccagacuacgaagaauuuagaaugcuauguuuugugaauaauauacaaguaaaaggaccacaugaccucgaacuccgcccacuuacauacgaagaaagagaaaagaucgaacaucucuucuuuagaaaaaguaaaccaaauuuugacuuugaagacauagcaaaagaauuagccgguaagaaaaacuaugccuggauacacgauaaagaggagcgcgcauauaaauuuaacuaccgaaugacccaaggggucccagggugcccaaccaccgcacaacuaaaaaguauuuucggagacgauuggaaaacuggaauagcagaaacauauacacuaauucaaaagaaaaacggaaguaaaucacuccaagaaaugguugaugacguauggaauguacucuauucauucaguucgguugaaaaacugaaagaauuugcacaccauaaacuacaacuugacgaagaaaaugcugagaaauuugcgaaaauaaaauuaucacacagcuucgcagcauuaaguuuaaaagcuauaagaaaauuccuacccuuccuaaggaaagggauguacuauacacacgccagcuucuuugccaauauccccacuaucgucgguaaagaaaucuggaacaaugaacaaucuagaaaauauauuauggaaaauguuggggagcuaguguucaacuaccaacccaaacauagagacguccagggaaccaucgaaauguuaauaaaagauuuccuagcaaauaacuucgaacuaccagcaggagcaacagacaagcuauaccacccaucaaugaucgaaaccuauccucacgcgcuaaggaaugaauuugggauacuccaacuaggcucaccuagaacaaaugccauucguaacccaauggcaaugagaucauugcaugugcuuagaagaguuguuaaccaacuauuaaaagaauccauaauugacgaaaauacugaaguacacguagaauaugcgagagaauuaaaugacgcaaauaaacguagagccauagccgauagacaaaaagaacaagacaaacaacacaagaaauacggggacgaaauacgaaaauuguauaaagaagaaaccggaaaagauaucgaaccgacacaaacugauguacuaaaauuccaacuaugggaagaacagaaucacuauugcuuauauaccggcgaacaaaucggcaucacugauuuuauaggaucaaacccaaaauucgauauagaacauacaauaccacaaucaguuggaggagacaguacccaaaugaacuuaacuuuaugcgauaauagauuuaauagagaagucaagaaagcaaaauuaccaacugaacucgcaaaucacgaagagauauugacgaggauagaaccauggaaaaauaaauacgaacaauuaguaaaagaaagggacaaacaaagaacguucgcuggaauggauaaagcuguaaaagacauaagaauacaaaaacgacacaaauuacaaauggaaauagacuauuggcgcggaaaauacgaaagauucacaaugacagaagucccagaaggauuuucaagaagacaaggaacuggcauuggauugauaucuagauaugccggucucuaucucaaaucacuauuucaccaggcagauucccgaaauaaaaguaacgucuauguagucaaggggguugcuaccgcagaauuuagaaaaauguggggccuacaaucugaauacgaaaagaaaugcagagacaaucacucacaccacuguauggaugcuauaaccauagcauguauuggaaaaagagaguacgaccuaauggccgaauacuaucacauggaggaaacauuccgacaaggaagagguagcaaaccaaaauucucaaagccaugggcaacuuucacagaagauguacuaaauaucuacaaaaaucuauuagucguccacgacacaccuaauaauaugccuaaacacacuaagaaauauguccaaacuucaaaaggaaaaguauuggcacaaggagacacagcacgaggaucacuacauuuggauaccuacuacggagcaauugaacgagauggagaaauccgauauguaguaagacgcccacugaguagcuuuacaaacccaaaagaauuagaaaacauaguagacgaaaccguaaaaagaaccaucaaagaggcaaucgcagacaaaaauuuuaagcaagcaauagccgaaccuaucuacaugaaugaagacaaaggcauucucauuaagaaaguaagaugcuuugcaaauagcgugaaacagccaauaaacauaaggcaacacagagacuuaagcaagaaagaauacaaacaacaauaucauguaaugaaugaaaauaacuauuuauuagcgauauacgaaggauuaguuaaaaacaaaguaguaagagaguuugaaauuguaucuuacaucgaggcagcaaaauauuauaaaagaagucaagacagaaauauuuuuaguucaauuguaccuacgcauaguacaaaauacggauuaccuuuaaaaacaaaauuacugaugggacaacaaguauuaauguuugaagaaaauccagacgaaauacagguagauaacacaaaagaucuaguaaaacguuuauacaaaguggugggaaucgaaaaagauggacguauaaaauucaaacaccaccaagaggcuagaaaggaaggauugacuauuuacaguaccccauauaaaaacaaugacgauuaugucccaauuuuucgucagucaauuaaaaacauuaauauauuagucgauggaauagauuuuaauauugauauccuaggaaaaguaacccuaaaagaauga

SEQ ID NO: 5208 - RNA, 3657 nt, Artificial Sequence
  Cas9 variant
augaacaaaagaauauuaggcuuagacaccggaacaaauucucuaggaugggcaguagucgacugggaugaacaugcacaaucauaugaacuaaucaaauauggagacgucauauuccaagaaggaguaaaaauagaaaaaggaauagaaagcagcaaagcagcagaacgauccgguuacaaagcgauaagaaaacaauacuuuagacggagauuacgaaaaauccaaguacugaaaguauuaguaaaauaucauuuauguccauaucucucagacgacgacuuaagacaauggcaccuccaaaaacaauauccaaaaagugaugaacuaaugcucuggcaacguacaucagacgaagaaggcaaaaauccauacuacgacagacauagaugcuuacacgaaaaacuagacuuaacgguagaagcagacagauauacacucggcagagcccucuaucaccucacccagaggagaggauuccuaucaaaccgguuagacacaucugcagacaauaaggaggacggugucguaaaaucaggcauaucacaauuaucgacggagauggaagaggcaggcugcgaauaucucggcgacuacuuuuauaaauuguaugacgcacaggggaauaaagucaggauaagacaaagauauacggacagaaauaaacauuaccaacacgaguuugaugcaauaugcgaaaaacaggaacuaagcagugaacuaauagaagacuuacaaagagcaauuuucuuucaauuaccucuuaaaucgcaaagacauggaguaggucguuguacuuucgaaagaggaaagcccagaugcgccgauagccacccagacuaugaagaauuucgaaugcuguguuucgugaauaauauacaaguaaaagguccccacgaccuagaacuccgaccacuaacguaugaagagagagagaaaauagaacccuuguucuuuagaaaaucuaagccaaauuucgauuuugaagauauagcaaaagcacucgcaggcaaaaagaacuaugcauggauucacgacaaagaagaaagggccuacaaauuuaauuaucgaaugacacaaggaguaccaggaugucccacuauagcacaacuaaaaucaauauuuggcgacgacuggaaaacaggaauugcagaaacauauaccuuaauccaaaagaaaaauggcagcaaaucuuuacaggaaaugguagacgacguauggaaugucuuauacucauuuucaucaguagaaaaacucaaagaguucgcacaccacaaauugcaauuagacgaagaaucagcggaaaaauuugccaaaauaaaauuaucucauucauucgcagcuuugagccuaaaagcaauacguaaauuccuaccauuccuacguaaaggcauguacuacacccaugcaucauucuuugcaaacauaccuacaauaguaggcaaggaaaucuggaauaaagaacaaaaucgaaaauacaucauggaaaacgugggugagcuaguauuuaacuaucaacccaaacacagagaaguacaaggaaccauagaaaugcuaauaaaagacuuccuagccaauaacuuugaacuaccugcuggagcaacugacaaacucuaccaucccagcaugauugaaacuuauccaaaugcacaacgaaacgaauuuggaauccuacaauuagguucgccgagaacaaacgcaaucagaaauccgauggcaaugcgaagucuacacaucuuaagaagaguaguuaaucaauuauuaaaagaaucaauaauagaugaaaauacagaaguucacguagaauacgcucgggaguuaaacgaugcaaacaaaaggagagcaauagcagacagacaaaaggaacaagauaaacaacacaagaaauauggugaugaaauaagaaaacuuuacaaagaggaaacaggaaaagacauagaaccuacccagacugacguccuuaaguuucaacucugggaagaacaaaaccaucacugcuuauauacgggcgaacaaaucggcauaacagacuucauaggaucaaacccuaaauuugauauagaacauacaaucccgcaaucaguaggaggugacucaacacaaaugaacuuaacucuaugcgauaacagauuuaaccgagaaguaaagaaagcgaaauuaccaacagaacuugcgaaucaugaagaaauucuaacuagaauagaaccauggaaaaacaaauaugaacagcuagugaaagagagagauaaacaaagaacuuuugcaggaauggauaaagcaguaaaagacaucagaauacagaaacgacauaaauugcaaauggaaauagauuacuggagaggaaaauaugaacgcuucacaaugacggaaguaccagaaggauuuaguagaagacagggcacuggcauaggauuaauaucucgauacgcagguuuauaccucaaaucauuauuucaccaagcagauagucguaauaaaucaaacguauauguaguaaaagguguagcaacagccgaauuucggaaaauguggggauuacaaucagaauacgaaaagaaauguagagacaaccacagccaucauugcauggacgcuauaaccauagcuuguauaggaaaaagagaauacgaccuaauggcugaauacuaccgaauggaagaaacauucaaacagggcagaggaagcaaacccaaauuuagcaaaccgugggccacuuuuacggaagacguacucaacaucuacaaaaauuuacucguuguacaugauacuccaaauaauaugccuaagcacacaaagaaauacguucaaaccucaauaggaaagguacuagcacaaggcgacaccgcccgaggaucgcuacacuuagauacauacuauggagcaaucgaacgagacggagaaauuagauauguggugaggagaccucuuucaucuuucacuaaaccagaggaacuagaaaacauugucgacgaaacugugaaaaggacaauaaaagaagccauagcagacaaaaacuucaagcaagcaauagcagaacccauauauaugaacgaagaaaaaggaauacuuauuaagaaaguucgcugcuucgcaaaaagugugaaacaaccaaucaacauaagacagcacagagaucuaagcaagaaagaauacaaacaacaauaccacguaaugaacgagaauaauuaucuucucgcaauuuacgaaggccuaguuaaaaacaaaguaguaagagaguucgaaauaguaucauacaucgaagcugcaaaauacuauaaaagaucccaagauaggaacauauucaguucaauuguucccacucauagcacaaaauauggguuaccacuaaaaacaaaauuacucaugggacaauuaguacugauguucgaagaaaauccggacgaaauucagguagauaacacaaaagaccucguaaaaagauuauauaaaguaguuggaauagaaaaggacgggagaaucaaauucaaauaucaucaagaagcuagaaaagaaggacuccccauuuuuaguacacccuacaagaacaacgaugauuaugccccaauauucagacaaaguauaaacaauauuaauauucuaguagauggaauagacuuuacaauagacauacuugguaaagucacguuaaaagaauga

SEQ ID NO: 5209 - RNA, 3657 nt, Artificial Sequence
  Cas9 variant
augaauaaaagaauacuaggacuagauacaggaaccaacucacuaggcugggcaguagucgauugggaugaacaugcccaauccuaugaguucauaaaauacggagaugucauauuccaagaaggaguaaaaauagaaaaagggauagaauccucaaaagcagccgaaagaucaggcuacaaagccauacgaaaacaguauuuuagaagacgacuaagaaaaauacaaguacuaaaaguauuagucaaauaucauuuaugcccauaucuuagugaugacgauuuaaggcaauggcaccuacaaaaacaauacccaaaaucagaugaacuaaugcuuuggcaaagaacaagcgacaagaaagguaaaaacccauacuacgauaggcauagaugucuucacgaaaaacuugaucuaacaguagaagccgacagauauacccuaggucgugcauuauaccaccuaacacagcgccgaggcuuucuaucaaacagauuagauaccucugccgauaacaaagaagacggaguaguaaaaucaggaauaagucaauuaaguacugaaauggaagaggcuggaugcgaauaucuaggagacuacuucuauaaacucuaugacgagcaagguaauaaaguacgaauaagacaaagauauacagaucgaaacaaacacuaccaacaugaauuugacgccauaugugagaagcaagaacucaguuccgaauugauagaagacuugcaaagagcaaucuucuuucaacucccacucaaaucccaaagacacgguguugggagaugcacauuugaacgaggaaaaccgagaugcgcugauucucacccagauuacgaagaauuuaggauguuguguuuuguaaauaauauacaagugaaaggcccacaugaucuagaacuuaggccauugacuuaugaggaaagggagaaaauagaaccccuguucuuuagaaaaagcaagccgaacuuugauuucgaagacauagcaaaggcacuagccgggaagaaaaacuaugcauggauucaugauaaagaagaaagagccuauaaauucaauuauagaaugacgcaaggaguaccuggauguccuacaacagcacaacugaaauccauuuuuggagaugacuggaaaaccggaauagcagaaacauauacguuaauacagaagaaaaacggaucaaaaaguuuacaagaaauggaagaugauguauggaauguuuuauauagcuucucaaguguagaaaaauuaaaagaauuugcccaucacaaauuacaauuagaugaagaaucagccgaaaaauuugcgaaaauuaaacucagucauaguuuugcagcccuaucacugaaagcaauaagaaaauucuugcccuuucuaaggaaaggaauguacuauacucacgcgagcuucuucgcaaacauuccaacaauaguaggaaaagaaauauggaacaacgaacaaaaccgcaaauacauaauggaaaauguuggagagcuagucuucaauuaccaaccaaaacauagggaaguucaaggaacaauagaaauguuaaucaaagauuuucuggcaaacaacuucgaacugccagcaggagcaacagauaaauuauaccacccaucaaugauagaaaccuauccacaugcacaacguaacgaguucgggauacuacaacuggguucaccaagaacaaacgccauaagaaauccaauggccaugagaucacugcacauuuuacgaagagucgucaaucaauuacugaaagaaucuauaauagacgaaaauacagaaguacacguagaauacgcaagagaacuuaaugaugcaaacaaaagacgagcgauugcaggcuggcagaaagaacaagacaaacaacauaagaaauauguggacgaaauacguaaauuauauaaagaagaaacgggcaaagacauugaaccaacccaaacagauguuuuaaaauuucaauuaugggaagaacaagaccaucauugcuuauauacaggagaacaaauaggcauuaccgacuucauaggcucaaacccuaaauucgauauagaacauacaauaccacaaagcguagguggagacaguacgcaaaugaauuuaacauuaugcgacaacagauuuaacagagaaauaaagaaagccaaacugcccgcgcaguuaagcaaccacgaagaaauacuagcccgaaucgaaccuuggaaaaauaaauaugaacagaaaauaaaagaaagggacaaacaaagaaccuucgcuggaauggacaaagcggucaaagaucuacgcauacaaaaacgucacaaacugcaaauggacauugacuacuggagagguaaauaugaaagauuuaccaugacugaaguacccgaaggauucucaagaagacaagggacagggauaggauuaauaucgagauacgcagguuuauacuuaaaaagccuauuccaucaagcagauuccagaaacaaaucaaauguuuauguaguuaaaggagucgcaacagcggaguucaggaaaauguggggauuacaaucggaauacgaaaagaaaugcagagacaaccauucccaccacugcauggacgcaauuacaauugccugcauagguaaaagagaauaugaucuaauggcagaauacuaucgcauggaagaaacauuuagacaaggcagagguaguaaaccaaaauuuaguaaacccugggcaacauucacagaagauguauuaaacauauauaaaaauuuguuaguagugcaugacacuccaaauaauaugccuaaacauacaaagaaauauguucaaaccucaaaaggaaaaguucuagcacaaggcgacacagcuagagguuccuuacaucucgauacauacuacggagcaauagaaagggacggcgaaauacgauaugucguuagaagaccauugucaucuuucacaaaaccaaaagaauuagaaaauauuguugaugaaacgguaaaaagaacaauaaaagaagcaaucgcagacaaaaauuuuaaacaagcaaucgccgaaccuauuuauaugaaugaagacaagggaauacuaauaaagaaaguacgaugcuucgcuaaauccguaaaacaaccaaucaauauacgacaacaucgagauuuaagcaagaaagaauacaaacaacaauaucaugucguuaacgaaaacaacuacaugcuagucaucuacgaaggucuuguuaaaaacaaaguaguacgagaguuugaaauagucucauacaucgaagccgcaaaauauuauaaacgcagucaagaucgaaacauauucuccuccaucguuccaacacacucagcaaaauacggacucccacuaaaaacaaagcugcuaauggggcagcuuguacugauguucgaagaaaacccagaugaaauacaagucgauaacacuaaagaucuaguaaagcgcuuauacaaaguaguagguauaaagaaagaugggagagugaaauucaaauuccaccaagaagcaaggaaagacggacuguuaauauucucaaccccuuauaaaaacaauaacggauacguuccaauauuuagacauagcaagaaaaacauaaacauacuuguagacggaaaagacuucacuauagauauacuuggaaaaguaacauuaaaagaauga

SEQ ID NO: 5210 - RNA, 3660 nt, Artificial Sequence
  Cas9 variant
augaaagaagaaguacgaggcaaaaaccggagccagacaugggcaauuuuagcaaaauucuuuguguggagugaaaaagaaaguguguggaacgaaaaagaagcgagaacugaagaacgaguaaaagaauacaagcuagugggauuaaaaagagauacaaaagguaacgaauugaaacuagaaaauuaucguuggagaguacaagcccuaucagaacaacuaaaucccgaaaucguagccauaguacuucaagaaauaaauggacaaauaucagcaucaucaggguaccugggcgcuaucucugaccgaagcaaacaacuuuauuuuaauagacaaacaguaggacaauaccuaaugagugaacuugagaaagacccuaacguaaguuugaggaaucgagucuuuuacagacaagauuauuuagacgaguuugacagaauaugggaaaaacaagcagaauuucaugaagaauuaacuguagagcuuaagaaagagauaagagacauuauaauauuuuaucagcgucgacuuaaaagccaaaaaggauuaauaucauuuugugaguuugaaaaacgcgaagucgugguagaagaagauggacgaaagaaaaauaaaaccgugggaugucgcguaauaccaagaagccauccccuguuccaagaguuuaaaauauggcaaacacuaaacgacauagagguauuugcgugggauaaacaaucaaaaagaaagaaagcagacaaaaguucaauauuauuugacaauucagaagaugcacuauuaguagaaggaaaaagauuccuauaucaagaagaaaaagaacuucuagcaaaagaguuauuuguaaaagaaucuaugaagaaagcugaagugcuaaaacuacuuuuugaaaacuaucaagaacuagacuugaacuuuaaacagauagacggaaaccacacagguuuugcacuauuuagugcauauucaaaaaugauagaaaaauacggauacgaaccaguggacuuuaaaagaucagcagaugaaauaauagaaaaacuugaaacaaucuucacaaacuuagguuggaauacagaacuuuuaucaauugaccugagcaaagaagacaaagaacuugaaaggcagucauacuucagauuauggcaucuauuguauucauucgaaggggauaacaccccaaccgggaauggaaaacuauuagagaaaauaaugcaacuuugugauguugaaaaagaauaugcgguggaacucgcuaauguuucauuccaggaagauuaugggucccucucagcgaaagcaauaaagaaaauccuaccauacuuaaaagaaggcaaucaauacgauguagcgugcgacuacgcaggauauagacauucaagaaguucacuaacaaaagacgaaauagaaaauaaaauauuaaaagauaaacuagaaauauuaccgaaaaacucacucagaaacccaguuguugagaaaauauuaaaucaaaugguaaacuugauaaacacguugauugauacauacggaaaaccugaugaaauaagaguugaacuugcacgugaacuaaagaaaaaugcuaaagaaagagaagaacuaacaaaaucaauagccagaaauacacgcgaacacgacgaaauaagacaacuacuaagaacagaauuuggcaugaugaauguuagcaggaacgacaucauacgauacaaacuuuaugaagaacucaaagauaauggauauaaaacauuauauaguaaugaauacauaccaagagagaaaauauuuucaaaagaaauugacauagaacauguuaucccccaggcccgauuauuugacgacucuuuaucaaacaaaacacucgaauaucgugcaauaaacauagaaaaaggaaacaaaacagcauacgauuuugugaaagaaaaauauggcaaugauggcuuagaaaaauuucugaacagaugugaaacacuauucaaagauaaaagaacuaaacucagaaaauuaaaaauggaagaaaaagacaucccagaaggauucaucgacagagaucuccgaaacacacaguauauaucaaagaaggcauucgcgaugcucaaugaaaucagccggaggguaguagcaacaacaggaaguauuacagauaaacuaagagaagacuggcagcuaguggaccuuaugaaagaauuaaacuuaccgaaauacgaaaaauuagggauggucgaaauguuugaagauaaagacggaagaaaaauaaagaaaauuacagauuggacgaaaagaaacgaucauagacaccacgcagucgacgcacuaacgguagccuuuaccaaagacguauuuauucaauuuuauaauaauaaaaacgcagcauggaugccagcguccaaagaacaugcaaacaucacagguauuaaggcccgauacuuugagaacgguaaagcucuagccccaaugccauuagcucaauuccgggcagaagcuaaaagacaccuagaaaauuuauuaguaucuauuaaagcgaaaaauaaaguuauaacaucaaacguaaacagaacgaaaaacaaaaauggcgagaaccgaaaauuacaacaaacaccacgcggucaauuacaucucgaaacuguauauggaagucacagacaauacgcaacaaaaauagaaaagguaaaugcagccuuugauguuacgaaaauagcuacagugagcaaacuagccuacagaaaugcacuauuaaaacgauuagaagcauuuggaaacgacccuaaaaaggcuuuuacaggcaaaaacacacuagagaaaaacccauuguacuuggacgaaaaccaaacagaaaugguacccgaaaaagugcaaacgguagaguucgaaaccguguacacaauaagaaaaccaauagacccuaaccugucaaucgauaaaguaguagaugucaaaauacguagcguucuagagaaaagacuaaaagaauauggaggggacgccaagaaagcguucguaaaucuagaugaaaacccgauaugguuaaaugaagcgaaaggaauuagcauaaaacgaguuucaauacgaggcauuuccaacgcccaaucuuuacaugaaaagaaagacaaagacgguaaccuaauacuagggaaagaaggaagaaagauuccagucgacuucgucaacacgggaaacaaccaucauguugcuauauacaaaaagcccgucuuagacaaggugggacaaguagucuuagacgaagaaggaaacccgaaauaugaacuagacgaaguaguuguaucuuucuucgacgcaguaacaagagccaaccugggccaaccaauaauagauaaggauuaccgccgaucggaaggcuggcaauucuuauucucaaugaaacagaacgaauauuuuguguucccaaaugacaaaacaggauuuaacccaaaagaaguagaucuacugaauccagaaaacuaugcucuaaucucgccaaacuuauucagaguacaaaaauuugcguauaaaaauuacgucuuuagacaucaucuugaaacgaccauaaaagauaccagcuccacuuugaaaggaauaaccuggaccgacuuuagaucgaguaaaggauuagauaaaaucguaaaggucagagucgaccacauaggacaaauaguaucaaucggugaauacuga

SEQ ID NO: 5211 - RNA, 3663 nt, Artificial Sequence
  Cas9 variant
augaaaagaauccuaggccucgacuuagggucugcaucaauuggaugggcucuaauugaggaagaugaaaaagguauaagaaucauagccuuaggaucacgaauaauaccuuauaacggaacagaaggccaagacuucgcaaaaggugcgggugaaaguagaaacucacugagaacccaagcaagaaccacaaggaaaggcuacgauagauaucaguuaagacgaaaauaccugauaaauguucuagagaaaaaucuaaugaugccgagcgaagaccuaagaaaaaugcccaaaaugaaccuauggcaacuaaggucuaaagcagucacagaauauauaucuaggcaagaacuuggaagacuacuauugugguugaaucagaagagagguuauaaaaguucacguuccgacgcaaaccuugacaagaaagauacugacuacgucaaagaaguaaaaucaagauuugauaagauaaaggagaaaaaucaaaccauaggacaauauuuuuacgaaagucuucaaugcgacgaauacuucagaguaaaggaaaacguuuuuccaagagaagcauacauagcggaauuugaugcaauauguagcagacaaaaagaucaucuaggacuaagugaagaacucauugcugaaauaaggaaugaaauuauauacuaucaaaggccauuaaaaagccaaaaaggucucguaucaguguaugauuucgaaggcaaauggaugaaccaaaauggaaaagaauuauucauaggaccaaagguagcgcacaaaucauccccauuauuucaacuagcuaaaaucugggaaaguguuaauaauauuaaauuaaguacaaaauauggugauacaauagaguuaacacucgaagagaagaaacagcuagucgaguuccuagauaacaacgaaaaacuuacaacggcagcacucuuuaaaauauugaggaaagauaagaaagaauauauacuuccaaaacaacuggaaaaaggacuacaaggaaacauaacgaaauguaaaauagcugauauucuaggcucgaaauauaaucaacuauuacaacuaaaucuagaaaaacaagaaguaggaaccccauguuaccuauacacaaaaucaacaggagagguauuaggagaaaaacccuugcaauauaucgauaaaagcguugaaaaagaguuauuuuaccagcuauggcacaccaucuauagcauaucagaugaagaugaaugcuguaaagccuuacagaaaagguucgacauagaugcagaaacagcaggcagacuagccaaaauugacuucucaaaauauggcuucggcaauaaaagcgcaaaagcaauccgaaaaauacuaccauaucuuauggaaggagacaaauacagugaugcaauguguuacgccggcuauaaccacagcaauucauuaaccaaagaagaaaaccaugaacgaaaacuaaacgauaagcuaaaauuacuaacuaaaaacuccuugagacaacccauaguugagaaaauaaugaaccaaaugauacaauuaguaaauacaauaauagauaaauacgggaagccagacgaaauaagauuagaacucgcacgagaacugaaacaaucuaaagaagaaaggaacgaugcagacaaagcuaugagcaaacggcaaagagaaaacaaagaggcagagaagaaacuagaagaacaugguauacgugccacacauaacaauauauuaaaauauaggcuauuugaagaaaugggggagaagaaacacgaagcaauauguauuuacugcggaaaucccauuaguuuuucagcagcaaugaacggugacgaagucgacguagaacauauaaucccaagaucaaaacuuuuugacgauucucagaguaacaaaacacuagcccacagaaaauguaaugcaaacaaaaacgauaugacagcuuacgacuuuaugaaaaccaaauccaaacaagacuuugacaaauauguagaaaggguuaaucaauuauacgcggauagaaucaucagucguaguaaauacaacaaauuacuuaugagcgaagaugauauaccaaguaauuucauugacagacaauuaagagaaucacaauacauagcaacaaaagcccgagaaauuuuacaaacaaucugcuacaacguauggucaacaaguggaacaguuacggcagaacuacgccacuuauggggcugggaugauauuacaaugaauuuacaaaugccaaaauauaaagaauuaggacugacagaaaugguagaauggacuucugaccauggcaaaaauguccacucaaaagaaguaaucaaaggauggaccaaacgggacgaccacagacaccacgcuauagaugcccugaccauagcuuguaccaaacaggguuucauacaacgauuuaauacauuaucaucgucaaaaacaagagaugacaugcaaaaagaacuagaaaaauguucaauacaauucagagaaaaacgaucguuacuugaaaaauacauaaucagucaaagaccaauaagcguaucagauguagcugaagcaguaucacgcauucuaauuagcuucaaagcaggaaagaaaguagcaacuauaggaaaaagaaaagucaaaggcaaaguaguacaacaaggaauaguaguaccaagaggagcucuuucugaagggagcguauacggaaagauaagaacuauaguaaggaaaaugccagucaaauauuuauuugaaaauccagacuuaauauuuaaaccauauauaaaggcuuuagucaaagaaagauuagcagaguucgauaaugacaacaagcaagcucuugcaucauuaaagaaaaaucccguauaccuugacaaagagaaaacaaaacuucuagaauacggaacuugcuucaaagaugaauacguuaaaaaguaugacgucaacccuaacuucacaaaaauagcugaugucauagacggaaaagucaaacaaauacuagaagauagauuaagcaaauucggaggaaaacccaaagaagcauucaaggacguaguaaaagacgggaaaacacugaagugguaugaagacgaaggguuagaaagaccgaucagaaguguacguuguuuaacgggccucagugccguuguaccaguaaagaaagaugaaaacggaauggacauaggauuugucaaaccaggcaauaaccaccacguagcuauuuacguaggagcagacggaaaaggacaagaacauguaugcacauuuuggaaugcagucgaaagaaagaaauauggauuacccaucaucauaaaagaugccaaugaaguaugggauaaaauuacaauggccggugaugauguuuauccacaaucauucuuaucucuauuaccaaaaccagauuggacuuuaaaacuaucaaugcaacaaaacgaaauguucaucuuaggaauggaagaagaugagguaaaauuugcgauugaaucgaaagauuacaaauuauuaucugaucaccuauacagaguccaaaaacuaucaucaagugacuacaauuucauccaccaccuugaaacagacguacaaaagaaaacaaugacguauagaguaaggucacuaucaggcuuauucgcgcuaagaccauuuaaagugagaaucgacugccuaggaaacaucaucccaagcuga

SEQ ID NO: 5212 - RNA, 3669 nt, Artificial Sequence
  Cas9 variant
augaagaaaagaauacuuggucuagauucaggaacaaauucacuagguugggcagucguagaccgagaugagaacaaucaauacagcuuaauaaaauacggagaucuaauauuugaagaaggaguuaaaauugaaaaaggaguagaaaguucuaaagcagcagaacgaacgagccaccgagccuugagaaaacuauauuuucguagaagauuaagaaaaauagaagugcuaaaaguucugguaaaauacaaccuuugcccucaaguaucagaagaagaauuacauuuauggcacacaagaaaacuauauccacaaaauaaagaccuucuucaauggcaaagaacugacgaaaaagcuggaaagaacccauauauauacagauauagaugcuuacaugaagaauuagauaugucaguaagugcuaacagaaugacaguuggcagagccauguaucaucucgcacaacgaagaggauuucuaucaaacagacuagauaacgaagaagacgaaaaccaaaucggagcaguaaaaugugguaucucaaaccuuaccgaagagauacaaucaaguggauguaaauacuugggagaauauuuuuauaaacucuauaaugaacauggaaacacggugcgucuaagaacacgauauacuucuagagaguuccauuauaagaaagaguucuaugcgauaugugaaaaacaaaaauuagauaagaaauuaauagaagaauuagcaagugcccuuuacuuucaaagaccauuaaaaucacaaagacacacgguaggacgaugcacuuuugaaccaaacaaaccaagaugcgccgauucacaccccgcauaugaagaauuuaggauguuaucauucauaaauacaauaaaaguacaaggaccuuacgauaccgaacuaagaguacuaaacacagaagaacgagacucaauaacuaaacuauuuuguagaaaaagcaaaccaaauuucgauuucgaagacauugccaaagaacucgcaggaagaaauaauuauuguuauauaggcgaugucguagacaaggcuuacaaauuuaacuacaggaugucacaaggagucagcggaugcccuacuaccacuuaucuaauaaacguguucggccaagacuggcaaacaggaauagcagaaucuuaccaagcaauugauacuaaauuaggccaaaaaucuguagaugccaugaucgaugauguauggaacgugcucuauaguuucaguucgaaagacaaauuaagagauuucggacguaagaaauuacaguuaggagauaaagaggcagacacguuugcgaauauaaaacuuacacacaaauuugcuagucuuucauugaaagcaauacgaaaaaucaauaucuuccuaagaaugggccuaguauacucacaugcuguaacacuagcaaauaucccgacaauaguuggcacugauauauggcaaagaaaaaggaauuucauacuagcagaauugcuuccauuaauagaaaauuucaauccaaaagaaacaaaacuacaagaaacacuggauuuuuguguaaaagauuuucuacaaaauaacuuugaacucaaaaacggugcuguagacaaacuauaucacccuaguaugaucgaggcauauccggaugcagguuuaaacucaaacggaauacuccaacuaggaucuccaaggacaaaugcaauucgaaaucccauggcaaugcgaaguuuacaugaaauuagaaaaguaaucaaucaacuacuaaaagauaaaauaauaaaccaagacacugaaauacacguggaauaugcaagagaauuaaaugaugcgaacaaaagaaaagcaauaagcauauggcaaaaaucccaggaaaaacuacauaagaaauauguagaagaaauuacaaacuuauacaaagaagagaccgguaaagcuauagugcccacggacacagauauccucaaauuuaaacucugggaggaacagaaucacauuugcuuauauacaggacaacaaaucggcauagcugaauuuuuaggugcgacaccgaaauacgacauugaacauacaaucccacagagcguaggcggagauucgacagauaugaaccugacauuaugcgauaguagauucaacagagaaauuaagaaagcucaauugccgacucaacuaggaaaucacgcagauauccuagucaggauagcaggauggaaaaauuccuaugaaaaacuaucuaaagacauagauagaauaagaacacacucaggaauggcuaaagauauuaaagacaggcucauccaaaaacggcaucuuuuaaaacuugaaagagauuacuggagaggaaaauacgaacgguucacaaugaacgaaauucccgaaggauucagcagaagacaaggugugggcauaggacucauaucaaaguacgcaggucuauaucuaaaaagucucuuucacgauaaaaaugaaaggaauaaaggacacgucuuuguugucaaagguacaacgacagcggaauuucguaaaauguggggauuacaaaacgaauacgagaaaaaguccagaaacaaucacguacaccacugcauagaugcaaucacaauugcaugcaucggaaaacaugaauacgcccagauggcgcaauauuaccacgaugaagcagaauacuuauaccaccauggaauaaagccaaucuuuccgaaaccauggaaaacauuuacagaagacuuacuggaccuagaacauagcuuauuugugguacaccauaguccuaacaauauggcuaaacaagcaagaaaaagaauaauaaccagcacaggacaacauugggcacaaggagacucagcacauggcagucuacacaacgauacuuauuauggugcaaucgaacgcgauggagagauaaaauacgucguaaggagagccguaagcucauuugaacaaaugagugacgucgauaguauaguagaugacgucguaaaagaaacaguaagaaaagcacuagaaggcaaaaacuuuaaagaagccgugaaugcaccaauauauaugaauaaggaaaaaggaguccuaauaaagaaagucagaugcuaugcaaagaguauuaaaaagcccauagacauaagaacucacagagauucaucaucaaaagaguauaagcgaaaauuccauguaucgaacgauauaaacuaccuaauagcaauauacgaaggaacgguuaaaggaaaaguaaaaagagacuuugaagucgucaaaaacauagaagcggcaaacuucuuuaaaagaucacaagauagacgcgauuacccgacaauaguuccagaaaagaguauaaaacacggauucccuuuaaaaacaacacuaacaaauggaaccauggugauuuuguacgaagagaauaaagaagagauagacuuuacaaagaaagaagacauauguagaagacuguauaaauuaguaggaaugucuucaaugauaguuaguggaugugaauauggaguacuaagccuacgccaccaccaagaagcaagaccaucaaaagauauaaaaagcaaaaacggagccuucaaaaauggcgaagccuuacgaccggcgauuacuaugcuucacacacaauucaacgcgcuagucgaaaacauugacuuuaauauagauguaacagggaacauagaauugauauga

SEQ ID NO: 5213 - RNA, 3669 nt, Artificial Sequence
  Cas9 variant
augaagaaacgaauacuaggccuagacucaggaaccaacucauuaggaugggcuguugucgauagagaugaaaacaaucaauauucucuaauuaaauauggggacuuaauauucgaagaaggagucaaaauagaaaaaggaguagaaagcucaaaagcagcagaaagaaccucacauagagcauuacgaaaacuguacuuuagaagaagacuaagaaaaauagaagugcucaaagucuuaguaaaauacaacuuaugcccacaaguauccgaagaagaauuacacuuauggcacacacgaaaacuauauccacaaaacaaagaccugcuacaauggcaaaggacagacgaaaaagagggcaaaaauccauacauuuaccgauaccgcugcuuacacgaagaacuagacaugucugucucggccaacagaaugacggucggaagggcaauguaccauuuggcacaacggagaggauuccucagcaaucgacuugacaaugaagaagaugaaaaccaaauaggagcgguaaaaugugguaucuccaaucuuaccgaagaaauccaaucgucaggauguaaauaccucggagaauacuuuuauaaacuuuauaaugaacacggaaauacagugagacuccgaacccgauauacguccagggaauuucacuauaagaaagaguucuaugcaauaugugaaaaacaaaaauuagauaagaaacucauagaggaacuagcaagugccuuauacuuccaaagaccacucaaaagucaacgacauacaguuggucgcuguacauuugagccaaauaaaccaaggugcgccgacucacauccugcuuacgaagaguuccguaugcucucguucauaaacacuauaaaaguucaaggaccguaugauacagaauuaagaguauugaauacagaagaacgagacucuauaacaaaauuauucugucgaaaaucaaaaccuaacuucgacuuugaagacauagccaaagaauuagcagguagaaauaauuauuguuauauaggagauguaguagacaaagcguauaaauucaacuauagaaugagccaaggaguaucaggaugcccaacuacuacauaucuuaucaacguuuucgggcaagacuggcagacaggcauagccgaaucauaucaagcgauagacacgaaacuaggacaaaaauccguggacgccaugauugaugauguauggaauguguuauauuccuuuagcucuaaagauaaauugagggacuucgguagaaagaaauuacaacuaggagacaaagaagcagauacuuuugccaacauaaaacuuacacacaaauucgccagcuuaucuuuaaaagcaauaagaaaaaucaauauauuccuaagaauggggcuaguauacagccacgcaguaacuuuagcaaacauuccaacaauuguaggaacagauauauggcaacggaaaagaaauuuuauauuagcagaacuauuaccacuaauagaaaacuuuaaucccaaagaaacaaaauuacaagaaacguuagauuucugcgucaaagacuuuuuacagaauaacuucgaacuuaaaaacggagccguagacaaauuauaucauccaagcaugauagaagcauauccagaugcaggcuuaaauucuaaugggauucuacaauuagguagcccacguacuaacgccauucgcaauccaauggcaaugagaagucuacacgaaauaagaaaagucauaaaccagcuauuaaaagauaaaauaaucaaccaagacacugaaauacaugucgaauaugccagagaauuaaaugacgcaaauaaaagaaaagccaucucaauauggcaaaaaucacaagagaaauuacauaagaaauacguagaagaaauaacaaauuuauacaaagaagaaacaggaaaagccauaguacccaccgauaccgauauuuuaaaauucaaauuaugggaagaacaaaaucacauaugucuauauacuggucaacaaauaggaauagcggaauuucuaggagcuacucccaaauacgauauagaacauaccauaccacaaagugucggaggcgauucaacagacaugaacuugacccuuugcgacucgagauucaaucgugaaauaaagaaagcacaacuaccgacacaacuuggaaaccacgcagacauccucguaagaauagcaggauggaaaaauucguacgaaaaauuaaguaaagauauagacaggauaagaacacauagcgguauggcuaaagauaucaaagacagacugauucagaaaaggcacuuacucaaacuugaacgagauuacuggagaggaaaauaugagagguuuacgaugaaugaaauccccgaggguuuuuccagaaggcaaggggugggcauuggacucauuucaaaauaugcugguuuauacuuaaaaagccuauuucacgauaaaaacgaacgaaauaaaggacacgucuucguagucaaaggaacaacaacagcugaauuuagaaaaauguggggacuacaaaacgaauaugaaaagaaaagccgaaauaaccacguucaccacugcaucgaugccauaacaauagcauguaucgguaaacacgaauaugcacaaauggcacaauacuaccaugacgaagccgaauacuuauaucaccacggaaucaaaccaauauucccaaaaccauggaaaacuuucaccgaagaucuauuagacuuagaacacagccucuuugucguacaccacucuccuaauaauauggcgaaacaagcgaggaaaaggaucauaacuucuacuggucagcacugggcucaaggugauucggcccauggcucguuacacaaugauacguauuauggcgcaaucgaacgggauggagaaauaaaauauguaguaaggagagcaguauccaguuucgaacaaaugucagauguagacaguaucgucgacgauguaguaaaagaaacuguaagaaaagcauuagaaggcaaaaauuuuaaagaagcgguaaaugcaccaauauacaugaauaaagaaaaaggaguacuuaucaagaaaguuagaugcuaugccaaaagcauaaagaaaccaauagauauacgcacgcacagagacucauccucaaaagaauauaaacgaaaauuucacgucucaaacgauauaaacuauuuaauugcaauuuacgaaggaacaguuaaaggcaaagucaaaagagauuucgaaguugugaaaaacauagaagcagcuaacuucuuuaaaagaucacaagauagaagagacuaucccaccaucguaccggagaaaagcauuaaacacggauuuccauuaaaaacaacccugacuaacggaacgauggugauccuauaugaagaaaauaaggaagagauagauuuuaccaagaaagaagacauaugccgacgacuuuacaagcuaguaggcaugucauccaugauagucagcggaugcgaauacggagugcuaagccuuagacaccaccaagaggcaagaccaaguaaagauauaaaaagcaaaaauggagcauucaaaaauggagaagcgcuacgaccagcaauuacgaugcuacauacacaauucaacgcuuugguagaaaauauugauuuuaacauagaugugacaggcaacauagaguuaauauga

SEQ ID NO: 5214 - RNA, 3678 nt, Artificial Sequence
  Cas9 variant
augagcaaacgaauacucggaaucgacguuggaacaaacucacuuggcugggcagucguagauagaacagacugugauaacuacacucuagugaaaagaggugauguaauauuucaagaaggcguaaacauugaaaaaggcaacauagaaaaauccagagcuagcgaacgaacuggucaucgaucaacaaggaaacacuauuuccggcguagaaugcuaaaaaucaaaguucuagaaauuuuaguagaacaucagcuuugcccuuauuuaucacacgaggaacugcaucaauggaugacccgcaaaguauacccgacuaaugaggacuucagacuauggcuaagaacuaacgaugccaaugaucaaaauccauaucaugauagacauguaugccuacacgaaagauuggaccuaagauuacaagaaaauagguaccgauuaggacgcgcacuauaucauuuagcacaaagaagaggcuuuuuaucuaauagacuagaacaaaauucaaaaacugaugaaacaggagcagucaaaucagauauuagucaacuuaaugaagaaaugaagaaagcaggaucacaauacuuaggugacuacuuuuauuggcucuaucaggaauacgggaaucaggugacuuuacgaauaagauacacagauaggaaacaacacuaccagaaagaguuugaagcgauuugucagagacaacaguugagcgacgaucuuguugauaaacuuagacgagcuauauacuuucaaagaucccuuaaaucacaaagagccgggguuggaaaauguaccuuugaaccggauaaaccacgaugcgcuuuaagucauccaagauaugaagaauuuagaauguugagcuuuuuaaauaacgugaagguuaaaggaccaucagaugauuccuugagaccacuuucaccaagugaaaaagagaaaauaaaaccccucuucuuacgaaaaaguaaagccaauuucgacuuugaagacauagcuaaggcaauugccggaaaaggaaaauaugcuuguauaagagacaaagaaggugcucaaaagccguaccaauuuaacuacgcguuaucacaaggaguaagugggugcccugucacugccaaacuaaucgccguauuuggugaaucaugggaacgaaauuuaguaaaugcguauagauccaggaacgauaugcgcaaaucugaugaagaaauagucaaugaaguuuggaauguacuauauagcuucucgucgaaagaaaaguuaagagcauggggaauggaaaaacucggauuagaugaagccugcgcaggagaguucgcugauauaacacuaccaacagcauuugcagccuuaucacucaaagcaguuaauaaaauucuaccauuucuacgacaaggauucauauacucgcaugcaguaauguuagcaaauauaccauauauaauaggaauggauagauggaacgaaccgcgacaaagacaguucauaauggauaauuuacaggaacuauuggacaacuucacggcuagcgauaaagcauuacaacaaaccuuggacuuuugcauaaaagacuuuuuauuaaacaauuaugaacuugcaccugggaaagccgauagacuauaccacccuucuaugauugaaacuuauccagaugcaaaagcagacggucaaggcaucuaccaacuaggaagcccugcuacgaacgccauaagaaauccuauggcuaugagaagucugcacauacuacgaagaguuguaaaucaacuauuaaaagaaaagacuauugauagugaaacagaaguacauauugaauacgcuagagaacuaaacgaugcgaauaggagaugggcaauaaaucaauggcaaagaaaacaggaaacacaaagaaaagauuaugcagaaaagauuagaaaagucuacgcagaugaguucgaaaaaguaauagaaccaacacaagaagaacucuuaaaauaccaacucugggaggaacaacaacauuugugucuauauacaggagaacagaucggauuaacagacuucaucgggccaaaucccagauaugauauagaacauaccaucccacaaucuaugggcggagauagcacacgaaugaauuuaacacugugugagagaacauacaauagaaccguaaaaggaaaccgaaugccgucgcaacucgcagaacacgagucgauauuaacacgaaucaaacccuggaaagacaaauacgaagaacuaacagucaaaauaaauaaauuaagaacacauccaggcauggauaaagcaucaaaagauaauauuauaagaaaaagacauuuauuagaauuagagagggauuacugguuucaaaaauaucaaagauucacaaugaccgaaguaccugaagguuucucccuacgucaaggcacaggaauaggacugauuggaaaauaugcuggauuguuuuuaaaaucucuauuccaucauguuaaagaacgaaaucgaaaacaaguauauguuauuaaagguccuauaacagcggaguucagaagauuauggggauuacaaaaucucuaugaacagaaaagcagagacaaucaugcucaccauuguauugacgcuaucguaaucgcaugcauaaacccagcugaauaugccagaauggcaaguuauuaucgacaagaagaagacuucagacuaaacaaaggaaauaaacccguauucccaaaaccauggacuacauucacacaagauuuacaagcucucgaagccgaauugcuaguaguacaugaaacgagaaauaaucuaacuaagaaagcaagaaaacggguccgaacgaaaggcggaaacguacuaucagaaagugacucggcacgcgggucacuacauaacgacacauauuauggagccauacagaaagacgguguaauaagauacguaguacgaaaagcauugucaucauugucagaaaaagacgucaaagauauaguagacaaaacagugagagaaaaaguacaggcggcgauacaagagaaaggagcaaaagaagcacuagcugguaccauauauaugaaugaagaaaaaggaauuaccauaaagaaaguuagauguuucacaaaaaucgcuagcccauuggcgauaagaagacaccgagaugcuucugccaaagaauacaaacgaccauauuauguaacaaacgaaaguaauuaugugauggguauuuaugagggaugcauuaaagagaaaacaaaaagagaguucauucucgugaauaaucuagaagcggugagacaauuaaaagcugcacgaaaacaaggcguugucucaagcauucugcccccaguuucugcaaaaagucaauuucccuugaaauauagacuuuauacaggcacauugguacucuuauaugaaaauucacccgaagaaauagauuuuacuaaucaaguugacauaugcaaaagauuauauaaaguuacaggauuaagcagcaugaccguuacagguaaccaauacggaacaauacaauuacgauaucaccaagaagcacggcaagcaaaagaccuaaaagcacaaaacggagcauacaaagaaggggaagaacaucgacccgcaauuaugauguuacauacccaauucaaagccuuaguagaaggaaccgauuuccgaaugaauauucuuggugaaaucgaaccauuaaggaaauga

SEQ ID NO: 5215 - RNA, 3690 nt, Artificial Sequence
  Cas9 variant
augggagaccgcaaauacaacuuaggauuagauaucggaacaucgucaaucggauucgcagcuguagaugaaaacaaccaacccauacgaguuaaaggaaaaacggcuaucgguguaaggcuauucgaagaaggcaaaaccgcagcagauagacgcggauucagaacaaccagaagacgccugucaagacgaagauggcgaaucaaccuucuuaaugaaaucuuugaugcucaccuggcagaaguggacccuacauuccuagcaagacucaaagaaucuaaccguaguaaucucgauccuaagaaaucuuuucaaggcagccuacuauucccugaaaggaaagauuaccaauuuuacgaagaauacccaaccauauaucaccuacgaaaagcacuaauggaaaaagauagaaaauucgacauuagagaaauauaucuagcaguacaccauauaauaaaauaccgagguaauuuccuaaaugggacucccaugagaucauuuaaaguugaaaacauagagcuaaacacacuauuugaucaacuuaaucaacuuuacgcggaaaucguacccgacaaugaguuagcauucgaucuagcucaaguugcugacguaaaagacguucuaaguucaaccacaaucuacaaaauggacaagaagaaacaacuuguaaaaaugaugcuacuacccgcuucaaacaaagcccuacaaucagaaaacaaaaagauuguaacacaauucgucaacgcaauacuaaauuacaaauucaaauuagacguauuacuccaaguagaaacagaugcagauuggagucuuaaauuaaacgacgaaggugcugacgauaaacuugaagaauuuaccggagaucuagacgaaaaucgauuagagauaauugacuuauuacaaagacuacauaacugguuuucgcuaaaugaaauaaccaaagacggaaacucacuaagugccgcaauggucgaaaaguacgaaaaucaccaucaucacuugggauuacuuaagaaaguaauagaaaaccauccugaugcaaagaaagcaaaagcucuuaaagaaaccuauacagccuacguaggaaaaacagacgauaaaacgcaaaaucaagaugacuucuacaaagcaguagagaaaaacuuagaugacaguccugacgcgaaaggaauaaaaagacucauacaacuagaucaguucaugccuaaacaaagaacuggucaaaauggagccauuccccaccaacuucaccaacaagaauuagaucaaauaaucgaaaaacagucaaaauacuauccauuucucgcagaaccgaauccaaacguuaaaagaagaaaagacgccccauacaaacuagaugaacuuauugccuucaaaauuccuuauuacguuggaccuuuaguuacgcccgaagaacaagcccaaaauaaagaaaauguuuuugccuggaugaaaagaaaagcugccgguccaauuaccccauggaacuuugacgaaaaaguagaccgaauggagagcgcaaaccgauuuauucgaaggaugacaacuaaagauacauacuuauucggcgaagacguccugcccgcugaaaguaugauauaucaaaaauuuguaguguuaaaugaacuaaacaaucuaaaaaucaacgggcgacaucugucauuaaaagauaaacaagauguauauaaugaccuuuuuaaacaacagaaaacaguaagcaucaaagcucuacaaaacuacuauguaaccaaaaagaaagcagcuacagcaccaacaguaggaggauuagcagaucccaagaaauucuuaucaucauuaaguacauacauagacuuuaaaaacauguuuggcgaacggguaaaugauccccaauuccaagaagaccuagaacaaauuguagaauggaguacaauauucgaagacagagguauauucaaagcaaaacuacaagccuuagguugguuaucugaaaaacaaauacaacagcuaguagccaaaagauacaaaggaugggguagacucucuaagaaacuauuaacaggacugaaaaacgcugaggguuauagcaucuuggacgaaauguggcgauccacagaaaauuucaugcaaauacaaagcagaccagaguucgcagcccugauacaacaagcaaacgaaaaacaauuugaaggaaaugauccagauaacguaugggaaaauaucgaaaauauauuaggcgacgcauacacaucaccacaaaacaagaaagcgauacgccaagugguuaaaguaguacaagauaucgaaaaagcaguaggaaacccuccugagaaaauagcgauagaguucacaagagaagcugcagcaaacccccaaagaacgcaaucacgucuccggaccuuagaaaaacucuaugaaagcgccgaagaagucguagacgccggccuaaccgcagaacuagcagaguucaaagaaaacaaacacguauuauccgacaaauacuacuuauacuucacgcaacuaggaagagauguauacacaggagauacaauaucauuagauaaacuaaacgacuacgacguugaucauauacucccucagagcuuuauaaaagacgauucucuagacaacagaguacuaacgauacgagcaguaaauaacgguaaaagugauaacguacccgcuaaaauguuuggcaagaaaaugggguccuuuuggagacaccucuuggacaauggaaugauaaguaaaaggaaauacaauaaucucaucacagaucccgauaacauaucaaaauaugcccaaaaagguuucauaaauagacaauuaguagaaacgagucaaguuaucaaacucacagcuaacauauuaaacggaaucuacgauaaagacaccgaaaucauagaagucccugcgaaaaugaauagucaaaugagaaaaauguuugacuuagucaaaguaagagaaguaaacgacuaccaccaugcauucgacgcauaccuaacaauauuuauaggcaauuauuuauacaaaugcuauccaaaacuucgccccuacuuuguauacgacaacuuuaagaaauucggcaauaaagaagauaucggacauaaaagguuuaacuuucuagguaaaauagaaagggaaaagaaagucguagcuccagaaacuggcgaaauauuguggucaaauguagcaccaaaugaaaccaucaaacaaauuaagaaagucuauaacuauaaauucaugaucguuucaagagaaaucacaacacgaagggcagaacuauuuaaccaaacagucuauccgaaaaacuaccguggaaaacucauaccaaucaaagaagaccguccgacagaccuauauggaggauacaguggaaacaccgaugcuuaucuagccauuguagcauuagaagauaaaaagaaagggaaauauuucaaaguaguugguaucccaacacgagcagcugcaaaacuggaaaaacuaaaacaacaagacucucaacaauaccuccaggcccuccaugaaguuauagcaccacaauuuacuaaaucaacgaagaaaggaaucaagaaaacagaauuugaaaucguacuagauaaagugcacuauagacagcuuguccaagaugguccaguuaaaaugaugcuaggcagcucgacauacaaauacaaugcaaaacagcuaguauuaucagaaaaagcacuguga

SEQ ID NO: 5216 - RNA, 3696 nt, Artificial Sequence
  Cas9 variant
augauaacgcguauuuuaggucucgacacaggaacaaacucacuagccugggcuguaguagaucgcgaugcuaacggaaauuacacccucguaaaaagaggugacguaaucuuuacagaagggguaaaaauagagaaagguaucgaaaguaguaaagcagcugagagaacagcacauaaagcacuaagaguccauuauucacgcagaagauuacacaaaaucgacacuuuaaaaguacucguagaacucgaccuauguccauacuuaaguaacgaacaacugaaccucuggaaagcaaagaaaacauauccauuaacagaugauuucauguuauggcaaagaucaggaagugcggaagaaaauaauccauauuacugcagacacagaugcuuaacccaaaaauuagauuuaacagaucaaucacaaagauuucuucuagggcgagccuucuaucacuuagcacaaagacgaggauuccuaucgaauagacucgauacgucagcagacucagaugagucaggcaaagucaaaaguggaauagcugaauuaucaguagagauggaaaaagcagggugcgaauuuuuaggagaauacuuuuaccaacucuacaaacaacauggaaacacaauaaaacuaagaucaagguauacagauagagaggaacauuacaagaaagaguuccuggcaauaugugaaaaacaggaauuagaucccaaauggguugaagccuuacaacgugcaaucuauuuccagagaccacuaaaaagucaacgaaaagggguuggcaaauguacuuucgaaccaaagaaaccuaggugcgcagaaucccauccagauuaugaagcauuuagaauguuguguuucuuaaauaaugucaaaauucaaacaccaaacgauacuucccuuagaccauugaacgaagaugaaagagagaaaauauggccccucuuuuucagaaaaagcaaaccaaacuucgacuuugaagauauagcaaaagcauuggcugguaaaaacaauuacgcaugguacaaagaugcaggcgaaaagccauuuaaauuuaacuacagaaugcaacaaggaguaucuggaugcccaguaaccgcgcaacuaauugacauauuuggaagugauuggcaaaccgcgauagccgaaacguacacagcaguagaaaagaaaaacggcacaaaaacaauugaugaaauggccgaugauguauggaacguccuguacaguuuuaguaguaaagauaaauuaaaagcauucgcaacugaaaaauuacaacuugacgaagcaucagcuacaaaauucgccaacgcaaaauuaccacauggauuugccucccuaagccuaaaggcuaucagaaauauauuaccauuucuaagacaaggcuucauuuacgcucacgcaguacauuuagcgaagauaccagacaucgucacaaaggcgguuuggaacgacgcagacaaacgagaaaugauacuaucuggguuaauggaaauuauagaaaacuauaauccaaaagaccgaggggucgaaggaaccauugacuucuguaucaaaucccaucuacaggacguuauugauuuaagaccaggcgcagcagacgcccuauaucaucccucaaugaucgaaacauacccagaugcuaaauugaacaaaaugggagucuuccaacuaggaucaccaagaacaaaugcgauacguaacccaauggcaaugagaucauuacacauacuacggucagucgucaaucaguuacuaagggaugguauaauagauagaaacacagaaguucauguagaauacgcaagagaauuaaaugacgcaaacaaaagaaaagcaauagcagauuaccaaagagaacaggaaaagaaaagaaaacaauacagagacgauauaaucgcucuauauaaaagcgaaugucauaaagaaauagaaccaacagacaccgacauauuaaaauuucaauuaugggaagaacaagaucaccuaugccuauacacggguacucagauaggaauaugcgacuuuuuaggcgauaauccaaaauucgauaucgagcacacuguaccaagaucaguagguggagacuccacacaaaugaaucuuacacuaugugacgccacauucaauagacaagucaaaggugcucaacuaccuucgcaacugaguaaucacgcagacauccuagucagaauugaucacuggaaaaguaaaugugaagaccuuagaaaacaauuagauaaaauuagaacauauggaggcauggaaaaagcaaugaaagauagacuuauacagaaaaggcaucgacuaaaaauggacuuagauuacuggcaaggaaaauacucaagauuuacuaugacagaaguaccagaaggauucaguagacgucaaggggcagguauaggccuaguguccaaauacgcaggacuauuccuuaaaagucuguuccacaaugaacaaaacccgaauaagaguaacguauaugucguaaaaggaguaacaacagccgaguuccgaagaauguggggacuacagggagaauaugaaaagaaaucacgccuaaaccacugccaccacuguauagacgccaucacuauagcauguauaggaaaagcugaauacgauaaaauggcacaauacuaucaugacgaagaacuuuuccaauggagggguaccaccacuaaaccgcacuucaacaaaccauggccaacauucaccgaagacguacuugcuaucgaacaaucccuauuaguuaagcaccuaacgaaagauaauaugccaaaacaagcuaagaaaagaguacguacagcaacgggaaaauaccucgcucaaggagacacagcacggggaucuuugcauaaagauacauacuauggagccauagaacaagacggagaaauuagguauguacugaggaaaccguuaaauaaauuugaaaaugaagcagaauuagagaaaauagucgaucaagcgguaaaagagaaaaucaaagaagcaauugcagguaaaaauuuuaaaaccgccauaacugaaccuauauucaugaacaaagaaaaaggaauacgcauaaauaaaguacgguacuacgucaaagcacaagaaagauuaaagauuaggcaacaacgagaccuuagcucuaaagaauauaaacaauuuuucugcguagaaaaugaaucaaacuauuugcucgcgaucuaugaaggagaacuuaagggaaagaaagaaagagacuuuugugucgucaauaauuuagaaucggcagcuugccuaaaacgaucaaauaaagggaaagcagcaccucuagucccagaaagaucagaagaaagaaaucuuccauuauuagcaguauugaaaagaggaacacaaguucuauuuuaugaaaacagcccagaagaaauacuauucgacaacccacaagacuuggugcgaagauuauacaaaguuacaggcauaaauacaaagaaagacgucaaaaaugguaaaacauaccuauacgguaacauugaacuacgcuuccaccaaaaugcacaaaagaaagacgauguaaaaaugcaaucaggaguauauaaaaacaaugaaguucuucgccaaggaaucguucuaagucacaaacaguucaaagcccuaguagaagggguagacuucgaauuuaaugugcuaggagaaauuaaaaagaaagaaagacacgcuuga

SEQ ID NO: 5217 - RNA, 3699 nt, Artificial Sequence
  Cas9 variant
augacuaaaacacgaauacuaggacuagauacuggaacaaacagucuaggaugggcaauaguugaccgagacgaaguaagcggacaauaugaauuaguugaccguggagaucuaaucuuuacugaaggagugaaaauagagaaaggcauagaaucaaguaaagcaucugaacgaacgcaacacagagcuuuaagaaaacaauauuuuagaagacgacucagaaaaauugaaguacuaagaguucuuaccuuuuaucaccuaugcccacccguuagugaagaagaauuacaucucuggcacgucaagaaaauauauccggucgaaaaccacgaguucaugaucuggcaaagaaccaaugacaaugaaggcaaaaacccauacuacuaucgacauauaugucuacacacaaaacuaaaucuaacacuaaugaaagacagauauauucuagggcgcgcacuauaucaccuaucgcaacgcagaggcuuucugaguaaucgauuagaucaaucacaagacgaagaugacaaaggaacagucaaaaccggaauaagcucauuaucaaaagacaugaacgaugcuggaugcacguauuuaggagacuauuuuuacaaacuauauucagaaaacggaaauagaguaagaauacgaaaccacuacaccgccagaaacgaacacuacuuagcugaauuugaggcaaucugccaaguucaaaaauuagaaccagaauuaguagaagcucuccggagagcaauuuucuuucaaagaccacuaaaaagucaacgcaaaggaguaggaaaauguacauuugaaccacgaaaaccgagaugcgcagacagccacccagauuacgaagaauuuagaaaauuauguuucauuaauaacaucaaaauacaaacgagcgaugacgacacaaugagaccauuaaacaaagaagaacgacaaagaaucaauucuuuauucuacagaguuagcaaagcaaauuuuuacuucgaagaaauugcuaaguugcuaggaggucgaaacaacuauugcuauuuuaaagacgaaguacaaaaagacuuuaaauucaauuaccguaugucgcaaagcgugaguggauguccuacuacagcacaacuaagaaacauauucggagaagacuggaaaaccgggaucgcggaaacauaucagcauuccgcaaagaaagauggaucauuaaaaacaguggacgaaauggcagaugauauauggaacguguuauauagcuucucgaguaaagacugcuuauacaauuuugcaguaaacaaacuacaacuagaagaggauaaagcuaagaaauuuucaaaaauuaaacucucucauggauucgcuagcauaucccucaacgccauucauaaaauacuaccuuuccuucgaaugggaaugauauauagccacgccguacuauucgcaaacauaccgacaaucguaggaauggaugucuggaacgacgaaucaaaacgacaacacauuaugacggaauuaagcgauuuaguauucaauuaugaucccaaaaaccgagaagucgaaggaacaauagaaauguguauaaaagauuuccuauuaaauaauuaugacuuaccagccggugcaguguguaggcucuaucauccuucuaugaucgacacauacccagacgcaaaagcaaauaaauacggaguacuacaauuagguucaccagccacaaacgcaauaaggaacccuauggcuaugcgaucucuacaugagcucagacauguugucaauuuacuacucagaaaagggaaaauugaucaaaauacugaaguacauguggaguaugcgcgagaacuaaaugaugcaaacaaacgaaaagccauugcagauagacaaagggagcuagauaaauuacauaagaaauaccaugacgacauaauaacauuauacaaagaagaaacaggaaaagauauaaacccaacacaagcagauauuuuaaaauuccagcuaugggaagaacaagaacauguaugucuauauacaggaaggcaaauaggaauaaguaaauuccucggacccgacccagaguucgauaucgaacauacagugccaagaucaguaggcggugacucaacccaaaugaacaugacccucugcgacagacguuuuaauagggauguaaagaaagcuaugcuaccaucucaacugccaaauuaucaagaaauacuaccacgaauugaaaaauggaagaagaaauacgaaaaacuaacaaaagauauagaccauugcauuacccacucaggaaugacaaaagaagccaaagacucaauuauccagaaaagacaccggcuaacacuagaacacgacuauuggcggaauaaauacucgagauuuacaaugacagaagucccugaaggcuucucucgacgccaaggagcaggaauaggauuagucucaaaauacgcaggccuauuccuaaaaagucuguuccaugaucccacagaucgacgacgaucacauguauaugugguaaaaggaacaacaacugcagaauuuaggaaaauguggggauuacaaagcgaauaugaaaagaaaagucgagauaaccauguacaucacugcguagaugcaaucacuaucgcguguauagggaaaaacgaguacaacaagauggcuucauuuuaucaugacgaagaagcguuugaaagaggagagugugaaaaaccacauuucgauaaaccauggccaacauucacacaagaugucuuaggacuagagaaaagacuuaucguaguacacagcacgcaagacaacaugcccaaacaugcgaagaaauauguaagaacuccuagaggaaaauucauugcaaaaggggauugugcuagaggcucauuacaucucgacacauacuauggagcaaucaaacauaaagaugauacagaacccagauacguauuaagaagagaacuuucuaguuuugacagcguaaaugaucuagauauaauaguugacgacgcaguccgagagaaaauuaaagaagcaguaaaagguaaaaguggcaaagccuuuaaagaggcuuuagcuaauguuuauaugaacaaagaaaaagauaucagaauaaagaaaguuagauguuacguucccucgguaaaaagaccgauugacaucagacaucaaagagauaugucccgcuuugacuacaaaagacaauuccacguagcuaacgacgguaacuauaugauggcuauauaugaaggggucguaaaaggaaaauuaaaacgagacuuugaacucgugaaaaauauagaagcagcaaguuacuucaaaguaagucaagacaacgaaaguuuuuccucuauuguacccgaaaaaucaucaaauggcuuccccuuaaaagcaguucugaaaauaggaacacacguauuauuauaugaaaauacagcauccgaaauagacuucucagauccaguugacuuaacaaggagacucuauaaagucguaggauuaagcucagcaauaauaaauaauugcucauauggauuuauuacuuuaagauuccaucaagaagcccgacaagccaaaaauuuaaaacugaccaaaggaguauucaaaaacgucgauaauuacagaggagcuauuauccuauaucacacacaacugaaagcacuuguagaaggauacgacuuugauauaaacauuuugggugaaauaacaucgaaacaguga

SEQ ID NO: 5218 - RNA, 3705 nt, Artificial Sequence
  Cas9 variant
augcccaacuucuggucgauauucaccgaaaauuuacaaacauaucuaaugaaaacgcggauucuaggccuggacaccgguacuaauucucuuggaugggcagucguagaccgugacgaaaacaaccaauacacaccaauaugucgaggugauuuaauauucacggaaggcguaaaacaagaaaaagguaucgaguucagccuagcagcagaaaggacaucguauagagcuucaagacgucacuacuucagacgaaggcuaagaaaaguagaaguauuaaaaguuuuagucaaacauaaacuauguccaccccuuucagaugaggcuuuaaacagauggcauaccaagaaagaauacccccuagaugaagauuuuauucuauggcaaagaaccaaugaagcagauaacaaaaaccccuaccacgaccgccauauaugccuacauagaaaacugaacuuaaaagauucccaaaccgaucgguacacauuaggccgugcacuauaccacuuaacacagcggagaggcuucuuaucaaacagacuagaucaaaaugaagaagccgaagaaacagguaaaguaaaauccgcaauaucggaacuaagcaaagaaaugaaagaagccggaugcgaauuucuaggagauuauuuuuauuuauuauauaggacagaaggaaacagaguacgcaucagaucuagauauaccgacagagaaaaacauuaccuacaagaauuuaaagaaauaugcaggguccaagaauuagaugaagaccuagcaaaggcccuagagaaaacgauauucuuccaacgcccacuuaaaucacaacgacaaggaguaggaaaaugcacuauggaaaaaggacauucgaggugugcagugucacacccacuguacgaagaauauaggcuucucugcuacuuaaauaauauacgaauuaaaacacccucagaugacagauuaagaccccuaaaugcagaagaaagagagaaaauaacaccgcuauucuauaaagagaaaaauuuugauuuugagaaaauagcuaagaaacucgcaggaaaaacaccuuucgguuggaucagagacgccgaagauuggccauaucaauuuaacuaccgaaugacccaagaagcaccagcgugcccaacaacagcucaacuaauaaaaguauucggggaagacuggaaagcugcucuagcugaaacguacacaauguccgcuaaacaggaugguacccuuaaaacagaagacgaaaucugcacugacaucuggaacguauuauacagcuuuucaucaaaagaaaaacuuaaagaguucggguuaaagaaauuacaacuagaugaaguucaggcaaaggcuuuuucugaaauaagacugacucgagacuucgcaagccugucauuaaaagccauaaggaaaauacuguucuuucuccgaaccggcgaagacuauuccaaagcgauauuuuuagcaaauauucccacaauagucggagaagaaauauggaaugacauagaaagaaggucaagacuccucuacaaaguagaucucgcacuucgaccucaggaagaacgagaugcugaggagcacaggaccauagcagaacggauuaaagccgcuguagcagcagaaguccccgacgcccccauagacuuguuauaccaucccuccaugauagaggcauauccagaugccaagcgaaacgaaagguuugauuguuaccaauuaggaaguccaaaaacaaaugcagugagaaauccaauggcuaugcgaaguuuacauauggucagaaaaguaauaaaucauuuacuaagaaaacauauaauagaugagaaaacagaaauccacaucgaauaugcgagagaauuaaaugacgccaacaaaagacaagcaaucgcagauuggcaacgagaauuaagcaaaagacacacagcauaugcucaaaauauaagacaacuauauaaagcugaaacugggcuaguaauugagccaacaaaggcugauauauuaaaauaucaacuuugggaagaacagcagcacgucugucuguauacaggaaagaaaaucggaauagccgacuuuuugggagccaauccaaaauuugacauagaacacacaauaccgcguucuagaggaggcgacucuacucaagaaaacuuaacauuaugugaaucaaaauuuaaucgagacauaaaacgggauaaauuaccaacagagcuugccaacuaugaagagauacucgccagaauagaacacuggaagaaacaaugcuaugcacucaaauuaaaaagagauggcauacgaacacacaguggacuugagaaaagcauaaaagacaguagaauacgacguagacaccuuguaggauuagaauauggauaccuaaaagguaaauacgauagauuuaccaugaaagaaguaccagaaggauuuucacgacgacaaggagccgggauuggccuaaucucuaaauacgcaggucucuuccuaaaaagccuauucaaggauccuaaaaacccaaaccgaagcaaugucuacguaguaaaaggugccauaacagcagaguucagaaaacuauggggucuccaacaagcagacgaagcaaaaagccgagaaaaucacacacaccacuguaucgaugcuuacacaauagcauguauagggcccugugaauaugccgcucucgcagccuauuauaggagugacgaagaguucaaauacggaagaagacgugaaaaaccacaauuugaaaaaccuuggccaacuuucaccgaagaccuccuaaaauuacaagaagaauuacuaauaguacaucaaacaaccgauaaauuagggaagagagaucgaagaaaaguaaaaacgccccgaggaaaauuccuaacaggaggugacagcgcaaggggucgccuacaucaagaaacauacuauggugcgauaaacuacgacggaaacauuaaauacguaguaagaaaaccgcuagauuccuuaacagaaaaagaccuagauaaaauaguagacgaaacaguaaugggaauuguuaaaggugcaguagaagcuaaaggaucacuuaaagaagcacucgcugacggcauauauaugaauaaagaaaaaggaauauuaauaaagagaguaagaauuuucucagacgucucggaaccaauaaaccuaaagcaauugcgagauguuagcacaaaagaauauaaacgacauauacaucugagaaaagaugaaaacuaccuguuugcaaucuaugaaggaauagacaagaagaaaaauaagaaacaaacagaaaccgccacaguggauuaccuagacgcagcaaaauuuuauaaagauagcaaacguagagacaaagcgaauaguuuaguaggagauuacucaaagaaaaauaaauuaccguugaaauguauuuuaaagaaacgacaaauggugcucuuuuacgaacacucucccgaagaaauuagauucaaagauaagaaagauuugucgcgaagacuauacauaguaacuagcauagccaaagacgguagagucaaauuucuccaucaccaagcagcgacagcgaccgguauccaaucaucgccaucaccguuuacaaacgacggcgaacaucaaccuuauuaucgacuuagugcauccaauauaaaaguacuuguggcuggaauugacuucgacauaaacauucuaggagaaauaacacccaaauuauga

SEQ ID NO: 5219 - RNA, 3711 nt, Artificial Sequence
  Cas9 variant
auguauuucuacaaaaacaaagaaaauaaauuaaacaagaaagucguacugggucuagaucuagguauagcaucagucggauggugcuuaacugacauaucacaaaaagaagauaacaaauuucccauaauauuacauggagugagacuguuugaaacaguagacgacuccgacgacaaacuuuuaaacgaaacacgaagaaagaaaagaggccaaagacgccggaacagacgauuauuuacccguaaaagggacuuuauuaaauaccuaauagauaacaacauaauagaacuagaauuugauaaaaauccaaaaauccuagugagaaacuuuauagaaaaauacauaaacccauucagcaaaaaccuagaacuaaaauacaaaucaguaaccaaucuaccuauagguuuccacaacuuacguaaagcagcgaucaacgaaaaauacaaacuagacaaaagugaacucauaguacuacuauacuucuaccuaucccuaagaggcgccuucuuugauaacccagaagacaccaaaucaaaagaaaugaacaaaaacgaaauagaaauuuucgacaaaaacgaaucaaucaaaaacgcagaguucccaaucgacaaaaucaucgaauuuuacaaaauaucaggaaaaauuagaucaacaaucaacuuaaaauucggucaccaagacuacuuaaaagaaaucaaacaagucuucgaaaaacaaaacauagauuucaugaacuacgaaaaauucgcuauggaagaaaaaucauucuucagccggauaagaaacuauucagaaggcccgggcaacgaaaaauccuucuccaaauacggacucuaugcuaacgaaaacggaaauccagaauuaaucaucaacgaaaaaggacagaaaauauacacgaaaauuuucaaaacccuuugggaaucaaaaaucggaaaaugcucauaugauaagaaacucuaccgagcaccuaaaaacuccuuuucagccaaaguauucgacaucacaaacaaauuaacagacuggaaacacaaaaaugaauauaucagcgaacgccugaaaagaaaaauucuucuaucacgauuucuaaacaaagauucaaaaagugccgucgagaaaauacuaaaagaagagaacauaaaauucgaaaaucuaagcgaaauagcauacaacaaagacgauaacaaaauaaaccugccaaucauaaaugcuuaucauagcuuaaccacaaucuucaagaaacaccucauaaacuucgaaaauuauuuaauaucaaacgaaaacgaccuaucaaaacucaugaguuucuacaaacaacaaucugaaaaauuauucgucccuaaugaaaaaggcuccuacgagauuaaucaaaauaauaauguuuugcauauauucgacgcaauuaguaacauccuaaacaaauuuucaacaauacaagaccgcauuagaauacuagaaggauacuucgaauuuucgaaccucaagaaagacguaaaaagcagcgaaauuuacucagaaaucgccaaacuccgcgaauuuagcggcaccagcucccuuaguuucggagcauauuauaaauucauuccgaaccucauaucagaaggcagcaaaaauuacucgacaauaucauaugaagaaaaagcauuacaaaaucagaaaaauaacuuuucccauucaaaucucuucgaaaagacuugggucgaagaccuaaucgccucacccacagucaaaagaucguuacggcaaacaaugaaucuauugaaagaaauauuuaaauacucagagaaaaacaaccucgaaauagagaaaauaguuguagaagucacccgaucaucaaauaauaaacaugaaaggaagaaaauagaagguaucaacaaauauagaaaagaaaaauaugaagaacucaagaaaguauaugaccuacccaaugaaaacacaacccuucuaaagaaauuauggcuacucagacaacaacaaggcuacgaugcauacucauuaagaaaaaucgaagcaaaugacguaauaaauaaaccauggaacuaugacauugaucacauaguuccaagauccaucagcuucgacgacuccuucuccaaucuaguaauaguaaacaaacuugacaaugccaagaaaucaaacgaccucucagcaaaacaauucaucgaaaagauauauggaauagaaaaacuaaaagaagcuaaagaaaacuggggaaacugguaucuacgcaacgcaaacggaaaagcauucaaugacaaagguaaauuuaucaaauuauauaccaucgauaacuuagacgaauuugauaacagcgacuuuauuaaucguaacuuauccgacaccucauacauaacaaacgcccucguaaaucaccucaccuucucaaauucaaaauacaaauacuccgucguuucgguuaacggaaaacaaacauccaacuuaagaaaccaaaucgccuuuguaggcaucaaaaacaacaaagaaaccgaaagagaauggaaaagaccggaaggauuuaaaucuauuaauuccaaugacuucuuaauaagagaagaaggcaaaaacgauguuaaagaugaugugcuuaucaaagaccgaaguuucaauggacaccaugcagaagaugcuuacuuuaucaccaucauaucacaauauuuucgaaguuucaaaagaauagaaagauuaaauguaaauuacagaaaagaaacuagagaauuagacgaucuagagaaaaacaacauuaaauuuaaggaaaaggcuuccuuugacaacuuccuacugaucaacgcgcuugacgaacucaaugagaaacucaaucaaaugagauucucuagaauggucauaacaaagaaaaauacccaacuauucaaugaaacauuguauucagguaaauaugacaaagggaaaaacaccaucaagaaagucgaaaaacucaaccuacucgauaauagaacagauaaaaucaagaaaauagaagaauuuuucgaugaagacaaacuaaaagaaaacgaacuaacaaaacuacacauuuucaaucacgacaaaaaucuauacgaaacuuuaaaaauaauauggaaugaagugaaaauagaaaucaaaaauaaaaauuuaaaugaaaagaauuauuucaaauacuuugucaauaagaaacuucaagaaggaaagaucucguuuaacgaauggguaccaauucuugauaaugacuuuaaaauaauaagaaaaauuagauacauaaaauucagcucugaagaaaaagaaacggaugaaauaauauucucccaaaguaacuucuuaaaaauagaccaacgucagaauuucucauuccacaauacccucuacuggguacaaauauggguuuacaaaaaccaaaaagaucaauacugcuucaucucuaucgacgcaagaaacucaaaguucgagaaggaugaaauaaaaauuaauuacgaaaaauuaaagacacaaaaagaaaaauuacaaaucaucaacgaagaaccgauacugaagauaaauaaaggcgaccuuuucgaaaacgaagaaaaagaacuauucuacauaguaggacgggacgaaaaaccccaaaaauuagaaauuaaauacauacugggcaagaaaauaaaggaccaaaaacaaauacaaaaacccgucaagaaauauuucccaaauuggaagaaaguuaacuuaacauauaugggagaaauuuuuaagaaauga

SEQ ID NO: 5220 - RNA, 3717 nt, Artificial Sequence
  Cas9 variant
augacgaaaguauuaggacuugaccuaggcgcugcuucugucggaugggccaugauagaagaagaggaaaaaucacacaaaauacuaggucucgguucaagaauaauuccguaugaaggaacagaaggaaacgacuucgccaaagggacuggcgagagccgaaaugcacuuagaacaaaagcacgcaccgcuagaaaaggauacgauagauaccaauuaaggagaaaauauuuaguggauacguuagucaaaaacgaaaugaugccagaugaauacuuaagaaaauuacccaaaaugcaguuaugggaacuaagaucuaaagcuguuacaaccgaaauaacaaaacaagagcucggaagacuauuucuauggcuaaaucagaaaagagguuacaagucaagccgaucugacgcaaaccucgacaagaaagacacagaauacgucgucgaagucaaaucaaggcaugaaaaaauaaaagaaucuggcuuuacaaucggucaauauuuuuauucagaauugaaaaguaaugaauacuucagaguaaaagaaaauaucuuuccucgagaagcauacauagaagaauucgacgccauaugcaaacaacaaaaacgacaccuuaccgacaaauuaauaaguagaauacgaaaugaaaucaucuauuaccaaagaccccuuaagagucaaaaaggauugguauccguaugucgauuugaagguuucuuuaaaaaaggaauaaauggaaaagaauacuucguuggaccaaaggucgcaccaaaaucaagcccacuauuucagaccguaaaaauaugggaaaauauuaacucuauccgucucucugaccgaaaugggaaggagauuaugcuaucacuagaacaaaagaaauguaucuucaaccaucuagauaacaaugaaaaacuaacaccaaaagacuuauuuauaaucauaggaguuaaaaaagagaauugcuucguaaacaaacaacuagaaaaaggaauucaaggcaauguuacuaaaagcacgauacuaaaguguuuuggagaaaauaacgacuaugauaaaugguuaaaauuagaccucaacauuaucguaaaaaaagacacuuuuggcuaucuuuaugacaaaaaaacuggggaaauuauaggcgaaaaacuaauaaaacacguagacucggcaguagaaagagaaccauuauaucaacuauggcacacaaucuacucaauaaacaauaccgacgaauguuccgcugcgcuacaaaacaaauucggcuucgacucagaaacggccgacaaauuaucaaacaucgauuucggcaaagcaggauucggaaauaaaucagcuaagguaauaagaaaaauacuuccauaccuuauggaaggugacgacuacucacaaucaaugagcuaugcagguuucaaccacucagauucacuaacuaaagaugaaaacuuaaaacgaaaauuauuagauaaacuaagaccaaucgaaaaaaauucccuacgucaaccuauaguggaaaaaauuuuaaaucaaauggugaaugugguaaacgcaauuauagauaaauacggaaaaccagacgaaauacgaaucgaacuagcaagagaacuaaaacaaaacaaagaagaaaggaacaaaacagacaaagauaugucaaaaagacaacgagaaaauggagaaauaucaaagagguuagcagaauauggccuucgcgccacacguaacaacaucaucaaauggagauuauaugaagaaauagacaaucaagauaaaaaauuaaacgcuauuugugucuauuguggacaaccuauaaguuuaacagaagcaauuaaaggcaacgaaguugacguggaacauauaauaccuaaaucaaaacuauuugacgauagccaaagcaacaaaacacuugcacaccggcgauguaauaguacaaaaggagacaugacagcauacgauuuuauggaaaauaaacccgcacaaguauuuaacgcuuacauugaaaggguaaacaugcuauacgacaauaaaauaauuagaaaagucaagcgagacaagcuacuuaugccagaguccaaaauuccugauaacuucauagauagacaacuuagagaaagccaauauaucgccucaaaagccagagaaauauuacaaacaaucuguuauaauguauggagcacaucaggaacagugaccgcccgucugagacacuuauggggcugggacgacgcaacaaugucacuccaauuaccaaaauaucgggaauuagguuuaacagaaaugguagaaugggaaagugaacauggcaaacagaaacauagcaaagaagucaucuccgacuggucuaaaagagaugaucacaggcaccaugcaguagacgcacuaacgauagcauguaccaaacaaggcuuuauacaacgauucaacacgcuuaacaguucuaaaacgaaagaagacauggaguuugagaucgcaaaguguucaauagaauauagagaaaaccuaucaaaauuagaaaaauacauuaucgcauuaagaccuauuccgguuucggaaguugaagacgcaguugcuaacauacuaauaaguuuuaaauccggcaaaaaaguugccguuaaaggaaaaagaaaaauaggaaaacgagguaauaagaaaauaauacaaaccgacaucauaauuccacacgguucacuaucggaggagaguguguauggaaaaauaaaaacaauagaacgugaaaaaccgcuaaaauaccuauuccaaaauagucaacuaauauucaacaauaaaauuaaaauuuuaguagaagaaagacuagcaacauuugaaaacgacacaaaaaaagcgcuagcauccuuaaaaaaaguaccaguuuaucuagacgaagaaaaaacaauuguacucgaauacgcgaccuguuuuaaagaggaauacguaaaaaaauaugacguagauacaaacuuuaguaaaacagauaagguuauagacgacaaaaucaaagaaauucuacaacaccgacuaggaaaauuuggugguaaagcaaaagaaaaagaggcauuuaaagacguucaacaaggugauaaaacaauaaaaugguacgaggacgaaggacuagaaagaccaauacauucuguacggugcuucacaggccucucugccauuguaccaguaaaaaaagacgaaaacggcaucgauaucggguucguaaagccagguaacaaucaucacauugcaauauauucagacaaagacgggaaccgcuaugaacauauauguacauucuggcacgcagucgaaagaaaaaaauacgacauuccaguaguuauuaaagacucaaacgaaauauggaacaaaaucuggucaaaaccagaaggaucuuacccgcaaaguuuucuagacaaauuaccacaggaaaaccucacucuggaccuuucaaugcaacaaaacgaaauguuaauauuagggaugagcuaugaagacauuaaaacggcuaucgacaacucagacuauaaacaauuaagcucaaaucuauacagauuacaaaaacuugcaaacgcaaacuauauguuccgacaucaccuugagacacaaaucauugaugauaauaauucaaaagcaagcaggagauuuauaaacauucacucauuaaaagcauuauucgcuuggaaccccuacaaaguuaacauaaacugucuaggagacauacaaacaaacucuagauga

SEQ ID NO: 5221 - RNA, 3720 nt, Artificial Sequence
  Cas9 variant
augacagaaaaacgaaaauuugauauuagggaagucuaccucgcaauacaucauaucguaaaguauagaggaaacuuccuaaauagcgcaacaguugauagcuucaaaacauccaauauagacuuuacaucacaauucgacagauuaaacgaacuauacagacaagucauuuuagaagaaccuuuucaaauaaacaugaaucaagucgacaaaaugacuaacaaauuacuagauaaugacgcguuaaaacucgauacacaaaaacaaguagccaaacuccuaccuguaauauacaaugacaaacccgucgacaaacaauacacaagguuagcuacagaguuuuccaaagccauacuuggauacaaaacaaaacuagauguuauuuuaaacuuagacacccaaaaugcaaaagauugggcaauccgauuagaugaugaagacaucgaugacaaguuaccagcccuaguagaaaauuuagacgaaucuagacaagagauagucacaauaauuagagaccuauacgcacaaauaacccugaaugcuauuguuccaaaaggcaaaagcuuaucagagucaaugguagacaaguauaacgaccacaaagaucaccuagauuuauuaauggggcucauucacgaacuaggagaugauuccgcaaaaggaaucaaacuaagagaagcauauacacaauacguaggaaaaagcggagauaaaacauuaaaccaagaugauuucuacgccgccauuaaaaaaaaccuugaugaagacaguaaaagaucaccaaaaauacaacgauuaauugaacaagcaaguuuuaugccuaaacaacgaaccucagcuaauggcguuauaccacaccaacugcaucaauuagaacucgacagaauaauugaaaaccaaggccgauacuauccauuucuaaaagaaccuaacaguaauacacauaaaccaaacggagguaaauauaagcucgacgaacuagucgcauucaggauuccauauuacgucggcccacuaauaacaaagcaagaucaagaaaaaacaucuggagcugauuucgccuggaugauaagaaaaccgggacaaggaggagagauuacaccuuggaauuucgaucaagaaguagacagaauggccucagcaaacacuuuuauaagaagaaugacgacuaaagauucauaucuaguagcugaagacguacuaccagauucaucgcucauauaugaaaaauucaaaguacuaaacgaacucaauauguuaaaagucaaugaccgaagauugucaauaucacaaaaacaagaccuauucaauaaucuuuucaaaaaacaaaagacaauaagaacuaaaaaauuacaaacauauauaagaacuaaaugggaacuaccauccguaaugauauccggucuaucggaucccgacaaauucaauucuuccuuagcaaccuacaucgacuuucgagacgucuuuggagaaaaaguugacgaccccaaucgucaagcagacuacgaaaaaauaauagaauggucgaccguauucgaagacagaaaaauauaccaagccaagcuaaaccaacuagacugguuaaccgaaagccaaagcaaggcauuauuaacgaaacauuauaccggcuggggaaggcuuagcaaaaaacuauuaaccggacuuaaagaucaaaacggagauaguauacuagaucaacuauggaaaaccaacgacaacuucaugcaaauacaaucuagagaugaauuugcaaaacaaauucaugaugagaaugccaaacaguuucacgaagccaauaacguagaugacaucuuagacgacgccuuuacuucaccacaaaauaaaaaagcaauuagacaaguagauaaagucguacaggacguaguaaaggcaguaggauaugcacccgauaaaauagccauagaguuuacccguaguccacaagauagaccacaaagaacauucaguagacaacgacaauuacaaagcaccuaccuaaacgucgcaaaagcauuaaugaaaucaaaucuaaaccaagaacucaagucaguaauagauucacagcagacucuaacugauaaacuauaccuauacuuuacacaacucggucaagacauguauacuggaaaagagauaaauuucgaugaauuaguaaauuaccaaauagaucacauuuuaccucaagcauucauaaaagaugauucuuuagauaauagaguauuaguuucagcccccauaaauaaugcaaaaagugauaauguaccaguuaaaaaauuuggagccaaaauggguuacuucuggaaacaacuagcagagaaccaucuuaucucaaaaagaaaacucaauaauuuaaccacagauccagacaagauaggaaaauucaccgcucaaggauuuauacaccgacaacuaguggaaacgucacaaguaauaagacuaguugcaaauauucucggaaaugaauauggacaugacggaacgacaauaaucgaaguuacagcaaaaaugaaccaucaaaugcgaaaagacuuugacuugauaaaaauaagggaugucaaugacuaucaucacgccauggaugcuuauuuaacagccuacgucggcgauuaccucuaccuaagauauccgaaauuaagaagcuauuuuguauauggagacuuuaaaaaacuaaaagaucaaagucuaaaaaucagaaauuuuaacuuuuuacacgauuuaacuaacgaugaagccggagauaaaauaguagaccaagaaacaggugaaauuauaugggacaaacaugaauccguaaaacaauuaaaaaaaguauaucacuacaaguucauguuagugucucaagaaguauauacccgacaagacgcccuauucaaucaaacaaucuaucccgcuucagacgcugauaaaagaaaacucaucccgaucaagaacaacaaaccagucgauguauacggaggcuauucagguaaugucgacgcuuacauggccaucgucagaauacauggaaagaaagaagauaaauacaaaguaguaggaguaccaaugcgcgcuguugccgauuuaaaaaaagccgaaucaaaaggacgagauaacuaucugaaugcaguacaugaagucuuaaaaccacaguuuacaaaaaaaaaaaaagaucgaaaaacaggugaaauuacugaaaugauggacgacuucgacguuuuauuagguaaaguauacuauagacaacugauuguagauggaaacaaaaaauuuaugcuaggauccucaacauaccaauauaacgcaaaacaauuaguucuaucagacaaagccaugcaaguccuaaguaaagacgauaaauuaaagaaccaagacgaaaaucaaaauuuaauagacguuuaugaugaaauacuagaaaaaguagaccaauauuuugaauuguacgauauaaacaaguucaggcaaaaacuacacgacggccgaaaaaaauuuauagaacuuccaguagacaaugauuuuaacggaaagaaauuaaucucauauggaaaacgagccaccauuauuucaauacuaaauggucuacacgcaaacgcgaccaugucaaacuugaaguaccucggaauuucaucgccuuucggaaugcuccaaguaccuaacgguauaauacuuucuccagccucacgaaucugcuaccaauccccaacaggacuauucgagagaaaaguaaaacuaucagaucuauga

SEQ ID NO: 5222 - RNA, 3738 nt, Artificial Sequence
  Cas9 variant
augauaauuuacuucauuuucgagaaaauuguaaauacuauucuaguaaugaagaaaauagugggacuagaccuaggaaccaauucaauaggcugggcauuaauaaaugccuacauagaugaauauaacaaagaacaccuauacgguauagaagcaugcggaagcagaauuauaccaauggacgccgcaauacuaggaaacuuugacaaaggaaacucaauaucacaaaccgcagaccgaacuucguacaggggcauccgaagacuacgagaaagacauuuauuaagaagagaacgacuacauagaauacuagacuuacuuggcuuucucccaaaacacuacucugacucccuuaacagguaugguaaauuccuaaacgacaucgaaugcaaacuccccuggguaaaagacgaaacgggaaguuacaaauuuaucuuucaagaaucuuucaaagaaaugcuagcagacuucaccgaacaucauccuaaauuaaucgcaaacaacaagaaaguuccauaugauuggacaauauacuaccuuagaaagaaagcacuaacucagaaaauaucaaaagaagaacuugcauggauacuuuuaaacuucaaccagaaaaggggcuauuaucaauuaagaggcgaagaagaagaaacgccgaauaaauugguugaauauuacucucuaaaagucgaaaaagucgaagauaguggagaaagaaaaggaaaagacacaugguauaacguccauuuagaaaauggaaugauuuaucggcgaaccagcaauauuccgcucgauugggaagggaaaacaaaagaguucaucguuacaacagaccuagaagcagacggcaguccuaagaaagauaaagaaggaaauaucaaaagaucuuuuagggcaccaaaagaugacgacuggaccuuaaucaaaaagaaaacagaagccgacauagacaaaauuaaaaugacuguaggcgcguacauuuaugacacauugcuacaaaaaccugaccagaaaauaagaggcaaauuaguccgaaccauagaaagaaaauacuacaaaaaugaacuauaucaaauacuaaaaacacaaucagaguuccaugaagaacucagagauaaacaauuauacauugcauguuuaaacgaacucuaccccaacaaugaaccacgccgcaacaguaucucaacgcgagauuucugucauuuauucauugaagacauaaucuuuuaccaaagaccauuaaaaagcaagaaaagccuaauagacaacuguccauacgaagaaaacagauauauagauaaagaaucaggcgaaauaaaacaugccucaaucaaaugcauagcgaaaagccacccacuauaucaagaauuuagauuauggcaauucauagugaaucucagaaucuacagaaaagaaacagaugucgacgucacacaagaacucuugccaacggaagcagauuauguaacccucuuugaauggcuaaaugagaagaaagaaauagaccaaaaagcauucuuuaaauacccaccauuuggauucaagaaaaccacaucaaauuaccgcuggaauuacgucgaagacaaaccauauccaugcaaugaaacccaugcacaaauuauaacaagacuaggaaaagcucacaucccaaaagcauuucucucaaaagaaaaggaagaaacacuauggcauauccuauacagcauugaagacaaacaagaaauugaaaaagcauuacauucuuuugcuaauaaaaacaaccuaucagaagaguucauagaacaauuuaaaaacuucccaccauucaagaaagaauacggcucuuauucagcuaaagccauaaagaaauuauugcccuuaaugcgaaugggcaaauauuggaguauugaaaacauagacaauggcacacgaauuagaauaaacaaaauuaucgacggcgaauaugacgaaaauauaagagagcgaguccgccaaaaagcaauaaaccucaccgauauaacccacuucagagcucuaccacuauggcuagcuuguuaucugguguaugacagacauucagaaguaaaagauaucgugaaauggaaaacaccuaaagauaucgauuuauaccuaaaaaguuuuaaacaacacucacuucgcaacccaauaguagaacaagucauaacagaaacauuaagaacgguccgagacauauggcaacaagugggacauaucgacgaaauacacauagaacucggccgugaaaugaaaaacccagcugacaaacgagcuagaaugagucaacaaaugaucaaaaacgaaaauacaaaucugcgaauaaaagcucuacucaccgaguuccuuaacccagaguucggcauagaaaacguacgaccauacuccccaagccaacaagaucuacuucguauauacgaggaaggaguacuuaacucaauuuuagaacucccagaggauaucgguauaaucuuaggcaaauucaaccaaacagauacuuugaaacguccaacucgcucugaaauucucagauacaaacuguggcucgaacaaaaauaucguagucccuacacaggagaaaugauaccccuaucuaaacuauuuaccccagcguacgaaauagaacauauuauaccacaaaguagauauuucgaugacucacuaucaaacaaagucauuugugaaucagaaauaaacaaacuaaaagauagaucacucggauacgaguucaucaaaaaccaucacggagaaaaagucgaauuagccuucgauaaacccguagaaguauuaucaguugaagcauacgaaaaacuuguacaugaauccuauucacauaaccguuccaaaaugaagaaacuauuaauggaagauauacccgaccaauucauagaacggcaacuuaaugacucaagauauauaagcaaagucgucaaauccuugcucaguaacauagucagagaagaaaaugaacaagaggcaaucuccaaaaauguaauacccuguaccgggggaauaacagauagacugaaaaaggacuggggaaucaacgacguuuggaauaaaauaguucuccccagauuuauaagguuaaaugaauuaacugaaucaacucgauucacaagcaucaacaccaauaauaccaugaucccaagcaugccucuugaacuacaaaaaggauucaacaagaaaagaauagaucauagacaucacgcaauggacgcaauaauaauugccugcgcaaaccgaaauaucguaaacuaucuaaacaacguauccgccuccaaaaacacuaaaauuacaagaagagaucuccaaacucuuuuaugucauaaagauaaaacagacaacaauggcaacuacaaaugggucauagauaaaccaugggagaccuuuacacaagacacacuaacugcacuacagaaaauaacaguuaguuuuaaacaaaaucuacgagucauaaauaaaacaaccaaccacuaucaacacuaugaaaacggaaagaaaauuguaucaaaccaaucaaaaggagauucuugggcaauccgaaaaagcaugcacaaagagaccguacauggagaaguuaaucuaagaaugauaaaaacagucucuuuaaaugaagcccucaagaaaccucaagccauaguugaaauggaccucaaaaagaaaauacuagcuauguuagaacucggauacgauaccaaaagaauuaaaaauuauuuugaagaaaauaaagacaccuggcaauga

SEQ ID NO: 5223 - RNA, 3741 nt, Artificial Sequence
  Cas9 variant
augcgccuaguauauuuggcgcucgcccacaugauaaaguuuagaggacacuuucuauaugaaggagacuuaaaagcagaaaauacagacguacaggcucuauucaaggauuucguggaggaauacgauaaaacgaucgaagaaucacauuuaucagaaaucaccguagacgcacuauccaucuuaaccgagaaaguaagcaaguccucaagguuagaaaaucuaauagcucauuauccgacagaaaaaaaaaacacauuauucggaaauuuaauagcauuaucacucgguuuacaagccaauuuuaaaacuaacuuccaauuaagcgaagacgcaaaacuacaauucagcaaagacacauacgaagaggacuuagaaggucuucugggugaagugggcgaugaauacgcagauuuauuugucuccgcgaagaaucucuacgaugcaauauuauuaagcggaauacugaccguagacgacaauaguacaaaagcuccauuaucagcaucaaugguaaaaagauacaaagaacauaaagaggaacuagcagcuuuuaagcgauucauaaaagaaaaauuaccaaaaaaauacgaagaaauauuuaaagacgacacaaaaaacggauacgcaggcuacguaggcgcagacaaaaaacuucgaaagagaucaggaaaacucgcaacggaagaagaauucuacaaauauguaaaaggaauacuaaauaaaguggagggcgcugauuauuuucuagauaaaauagacagagaagauuuccucaggaaacaacgaacauuugacaaugggaguauaccccaucaaauccaucuccaagaaaugcacgcgauucuccgcaggcaaggcgaacacuacccauuuuuaaaagaaaaccaagauaaaauugaaaagauacuaacauuccgaauuccauauuacguuggaccguuagccagaaaaggcucgagauuugcaugggccgaauacaaagcagacgagaaaauaacacccuggaacuucgaugacaucuuagauaaagagaagucagcagaaaaauucauaacgagaaugacauuaaacgaccuuuaccuuccagaagaaaaaguacuuccaaaacacaguccacuauacgaaacauucacaguauacaaugaacuaacaaaaguuaaauauguuaacgaacaaggggaggcaaaauuuuucgauacaaauaugaaacaagaaauauuugaucauguauuuaaagaaaauagaaaaguuacaaaggacaaauuacuuaacuacuuaaacaaagaauuugaagaauucagaaucguaaacuuaacaggauuagacaaagaaaauaaagcauucaacgcgucucuuggaacuuaccaugacuuaagaaaaauccucgacaaaucauuccuagaugacaaagucaacgaaaaaauaauagaagauauaauccaaacccuaacacuauucgaagauagagaaaugauucgccaacgccuacaaaaauacucugacaucuucaccacacaacaacugaaagaacuagagaggagacauuacacaggaugggguagauuguccuauaaauugauaaacggaauaagaaauaaagaaaauaaaaaaaccaucuuagacuauuuaaucgaugacggauacgcaaacagaaauuuuaugcaguuaaucaacgacgaugccuuaucauuuaaagaagaaaucgcacgcgcacaaauaauaggugacguugacgacauagccaaugucguacaugaucuacccggcucaccagccauaaagaaagggauacuccaguccgucaaaauagucgacgaacuaguuaaaguuaugggacacaacccaacaaacauuauaauagaaauggcucgcgaaaaucaaacuacugauaaaggacgaagaaacucacaacaaagacuaaaauuacuccaagauucauuaaaaaaucuagacaauccaguaaacaucaaaaacguugaaaaccaacaauuacagaaugacagauuauucuuauauuacauccaaaaugggaaagacauguacacaggagaaacacuagauauaaauaauuuaucacaauaugacauagaccauauaauaccccaagcuuucauaaaagacaauucucuagauaauagagucuuaacaagaucagacaaaaaccgcggaaaauccgacgauguaccaucaaucgaaguuguacaugaaaugaagaguuucuggagcaaauuacucuccguaaaauuaaucacccaaagaaaauucgacaaucuaacaaaagcugaaagaggaggacuuacagaaaaugauaaagcgggcuuuaucaaacggcaauuaguugaaacgagacaaauuacaaaacacgucgcacaaguccuagaugcaagauucaaugcgaaacacgacgaaaacaaaaaaguaauacgagaugucaaaauaaucacauuaaaaucaaaccuaguaagucaauucaggaaagauuucaaguucuacaaaguacgugaaaucaacgacuaccaccaugcacaugaugccuaucuuaacgcggucaucggcacugcgcuccuaaaaaaguacccgaaacuugcaagugaauucguguauggagaauucaaaaaauacgacguaagaaaguuuaucgcaaaaucagacaaagaaaucgggaaagcaacagcaaaauacuucuuuuauuccaaucuuaugaacuuuuucaaaaaagagguaaaauuugccgauggaacaguuguggaaaggcccgacauagaaacaucugaagacggagaaauagcauggaacaaacaaacagauuuuaaaaucguaagaaaaguauuaucauauccccaaguaaauauagucaaaaaaacagaaguccaaacucacggcuuagauaggggaaagccaagggggcucuuuaacgcgaaccccaguccgaaaccuaaaccugauagcucugaaaacuuaguaggaauaaaacguaacuuagauccaaaaaaauacggagguuaugcaggcauuucaaacucauaugcgguauuggucaaagcuauaaucgaaaaaggcguaaaaaaaaaagaaaccaugguuuuagaauuccaaggcaucucaaucuuagacagaauaacauuugaaaaagauaaacgagcauuuuuacuuggaaaaggcuauaaagacauaaagaaaaucauagaacugccaaaauauagccuauucgaacuaaaagacggcagcagacggaugcuagcuucaauccuuaguacaaauaauaagagaggagaaauacacaaaggaaacgaacuauuuguuccucaaaaauucaccacgcuacuauaccaugcaaaacgcauaaauaacccuauaaacaaagaccacauagaauacguaaaaaagcauagagacgauuuuaaagaauugcucaacuacguuuuagaauucaacgagaaguacgucggcgcaacaaaaaacggugaaagacuaaaggaagcugucgcggacuucgauucaaaaaguaacgaagaaauaugcaccucauuuuuaggcgcagucaauagcaaaaaugcaggacuauucgaacuuacaucauuaggauccgcuucagacuucgaauuccucggaguaaaaauaccgcguuaucgagacuacaccccaaguucacugcuaaaagauagcauacuaauucaucaaucaaucacaggauuauaugagacaagaauagaccucucaaaacuaggagaagacuga

SEQ ID NO: 5224 - RNA, 3747 nt, Artificial Sequence
  Cas9 variant
augaagaaaauccuaggccuagaccuagguagugccaguauuggaugggcagugauaacagagaauguggaaaacggcauaacaaaaugcgacaucuuaggcaugggcagucgaaucaucccauaugagggaacugaaggaaaagauuuuaccaaagguacaggcgaaucucguaauagccuucggacaaaagccaaaaccgcaagaaaaggcuaugaucgauaccaacuaagaagaaaauauuuaguagauacacuaauaaaaaaccaaauguacccagacgaagcaacccgcaaccucccaaaaaugaaauuaugggaauuaagagauaaggccguccacucuccagucucguuaauggaauuaggaagauuacuacucugguuaaaccaaaaacgagguuauaaaucaagccgaucagacgcaaaucuagggaaaaaggauacagaauauguagccaccguaaaaucacgacaugaaaaaaugaaagagcuagacgugaccaucggacaauacuuuuaucgagaacuaucagcaaacgaauuuuuuaaaguaaaagaaaauauauucccuagggaagcuuacauagaagaauuugaugccaucuguaaaacacaacaaauagcucauccaaugauccuacgaucagaguuaauugacaaaauuagaaacgaaguuauauauuaccaacgacccuuaaaaucacaaaaaggacuaguaucaguuugcgaauucgaaggcuuuuggcgaauaggaaaggacggaaaggaauacuucguaggucccaaaguggcaccgaaauccaguccucuauuccaauuagcaaaaaugugggaaaauauaaauaauauaaaaaucggcucgaggacaggagaagacuuaaaauuaacaacggagcaaaaaugggcaauauuucaacaucuagacaacaaugagaaauuaacaccaacagaucuacucaaaauacuaaaucuaaaaaaggaaaauugcuauguaaacaaacaaaugggcaaaggacucaauggaaauauaacaaaacaugcaauccuacaauguuuaggaggaucugacaaauaugaaaacuuacuaaaacucgagcuuaaaaugguggacggugauaaagagggauaucuuuacgacagaaaaacaggcgaaguauuaaauuccaaaaugaucaaauucauagaccccaugguagagcaagaaccauucuaccaacuauggcacauaaucuacaguauacaugaucaagaagaaugcucaaggguauuacaagcaaaauucgacauagaacaaccaaucgcugauaaauuagccgcaaucgauuuuagcaaacacgcauucggauccaaaucagcuaaaguaauuagaaaaauacuacccuaccuaauggauggagacggauauagugaagcaaugagcuaugcugguuacgaccauucaaauucccaaacuaaggaggaaaauuuacaacgaaaauuacuagaccuauugaaaccuaucccuaaaaacucacuuagacaacccauagucgagaaaauauuaaaucaaaugguaaacguagucaaugcaauuaucgaaaaauacggcaaccccgacgaaaucagaguagaacuagccagagaacuaaagcaaaguaaagaagaaagaaaugaugcggauaaagcaaugucaaaaagacaaagagaaaacgaugcaauaaccaaaagacuagaagaauucggauuaagggccacuaggaacaauauaauaaaauggcgacuguaugaagaaauagacaaccaagaaaaaaaacuaaacgcaaugugcguuuacugcggacaaccaauaucccucacagaagcgcuuagaggaaaugauguagauauagaacacauaauucccaaaagcaaacucuucgacgauucacaaaguaauaaaaccuuagcucaucggcacuguaauaagaauaaaaaugaccuaacggccuaugacuucaugaagggaaaaccagaggcgguauucaacgaauacguagagagggucaacuugcucuaugauaaucacauaaucagaaaagcaaaacgagauaaacuacuaaugacugaaagcaagauaccagacaacuucauugacagacaauuaagagaaagccaauacauugcaaaaaaggcucgagagauacuucaaacaauaugccaugauguaugguccacuucagguacagugacugcggaauuacgacacuuguggggaugggaugauguaacuaugaacuugcaaauggcaaaauauagagaauuaggacuaacucaccaaguagaaugggaaucagaacacggcaaaaacaaacaugaaaaagaaguaaucacggacuggaccaaacgagaugaccaucgacaucaugccgucgacgccuuaacaauagccuguacaaaacaaggauucauucaaagauucaauacauuaagcgcagcuaaaaccagagaagacaugauguucgacauagaacaacgcucccaugaauucaaggaaaaaagaaguuuauuggaaaaauacauaauaucagaacaaccacuuaaaguugacgaaguggaaaaggcugucuccaauauacuaaucaguuucaagagcggaaaaaaagucgcaguauggggaacaagaaaaaucgguaaacgggggaguaaaaagguaauucaaaaaaaaauaauuguaccaagagggucucuuagcgaagaaucaguauauggaaaaaucaaaaaacaagaagagaaagacuauaaguaccuauucgaaaacccgcaacuaauuuucaauccaacaaucaaagcgaagguagaggaaagacuuuuaauguuugacggagacguuaaaaaagcaauaacuucucuuaaaaaaauacccauauacuuagacaacaacaaaacaguuguauuagaaaaagcgauaugcuuaaaagacgaauucguaauaaaauauuccguagacauuaauuucaacaaaguggauaaaguuguagauccaaaaauaaaagaaaucuuacaaaacaggcuaaaaaaauuuggaggaaaagaaaaagaagcauucaaagacguccaauuagaggacaaaaugauaauuaaaugguacgaagaugaaggucuagagagaccaauaaagagcguacguugcuucacgggacuaagugccguaguaccugucaaaaaagaugaaaacggaaacgacaucgguuuugucaaaccaggaaauaaccaucacauagcaauuuauacagacaccgaagaaaauaagcaacaacauguaugcacguucuggcaugcagucgaaagaaaaaaauaugacauaccugucauaauaaaaaauaccaaugaagugugggauaaaauucaaagccaacccgacgguacauaucccgauaguuuucucgaaaugcuaccaccgccaaacuuaaaccuauugguaaauaugcaacaaaaugaaauguuuauauuagguaccacaacagaagauauuaaacuagccauagacaagagggacuacaaaauaauaggagauaaacuauauagacuacaaaaaaugagcaucaaaccaucuucuggacagauagacauaguauuuagacaucaccuugaaacacaauuaauagaugaugaaaauagcaaaaaaagcaaaagauuuuacaaugugcagaguuuaggggcucuuuucgcacugaacccauuuaaaguuagaauagacaauuuaggaaaucugguaaaggaaaaauga

SEQ ID NO: 5225 - RNA, 3762 nt, Artificial Sequence
  Cas9 variant
augaaagcaagaggaaauuuucuacaucaagacacaccuggacuaacagcagcaaaugcaaacaugggcgaugcaguugaaaaauuauguguagccuuagaagauuggugcaccuuacgcaaccuugaauguaauauccguaaaaaccagaaaaacauacaaaaucuuuuagaaggaaaaaccguugaagucucagcagaaaaugcuuuaaaagagucguucgacucaagccgagccaguagaaaagacaaagcaacaauauuaucaacauggauagccauacaaccaggcgaguacuuagacgcuaagcaagcuaaggaugcuucaaaagagauagccaauguauuguuuggacuacaaggcaauaugaagaagauauucauugaguucgaagaagaccaaaagauucguuuagauaacgacgaacaaguggaagcauuuuacucauuaugucccgacgaugguguugcauuauuugagucauuccaaucgauauauagugcauauauuuuaauggguauccugaaaaacgcaaauggugguucaauaucaucaugcaaaguagcagccuaugaccaguauaaagaagaucuaaaauuacuaaaagacuuaguaagagaauuugccucugaaaaauacgaugaguucuuucguggagauauauuugacaguuccaaaggauucagggcaagaaauuauaauccagcaacagcaaaaggauacaccaaauacaauaguguucgcggcgcauccuaugacgauuucaaaaaggaagucgagaaaaucuuuaaagguacaguugccgaagaagauauccgauauguugauaugaugcagagauucgcagaagguacguuuuugcgacguuuaaaaaccucugauaacgggagcauaccauaccaauuacaucuagaagaaauggaugcaauuguagaaaaucaaaaacaauucuauccguuuuuagaaagugaaaaggaaaaacuagaaucauuaguaacauucaggauuucauauuacgucgggccacuaacacagaaaaaugcaagauuagacaaccacaauaaugcaagauuugccuggagccaaagaaaggaaggcaaggaacaugcaagaguuuacccauggaauugggaagaagucauagacagaaaacaaucagcagcaaaauucauggaaagauugacagguacaugcaccuauauauuagaugaacccguacuacccagauguagcuuauuauacgaagaauacugccuucuuaaugaacuaaauggauccaaauggagagacaugggaggagauuggcauagguuugacuacgaaacaagaauggaaauuauagaaaaucuuuuuaaaaagaagaaaggaucuguaaaauaugcagcaguagaggacuggcugaaaugcgaaaaacacaaaucaugcgcagaaguaaaaggaggucaaggugaaacaggauucgagagcaaacucucaucuuauguuuucuuuaaagaaguccuucacgucgaugaaauagacgaggcagauauuccaaugauagaagaacuaauaugguggaacacacuguuugaagacaggucaauccucaaagaaucuaucgaagauaaguauggagacagacuuacggaugaccaaauaaaggccauaugcaagaaacguuuuacuggaugggggagacuaagcaaagaauuauuaugcggaauaaaaacgcacacagauaauggacccuacaguauaauggacguauuacgagaaggaaauccuaauaauaacgcacgaucagagacuaugguauuuauggagauacuaagagaugacaaauuuggauucgauaaauuaaucgaagaagaaaacaugaggagaguuucagaaguagacaauuuugacguuaacgauuuacccggaaguccagcaguaagaagaaccgugaaccaagcaaaacgaaucguggacgagauagugggcauagcaggaugugaaccacaaaauauuuuuauagaaguaacacgcgaugaggauggaagaaacaaaggucgacgaacuaaaagaagauaugacaauaucaagaacgcaauagcagcauugaagaaagaacaaaaagaguauuuuaacaaagauguaucagacagcuuaaauaaaacuaauccuagugaccuagauaaugaaagauuagcacuauauuuuaugcaaaaugguaaauguauguacuguggaaaagauuuagauauuaaacaacuugacaaauaccaagucgaucacauuuuaccacaaucauacguaaaagacgacucauuugaaaacaaggcuuuaguacauauggaagacaaccaaagaaaaucggcaagcaugcuauuagaugauaguauaauaagaaaaaugaaacccuacugggaggcacuaagagcugcaggcuuaauaggagaaaagaaauucaaaaaucuaacccgaguuagagugucagauaaagaacuuggagguuuuauagcacgacaaaugguagaaacaucccaaagcaugaaacuaacuucguuaguacuggagaaaacuuacccaaauacaaacguacgaccuguuaaagcagguuucucaagugaccuaagaaaacgauuagauuuaauuaaaugccgagaaauaaaugauuaccaccaugcacacgacgcguauuuagccugugaaauaggacaauucauaacgaugagacauaauaaacuuuaugaaaacccaauaucuuacucacaugcaguaaaagauuuuauagcgaaaagagcaaaauaugcaaaugaccaugguacucccauguccacauacggaaugccaggauccuccucauucguuaucucaucauuucucacaagugguuuugacgaagaaacaggagaaauauuuaaagacgccuggagugccgaaguagcagcaguuagaauuagagaaucccugaaccgaaaggacuguuauauuagcagaaugcccgaagaaacaaguggugcauuuuggaaagaaacuuuaauuucaccacgcgacccuagucuagggaaaaaccucagccuuccuauaaagaaaggacuagacccacggaaauauggaggauauaaugaacaaaaauuugccuauuucuuugucuaugaagcagugaaaauuaaaaagaaaggagaaguaaaagaauacguauuugcagcagucccaguacaaguugcagccauaguagcaagagaccccaaugcacuaacaggauucgcaaagaaagacgccgaagcacgaaaaauaaaauucuuacgaauaaucagagaaaaaguuuacaaauaccagcugauagagguaaauggagagcgauuauauauuacaggcuuaaaaaguguaagaaacgcaagacagaucgcguuaucgcaagauaugacgacaguauuccuaaaagcaauuaacgauaaagaugucgcagaagacgaauuaaaaagccuuuucgaagaaauuguucaaagauauagauuaugugcaaauagacugggaaaccaacuaaaaauauuuucauuaucagauucauucaacucugcaaacuccgaaagcaagaaaagagcauuagucucauuaguugcaauaauagacgcaaaaacaaacaaaauagauuuaucagguauuggaucagguaaagcaguaggcaacaugagauuaucuuuuuccaaagaaaugagcaacucgaaaaaucauuuugccuuuauagaccaaucuguaacaggaauguuugagagaaaaaccuaccuauga

SEQ ID NO: 5226 - RNA, 3777 nt, Artificial Sequence
  Cas9 variant
augaccgaggaaaauccagacauacgcaaaguuuuucuugcgauccaccacauacuaaaaaacagaggacauuuccugcuccaagggcaaucuuucaaagaaggaaaccugaauaacuuaauaaaagaauuacugaaccuagacaucuugcacaucucaauagaaaucacagaagaaaauauaaauaaaauaaccgaaauagcccuagagaagaaaacauuaacagacaaaguuaacgaccuaaaaaaaaucuauccuaaagaaaagcaauuacuagaagcauuuagacuaauuuucggaggcaaaacaagucuggacaaacuauucgccauugaugaauacaaggaauuggacgcaaguguaaaaaguguaaguuucaaagaaaaaauuuacgaagaaguaagacaugauuaugaacaagugcuuaguaauuacauugagcuacuagaccuagcuaaauugguauacgauuccauuauacuaucugacauuaaaaaggaaggaaaaacucucagcgagucaaaaguagaacuauaccacaaacacagagaagaccuuacaaaauugaagaccuuaguaaaaaacgacagcaagcuaagugaagauaagaaaguagaauuauauagugcaauuuucaaagaagacaaagacaaaggaacaaacuaugugaauuacauucgaaaaucggaagagggaaaaggaugcaacuacgaagacuucaaaaaauuucuaguaaaagagcuagccaaacuagaagaaagcucagcaaaagaagaaauacucagagacuuagaauuagaguuauuucuuccccuacaaagaaccaaagauaauaguguaguaccauaccaaauacacaaagaagaacuaguaaaaauauuagacaaugccgcuaaauaccacaaauucuuaaacgaaaaagacgauagcggauauucaauaauagaaaaagucauccagcucuuagaauuucggauacccuacuacguaggcccacuuaauuccuccaaaaaagcuaagguagacggauuugcauggucaguaagaaacaaaggauacgaaaacacccccguaacaccuuggaacuaugaaaaagucaucgaugaaucugcaucagcagaaaaauuuaucaccaaccugacuaacaaaugcacauaucuaaaaggugaagacguacuaccaaaaagcucacuacuauacucagaauuugcacucuuaaaugaauuaaaugcacuaaaguacgacggaaaccgaauuucucuagaagcaagaaauguaauaauagaaaaauuauuuaaagaacaagguaaaaaaguuacuaaaacuaguauaaaaaaucucuuaaaagcagaaggauacauagaugguaaaggagaaaucacuggaauugauaucacuguuaaaaacgaucucaaguccuaucgagacuucaagaaaauucuaggugacaaguucaacacagaacacguggaaaauauuauucuauggauaacccuauacggcgaaucacgaaaacugaucaaggcaaaaauagaagcaguauauggcgacaucuacuccaaagaagaaauagccaaaaugaguagauuaguauacaaagacugggguagauucagcagaaaacugcucacugaacuuguaucuaaaaaguuauacaaugaagaaacaggagagugucucaacaucaucggugcuaugcgacaaaacaauauccuauucauggagcuacuagccgaccguuuugacuauucacaacaaaucauugauuauaacaaagaacuucaaaaagagguuacagaaauaacaccugaaaucuuagacgaccuauauguaaguccguccguuaaacguucaauauggcaaacaguaagaauagucgaagaacuaaaaaaaaucaucggaugcgcaccagcaaaaaucuucguagaaacuacaagaucgaaucaagacaaaaaaaaaccaacugauagucgaaaaaaacaauuagaauuguuuuauaaggcaguaaaaaaagauguaaaggaucucgaaaaagaaauuggaaguuuaaacuuugacaaacuaaacgaacgauuaaguucaguagaaccaucaaaauuaaaagcaaaaaaacuauacuuauauuacacacaacuaggaagaugcauguacagcggugaaacaaucgauauaacacaacuaaauaccacugcuuacgacauagaucacaucuacccgcaaucaaagguaaaagacgacagcuuuaccaacacuguacuaguuaaaagagaauacaaugcugcuaaaacugacagauacccauuaggaucagauauacaaaccccaucaaacagacgauucuggaaauuucuuaaagaaaaagggcugauuacagaugaaaaguauaauaggcuagugaggacagaagaauucagcgaugaagaacuaacaggauuuauagcaagacagcuuguagaaacuucacagucagucaaggccguagcggggauccuaggugaacuaaacccaaaaacaagcauauguuacaguaaggcagagaauguauccucauuuagacagaauuucggaaaaauaaaagagggaaaucgaaagucagauaauacggaacaauuaaucaaagucagagaaaucaacgacuaucaccacgcaaaagacgcauacuuaaauguuguaguugguaauguauaugauacuaaauucacucgaaauguauuuaauuucaucaaagauaaaaaagacggaaggaaauacagccuaaacaacgucuucuacgaaaacguaaguaacucaaauaacguggcaugggaauuaaauaaaacugugcaccaaguugaaaagguaaugaauaacaauaauauuuuagugaccagaagaacuagugagcaaaaaggaggccuauucgaugcaacaguauacaaagcaaaaguagcagcaaaagcaaaggaaggaguuuacuauccacuaaaaacuagugauccaguaguaaaugacgugacuaaauauggggguuuuacaaagguuaagauugccuauuacucgauauuugaauauacacugguaaauaaaaaaggugaagaaaaaaucacaagaaucauaccuaucccaauauacguaucacaaaacauuaaagacgauagcacuuuauuagaauucggcaaaacacaaauaaacauaaaaucaggggaagaaguaaaagauuuuaaacugaaauauaggaaacuaugcauaggcgauuuaguaaaaauaaacaauuuuuuuaauuuuauugguggaaaaacaaaugacucauucgucuaugacggagcaguccaaguaacuuuagacaccgaguccgaaagauacauuaaaacuuuaucgaaauaccaaaacuggaagaaagaaaauaaagauggcgaauuaugggagucaauaacuaaagagaaaaacacagaauuauacaaccuauuaguagaaaaaaugaauucgggaaucuucauaaaaaaaaaaccaaacaaguucaacgaauuaaauucagaagagauaaggaauaacuuuuccagcaucagccuagaggaacaagcaaaaguucuccuagagguacuaaaccuccucacuaacaagaaaucaauauuugauuugaaaucgauaaauaucaccgcggcaagaggaaaaauaagcuuuaauuuaucaaauuuaagucaauucagcauuauagaacaaagcguagcgggcuuuuaugaaaaagaaauaacgauuauuggagacaaagaaaacgacauggaaaacaauaacuguuga

SEQ ID NO: 5227 - RNA, 3780 nt, Artificial Sequence
  Cas9 variant
augaaauacauucuuggucuagaucuagggguagcgucuaucggaugggcagugacggagauaaacgaaaaaggagagccgguaggacucauugacgcaaauuccguaaucuucaaaccccucgauaacgauaaaggaaaacuauauaaugucgaaagaagagacaagagagguucaagaagaauacuacgaagaaagaaacauagaguugaaagaacaaaaauguuacucgugaacucaucuuucuuaacuaacgaagaaauagauaaucuauaugucggaaaauuagacaacaucuaugaaguacgauuaaaaggacucaaagaacaacuaaguaaaaaugagaucgcaagacuuaugauauauuauugcaaaaaucguggauuuaaaucaaauagaaaaacagaagacuuagaaauauuaaaaucacuaggcgagaaaauaucggaaaaagacucagacgaaaagaaacuaaaacccauaauagccaaaaacacagaacuaauagaaagcaaaggacuaacacccaucgaagucauauacaugauuagagaaaaugacaacuccauacugggauuuaaaaacaaagaaggcaauuauaaauucggcuucaaaagaaaucaaguaauagaugaagugagaaaaauuuuaggaacucagcaaauccuaagcaaagaaauaguagacgaauacauagacauauuaucaagccagcgagacuucucagaugggccagggggagacucaaaguacaagauagacuacacaaaguuagcaggaaaauguaaguacacaggugaaguacgcgcaguaaaaagcgcuccaucuuaugaaauauuuacgaugcuacaaaagcuaaacgacauaagauauguaaaauuuacaagcgaagacaaaauugaaaagaagaaacuuagcaaagaaguaauucauaaacuuuaugacuuaguaguagagaaaaacaaaacccuaacauacgaccuaauagaaaaaucaauagaugaagaaaacauuaaacuacugaacauacccaaauuaucaaaaagcaaauacguagaacuaaggaaaucuuauuucaaagaacgcaacgauaacgaaaauuuaaccgaagaagaaauaaaugcauuuaaugaaaaauuaaacaaugaaagaaugaaacaagaacuaauccgaaacaaucuaaaagcauacaaagaacuaaaaaguaaauuuaagaaaaauaauauagacgagaacaggauaaaagaacuaggaggcauuuauuuccuggauuuaguagcggaacuccuuacguacaguaaaacggacgaaaagcuagaauacuucguggaaaauguagaacgauauagccucuuuaaagaacaacgugacauuguugaaauaauaaaaacuuuccccaauuauacaaagaacggcaaccuaucacugucuuuaguacgagaacuaaacaaacuuuuaauggagggacacgauuaugagucuagcuuaaguagccucaacuauuacaucgacacugauguagacugggaaaaauucccaacaauaagugaaauugaagacucccuauccacaaaaauaacaaaucccaauguuaaacauaucuuaguaauauuaagaaaauuauacaacacucucuuauuuaaauauggaagacccgaaaagguacaccuagaauuaucaagagacuuuaguaacgacuuuagcacaagaaacaaaauucaaaaagagcagcuggagaauaaaguaagaagagaaguggccgcguucgaaauguauggcgcaaauaaagacaucguugcaggaaaagacaggcuaucgaacgacgauuuuguacgcauaaaacuaugggaagaacaaaacaaggugugcauguauucaggaagaacaauugaaaaauaccaguuaaccucagcugaggugcaaauugaucauauccuacccuacagcaagagcuucgacaacagcuacagcaacaaaguuuuaguuuuuagcaaugaaaaccaagauaagaaagaaaggacgccauaucagugguuaaaagggacugaaaaauggaaugaguucaaacaaaggguccggcuaaaccugaacauaucgaacaaaaagaaagaaaacuugcuauucgaagaugaaguaguaaauaaugaguuccuagaacgagaacuacaugcuacaucauacaguucaagacuagcccuaaauauuuuucaaagacucauaccagucuccgacgaagacaaauacgacgaacauggcaacgaaaaagucaaauaucuguauaacaggaacgucaucgcauuucaaggcaaaaugacaucgauguugagaaaccuuuacucacuuaacaaauauacucacucguucgaaucggauacacuagacaucgauaauaaagcauuuauacuuaaagaguucgaaauaaauaaagauaaucuuaaaaugacagcuuacaacgugaauaccgggcuugaaauaacuucagaaacaaaaguagagaaaaauaaaucaggagaguucaaaacaaucaaagaugaacuacuaaagaaagaauuagauaagaaagaaaauuuaauagaaauaucagauuacuucaaagauaaaguccucuucgaucuaaaaauaguagauuuugaagaaauagacacaguagaaccagaaaucaucucgauccuauacaaaaugauaacggcgcucaaagaagaaguauacagcaaaaacagagaaaaccaucuucaucauucacuagaugcauucuuacuaaccauaaugaacagaucaaugcaaaugaaauuaaucaaauacaaucaacuaauaagcguauuaaagaacaaagaaauagagauauuuaacgaagaaaaaggugaauauauagauaguaaagaauuugcagaagaacuacaaaaacagaaaauaauagacauagacggaaacgaaaggggaaucaaauucaacguaaacgguaaaacacaccgacuuaacuuaguaaaaccuuacgagaacuucuuagacgacauuaaaaacaaaauauuugacaaacgcgaaaauaacaaacuuccguaccacguaguaaaaucgaaagucagcggggcauuacacgcugaaacaauacuaggugaaucuaaaggagaaauaacaaagagaauaucagucuucgacauaaacuacaaaaaccuagguaaaauauuugacaaagauggcucccaaaaagaaauauacgaaacauuaguaaaauggcuagaagcuaaaaguaaggacuaccccaaguuaaagaacggaaacauaaucaagaaaguaaaaauaguugacggaaauaaagacaaacuaaucaaacuaggaaacaaacgauauguggaaaugggcagaacaacgguaaaaaucuugguacuuaaaaaggaagcagaagaaggacuaaaguuugcaagcauagguagauacaaauauaaccuacuaaaaagcgaaaaagacguuaauauaaguauauggaaagacgccauucacuuuugcaaaguacgauauaacaaacuaaaggaaaacggcuacagguuaauccacgaacuuauaccgggagaaacgauagaguuagaacuaaauaaaggaaacauaucaaaaugucuugucguaggauuuaguggaggaaaaauagaaauaucaucagucauaggagacgcacuagaucugauaaacgauaaaauauccaccagaauaaaagaaagauauuauaucacagucucaacaauaaaguccaucaagaaaaucaacaaaaacauauuaggagauuga

SEQ ID NO: 5228 - RNA, 3792 nt, Artificial Sequence
  Cas9 variant
augcauaaaaacaaucccgacaucagagaauuguucuuagcaauacaccauauauuaaaauauagaggacacuuccuauucgcagggcaacaauuuaaagguucagaaauuaaagauaauaucagagaauuauuacaauauaacagccuaaauauaaaaauagauauuacagacgaauugauaaauaacauagcagaaauacuccucaaaaagaaaaacuccacggacaaaauaauagaauuuaagaaacuuuucgcagacgaaaaacaacuaauagaagcacuacgucucgcacuaggcaacaaaacacaacuugcaaaacuauucgacauagaagcauauaaagaauuagauauuucaauuaaaacaauuagcuuuaaagagaaaauauacgaagacguaagaagcaacuaugaagaaauuuugggagaauacaucauagugcuagauacugccaaacuaauuuacgacgccaucauacuaucagaaauaaaaaucaaaaauaugacaauaucagaaucgaaaguaauaagcuaugaaaaacauggaaaagacuuaaaacaauuaaaacaacuaauaaaagaagacucaaaacuaucaaagaaagagaaaagacaguuauuugaaaacauauucgucaaagaagaugaaaaagaagcaaacuacguaaacuacauaggcaaaaauaaugucggaagcagcaaaagcuccuguucauaugaagacuuuaagaaaagccuaauaaaagaacucaaauacugugaagaaucaaaacucaaacaagauauacuugcagaacuugaacuagaaacauuuuuaccacgccaaagaacuaaagacaauaguguaaucccauaccaaauacauaaagaagaacuggagaaaauacugaauaacgcaguucaauaccauccauuucuuaacaauaccgacgaauacggcaucucaauaaaagagaaaauuauucaauuacuagaauuuagaauccccuauuaugucgguucuuuaaauacaucacauaaaguaggcaacggaggauucucaugguccguacgaaacaaaggcuacgaacguacagcagucacaccuuggaauuucaauaaagucauaaauaaagaagaaucggcgaaaaacuucauagaaaauuuaacuaaccaaugcaccuaccuccuauaugaagauguccuaccuaaacauucacugcucuauuccgaguucacucuauuaaacgaacuaaauucuauaaacuacggaggcaaaagacuaacugucgaacacagaaaucuaauuauagaaagauucuucaaacaauccgcaccgaaagccaccggaaaagaacugaagaaauuccuaaugagugaaggagucaucgacgggaaagaugaauuaagcgguuucgacaucucaauuaaaaaugauuuaaaaucauauagagauuuuaagaaaauauuaggagaaaaauucgacagcgaaaaagucgagaaaaugauaagauggauaacacuauucggcgaaaguaaacaacuucuuguggacaaaauaacgaaagaauacggcgacaucuauagcucagaggaaaucaagaaaauaucagggcuuaccuacaaagauuggggacgucuauccgaaaaacuccugacugaaaucguuucaucacagcuuuacgaugaaagcaccggagaauguuuuaauaucauuaacgcaaugagaaacaacacacuacuauucauagaauugcucgguacaaauuacgauuacuucgagaaaauaaacaccuacaauggaaaauuaaggaaagaaauaacagaaaucacaccgcauauacuugaugaccuuuacguaucaccagcaguaaaaagaucuaucuggcagguaguaaggaucguagaagaacuaaagaaagugauuggcagcgaaccaaaaagaauuuucguagaaacuacacgcagcaauaaagaaaagaaaggugaugacggaagaaaagacucaaggaagaaagcacuacuggaacuauacaagaaaauaaaaacaagugauauagcggaauuagaaaaagcccucggucacacaguugacuucgauaagaagaaacaagaucuaaccgacauagacaacaauaaauuaaaagccagaaaacuauaccucuauuacacacaacugggacgcugcuuauauacaggcaaagcuauagauuuaaauaaucuauucggcucaaacagugaguacgauauagaccauauuuacccacaaucuaaaacaaaagauggauccuggaauaaccuaguacuuguuaauaaaacagaaaauucuaagaaaaguaacggcuuaauaagugaaagcauacaaaggaaaaacaagcauuucuggcgauuucuaaaagccaaaaaccuaaucucagaagaaaaauacaaacgauuaacacgaaccgaagacuuuacugauggagaacucuccggauuuauagcuaggcaacuuauagaaacaucacaaucagucaaagugguuagcaaaaucuuacaaaaccucaacccaacuacagaauuauguuuuucaaaagccgaaaauguaucagacuucagacaagaguucgguaaaaucaaaguagggaaacguaaaaaccuaaccgaagaagaacagaagaaagcgaaagagggacaauuaauaaaaguaagagauuuaaaugacuugcaccacgcaaaagaugcauaccucaauauaguaguaggcaacguauaccacaucaaauucacgagaaaccccaaaaauuuuauaaggaaaaacuucaaaaaccgcgaauauaccuuaaacacauuauucuauucagacaaaguugaaagaaauggugaaguagcaugggaaaaaggaaaaaccgaagaaaucguuucaucaguaaugugcaacaaccuaaucaacguaacacggagaacaagugaacaaaaaggagcccuauacgaagcuacuauauauaaagccaacgcagcaaaagaagguucauauuaccccgucaaaaccaacaauaagaaccucaaaaauguaacacgauacggagguuuuaccucuauuaaaaucgcauacuauucaauauuuaaguaugacaucagaaacaaggauaaaguuaaggagaauauaaaaauuauaccaauaccgauuuauaucucccaaaacauaaaaacagauuuagaucuaauaaauuucgcagaaaagcaaauaaaauuaaagaaaggugaaaauaucgaaaacuuacaacuaauuuacaagaaacugaacaucggagcgcuagucaaaauagaucauuacccauauuauaucggcggaaaaacagacgacaacuucuacgucgauggggcaguacaaguacuacugucuucagacauagaacguuauuuaaaagaaguggugaaauucgucaacuuucaaagagaaaacaaagaagcaaaaguaucgaaagaacauauaagccucgaagaaaacauaaaacuauauaacacuuuaguauguaagauggcaacaaaaauauuuacccauaagaaaaauaauaaauauaacgaccuaacacaagacaaagccaaaaacacauucaauaaacuuucauuagaagaacaaugcaaaguuuuauuagaaaucuuaaaccuauuaacaaauaagaaaaccacauucgaucucucccuaauuaaugagaaaacaucacgcguuaaaugcggauucaaucuauuaaaucaaaaacaguuuagcaucauagaacaaaguguaacgggauuauacgagaaagagaucaaaauaaucgaagacuga

SEQ ID NO: 5229 - RNA, 3795 nt, Artificial Sequence
  Cas9 variant
augaaaaauguacuaggauuagaucuagggacaaacucuauaggaugggcauuaauagaaguugaugaaaacaaucuaccaauuagaauuauagcaauggguucaagaauaauaccacuaucuacaagugauaaagaagaguuccaacgcggacuaucuauuacuaaaaaccaaucaagaacuguaaguagaacgcaaaggaaaggauacgacagaaaacagcuuaagaaaucagaucuuaagaaaauacuaaauaaauauaauaucuuuccuucagaagaacuacuaagauuaccaauguuagaucuauggaaacuaagaucagacagcgcaaacccagacgaaaacauaucugcugaacaguuaggaaggauacucuauaugcuaaaucaaaaacgaggauacaagagcgcgaggucugaagcaaaugcagauaagaaagauucagacuauguucaagcuguuaaaggcagauaugaccaauuaaaagaucgcaaacagacaauaggacaauauuuuuacgaugaacuuuauaaugcaaacgcaaacaacaguuauuuucggauuaaagaagaaguauacccaagagaagcauacauugaagaguucgacacaauaauaagugcucaacgagaaaaacaugauuuccucacagaugaaguaguccaucaacuaaggaaugaaauaaucuacuuccagagaaaguuaaagagccagaaggggcuagucucaauuugcgaauuugaaggcuuugagaaaacaguauuugauaaagagaaaaacaaaaauaaaguaguauucgugggcccuaaaguagcuccuaaaacaucaccacuuuuucaacugugcagaauaugggaaguuguaaauacaaucacacuaaaaaucaaaaacccagaaggaagcaaauacaaauggggagagaaaauacccgacauaaaagaaaaagaaauccucgcugacuauuuauuuaaaaacgaaaguuuaucauucucaaaacuucuagaaauauuggaacugaagaaagaaaaugucuacgugaauaaacaaaucuuaaaaggcauaaaagguaaugaaacauacagcgcacuacacucgauacuaggcgacaaugaauuacuaaacuucgacguauccaucaugacaucaaaucagacggcuuuacucguagacagaaaaacuggagaaauacuagaagaaagagcgggacuggaacuugaugcaucacuagaaaaagaaccacuguaccaacuauggcauacaauuuauuccuuaaaagaucuugacgaaugcaaaaacgcacucauaaaaagauuugauuuugacgaugaaacagccgaaaaacuuagccgaauagacuucaacaaacaagccuuuggaaacaaaagcaacaaaucaaugcgaaaaauccucccauuccuaauggaaggauacgauuauucccaaucaucgagccucgccggguauaaucauagcaauucauuaaccaaaaaugaaagggaacagcagaucacucuagaccgacucgaauuacuacccaaaaacuccuuacgacaacccauaguugagaaaaucuuaaaucaaaugauuaauguugugaacgccauccuagacgaauauggaaaaccuucagaaauacguguagaauuggcaagagaacuaaaacagucuaaagacgaaaggaacgaaacagaccuacaaaacagcaaaaauaagaaauuaaaugacgaaauagguaaacgacuugaagaauuaggccuuccaguaacaaaaagguacauacaaaaauauaaauucaucuuuccuucucuaaguaaaaaucucaaagaagcaaaagucaauaaccaaugcauauauugcggagaaacauucaauuuaacagaagcacuaagcggagaugcuuaugauguugaccacauaguaccaaaagcauuacuuuucgacgauagucaaacuaacaaaguacuuguacacagaaaauguaacucaacaaaaacgaaccagacagcuuacgauuauauugccacgaaaggagacgaacaucuaaaacuauauagcgaaagauuagacgauugguucgaaagaggaauaauaaguuacaguaaaaugcaacgacuaaaaguaucccacaaagaauauuuagaaagaaagaaacucggcaaagaaacagaaaccgacaagaaacuaugggaaaauuucauagauagacagcucagagauacacaauacauuucuagaaaauccagagaaauauuacagaaaauaugcaacgacguaaaaacaaccgaaggaggaguuacagccaagcuaagaaaccuuuggggaugggacgauguccuuaugaauuuacaaaugccaaaauacaaagaauuaggacaaaccauaacuaaagaauggacgucagagcauggcaaaagaaaacaucaaaaagaagaaauagacaauuggacuaaaagagaugaucacagacaccaugcaauagaugcccuaguaauagcauguacuaaacaagguuucauacaacgaaucaacacacuaaacucuucagacaccaaagaccuaaugaucaaagaagucgaagaggcaaaaauugaguucaacgagaaaacaacauuguuggaaaaauaccuaaaaacccaaaaaccauuuagcacucaagaaguaaugaaagaagcugauaaaauccuaguaucauucaaagccggcaagaaagucgcuacaaucacaaaauuuaaagcgaccggcaaaaauaaagagacaggugucauaguaccaagaggugcauuacaugagcaaagcguuuacggaaaaauaaaaguuaucgaaaaagacaaaccacuaaaauaccuacucgaaaacagcgacaaaauaguaaauccaagaaucaaaaauuuaauagaaauaaaacuaagcgaaaacaaaaacgaccccaagaaagcauuacuagcacucaagaaaaucccaaucuucuuagaugaagaacaaaguaucacauuagaaaaagcaagcugcuauaacgacgcaacuguacuaaaguauaaauugcaaaaccuaaaagccgcucaaguagacgauauagucgacgaaaaagucaagaaaauagugagggaaagauuaucccaauuuggcaauaaagaaaaagaagcauucaaagacacucucugguucaaugaagagaagaaaauaccaauuauaacagugagacucuucgcuagaccggacgcaaacaauuuacaaacgaucaagaaagaugaaaauggaaacggaauaggauucgucguuacagguaacaaccaucauauagcuauauaugaagauaaagauaauaaaccaguacaacacucaugcacauuuuggcacgcuguagaacgaaagaaauacaauauuccagcugugauuagagauucaucagaaguauggaacgaucuacuaagaaaagagcuacccgaaucauucuuaaauaaacucccagccgacaaccuaaacuuaaaauuuaguaugcaacaaaaugaaauguucauacuagggcuaucccaagaugaguucguaaaagcaauagcaaacaaugauaaaucccuccuuucaaaacacuuauaccuagucuggucuaucucagaaaauaacuacugguuucgccaucaccucgaaaccaaaaacagcgaucuaaagaaaacugacggcgugaaggaauccaaacgacuauauaauauacggucauuagguagccucuuuucacuaaauccaauaaaagugcggcucaacuaucucggagagauaaccaaaauaggcgaauga

SEQ ID NO: 5230 - RNA, 3801 nt, Artificial Sequence
  Cas9 variant
auggcaaaauacauacuagguuuagauuuagguacaaacucaauuggcugggccuuaauagaaguagaugagaacaauauaccaauacgcauaaucgugaugggcucaagaauaauaccccugagcucaaacgauagagaagaauuccaaagaggccucucaaucacuaaaaaccagaacagaaccauuuccagaacgcaacgaaaagguuacgacagaaaacaacucaaaaggaacgaccuaaauaaaguauuaaacaaauacaacauauuuccaucaaaaauguuacugaaucuuccaauguuagaccuauggaaacuccgaagugacagugcgaauucuaacaaagauaucagugcagaacaacucggaagaauacucuacaugcucaaccaaaaaagaggauacaaaagugucagaagcgaagcaaauucagacaaaaaggauacugacuacguacaagccguaaaaggaagauacgcacaauuaaaagaccgaaaccaaacaauaggacaauacuucuacgaagagcuuuacaacgcaaacguaaacaacaguuacuuuaagaucaaagaagagguuuacccaagagaagccuauauagaagaauuugauacaauaaucaauucgcaaaaaacuaaacacgaguuucuaacagaucaauucguacaccaacuacgaaacgaaaucauauacuuccagcgaaaacugaaaucacaaaagggacuaauaucaauuugugaauuugaagguuuugaaaagacaguauucgacaaagaaaaaaauaaacauaaaaucguuuuuguaggcccgaaaguagccccaagauccgcuccucucuuucaacuaugcagggucugggaagucauaaauacaauaagcauaaaaguaaaaaauccggaagguucuaaauauaaauggggagaacgcauaccaagcauaaaggagaaagaaauucuagcugacuacuuauucaaaaaugaaguauuaucauuuaccaaacuuuuagaaauauuaggauuaaauaagaacgacgucuacguuaacaaacaaauauuaaaaggaaucaagggaaacgagacuuaugcaacucuauacaauauucuaggcgagaaugaauuccucaauuucgacgugagcauaauacccucaaaccacacuucaauguuaguagauaaaaaaacaggagaaauccuagaggaacgagcaggacuagaauuagacguaucacuugaaaaacaaccauucuaucaauuauggcauacaaucuacucacuaaaggaucuagacgaaugcaagaacgcguuaauuaaacgauucgacuucgacgacgaaaccgcagaaaaucuuaguagaauagacuucaauaaacaagccuucgguaauaaaaguaacaaaaguaugcgaaaaauauuaccuuuucuaauggaaggauacgauuacucacaaaguuguucauuagcaggauacaaccacagcaacagucuaacaaaagaugagcgagaacaacaagucacgcuggacagacuagaacuacugccaaaaaauagccuaagacaaccaauaguagaaaaaauacuaaaucaaaugauaaauuuaguaaacgccauuuuagaucaauauggcgaacucucagaaauaagaguugaacuagcaagggaacuuaaacagaguaaagacgaaagaaacgaugccgaucuacaaaauaccaaaaacaaaaaacuaaacgacgaaauagguaaacgauuagcagaauuaggauuaccaauaacaaaacgauauauucaaaaauacaaauucauauuuccaucccucucgaaaaaucucaaagaugcccauguuaacaaucaaugcaucuacugcggagaaacauuuaaccuuagcgaagcucugucaggagacgcguacgaugucgaccauauuguaccgaaggcccuacuauuugaugauagucagacaaacaaaguguuaguacaccgaaaaugcaauucaacaaaaacuaaccaaacagcauaugacuacaucucaacaaagggcgacgaacaaguucgaauuuauuucgaaaggguugacgauugguuuaaaucaggaauaauaaguuauuccaaaaugcaaagacuaaaagucagucacaaagaauacuuagaaagaaaaaaaauaggcaaagaaaccgaaacagauaaaaaacucugggaaaauuucauagacaggcaacuucgcgacacacaauacauaucaagaaaaucccgagaaauacuacaaaaaguauguaauaacgucacaacgaccgaaggugggguaacagcaaaacuucgaaaccucuggggcugggacgacguucugaugaaccuucagaugcccaaguacagagaauuagggcaaacuguaauaaaagaauggaccagugagcauggaaaacgaaaacaucaaaaagaagaaguagaaaacuggacaaaaagagacgaccaccgacaccaugccauagaugcuuuagucauagcaugcacaaagcaaggauuuauacaaagaauaaacacacuaaacuccuccgacaccaaagauuuaaugcuuaaagaagucgaggaagcaaaagucaaauuuuccgaaaagacaacacucuuggaaaaauacuuaagaacacaagaacccuuuagcacacaggagguaaugagggaagcagacaaagugcuagucucauucaaggcaggaaaaaaaguugccacaauaacaaaauucaaagcuauaggaaaaaauaaggauucaggaguaauuguccccagaggcgcccugcaugaacaaucaguuuauggaaaaauuaaagucauagaaaaagacaagccgcuuaaauaccucuuugaaaauagcgacaggauaguggaccccaaaguaaagaaauuaguugaaguaagacuaucagagaacgaaaauaacucaaaaacugcaauaucaacccuuaaaaaagccccaaucuuucuaaaugaagaaaaaacagaaguacucgaaaaagcaucaugcuacaaugacgcuacuguacuaaaauauaaacuacaaaguauaaaagcaucucaagccgaugacauaguagaugaacgaguaaaauuccuaguaaaagagcgacucgcacaauuugguaacaaagagaaagaagcauuuaaagacauccuaugguuuaaugaagaaaagcaaaucccuauaauaucgguccgccuuuuugcaagaccagaugcuaacaaccuacagguuaucaaaaaagacgaaaauggaaagucaauugguuucguauuaacaggaaacaaccaucacauagccauauacgaagauaaagacaacaaacuuauacaacacucauguacauucuggcacgcaguagaaagaaaaaaauacaauauuccaguaguaaucaaaaacucgucggauguauggucacaacuacuagacaaacaacuaccagaaagcuuacuaaacaaacuaccaacagacaaacuuaauuuaaaauuuucuaugcaacaaaacgaaauguucauccuaggccugucacaaaaagaauucgacgaagcaaucaaaaauaaccacaaaucuuuucuauccaaauacuuauaccugguauggagcaucaguaauaaugauuacuauuuucggcaccauuuagaaaccaaaaauacagagcuaaaaaauauaucuacugcaaaagaaucuaaaagauacuucagauucaagucaguaggcgcauuaguuggaacaaacccuauuaaaauaagacuaaaccaccuuggagaaaucaacaaaguaggugaauauuga

SEQ ID NO: 5231 - RNA, 3807 nt, Artificial Sequence
  Cas9 variant
augacaaaaaauaucuuagggcuagacuuaggaacaaauagcauaggaugggcccuuaucgagguagaugaaaacaauacaccaauuagaaucauagcaauggguagccggauaauaccacuaagcaccuccgacaaggaagaguuucaaaggggcuuaucgauaacaaaaaaccaaagcagaacaguaagcagaacacaacguaaagguuacgacagaaaacaacuaaaaaaaucagaccugaaaaaaauccuaaauaaguauaauaucuuucccagugaagaguugcugaagcugccaaugcuagauuuauggaaauuacgauccgacagugcaaaccccaaugaaaacaucagcgcugagcaacuaggcagaauacuguacaugcucaaucagaaaaggggcuauaaaucagccagaagugaagcaaacgcagauaaaaaagauaccgacuacguacaagcaguaaaaggaagauacgcacaacuuaaggaaagaaaucagacaauuggacaauauuucuacgaagaauuauauaacgcaaacacaaacaacucauauuuuaggauaaaagaggaagucuacccaagagaggcauauacagaagaguuugacaccauuauaaaugcucaaaaaaauaaacaugauuuuuuaacagaugaagugguacaccagcugagaaaugaaaucauauauuuucaaagaaaacuuaaaucacaaaaaggacucguaagcaucugcgaauuugaaggcuucgaaaaaacuguuuuugauaaagaaaaaaauaaagauaaaguaguauucguaggaccaaaaguagcaccuaaaacuucaccauuauuccagcuaugcagaauaugggaaguaguuaauacuauaucacuaaaaauaaagaauccggaaggaucaaaguacaaauggggggaaaagauaccaaaccuaaaagaaaaacaaaucuuagcagauuacuuauucaaaaaugauagccuuuccuuuacaaaacuacuagaaauccuagaucucaacaaaaacgacgucuaugugaacaaacaaauccuaaaaggcaucaaaggaaacgaaacauucucaacauuacauacaguacuaggagacaacgaauuacugaacuuugacguaucaauaauuccaagcaaccauacaucgaugcuaguugacaaaaaaacaggagaaauacuagaagaaagagcagguuuggaguuagacgcaucacuagaaaaagaacccuuauaccaacuauggcauacaauauacucauuaaaagaucuagacgaaugcaaaaaugcacucauaaagcgauuuggguuugaugacgagacagcggagaaacuaagccauauugacuuuaacaaacaagccuucggaaacaaaucaaauaaaucuaugagaaaaaucuuaccauuccuaauggaaggcuacgauuauucucaaucaugcucccuagcaggauacaaucacuccaauaguuuaaccaaggaugagagagaacaacaaauaacuuuagacagacuagaauuauuaucaaaaaacucccuaagacaacccauuguagagaaaauacuaaaucagaugauuaaugucguaaacgcaaucuuagaacaauacggaaaauuaagugaaauacgcguagaacuagcaagagagcuaaaacaaagcaaagacgaaagaaaugacgcagaccuacaaaauucgaaaaacaaaaaacuaaacgaagaaauaggaaaaagacuagcugaacugggauuacccgucacaaaaagauacauacaaaaauacaaauucauuuuccccucucucucuaaaaaccuaaaagaugcacacguaaacaaucaaugcauauacugcggagaaacguucaaucuaacggaagcacucuccggagacgcuuucgacguugaucauauuguaccuaaagcauuacucuucgaugauagccaaacaaacaaaguacuaguacauagaaaaugcaauagcacaaagaccaaccaaacagcauacgauuacauugggacgaaaggcgaagaacaaguuagaguguacucugaacguauagacgacugguuuaaacgaggaauaauauccuacaguaagaugcaaagacuaaaaguaucucacaaagaguaucuagaaaggaaaaagcuaggaaaagaaacggaaacagauaaaaaauuaugggaaaauuucauugacagacaauuacgagacacacaauauauaagccggaaagcaagggagauccuacaaaaaguauguaacaacgucacuacaaccgaaggugggguaacggccaaauugagaaacuuauggggcugggacgacgucuuaaugaaucuacaaaugcccaaauacaaagaacuaggacaaacugucauaaaagaguggaccagugaacacggaaaaagaaaacaccaaaaagaagaaauugaaaauuggacaaaaagagacgaucacagacaucaugcaauagacgcacuaguaguagcuugcacaaagcaagguuucauacaaagaauaaacacgcuuaauagcucagauacaaaagacuuaaugcaacgggaaauaaaggaagcaaaaaaacuacuaggagaaaacuacaaugaaaaagaauucgaaaacgacaacgaauucgucaaaaaucacaaagaacgacuaucccaacuagacgacuaccuaagacuacaaaagccugucaaauuugauacgaaauauguagaacaagaagccgacaaaguccuuguuucauucaaagcaggaaaaaaaguagcaacaaucacuaaauucaaagcaacagggaaaaauaaagacacuggcguaauaguuccaagaggagcauuacaugaagcaggacuuuaugguauaagaacaauauacucaaaggggggcauagcugaaaaacauauaauaaaaaaauauaaagucggaguaagcgcacaggaccauauauucacaggaaaggagacauacucagucaaaaaagacaaaaauggcaaugaaaaagucgaugauaaaauaaaaauaguguuagauucaauaguagacaauaaaguaaaagaagucguacuaaacagauuaaaucgaggcuucaauaacgaagaagacuaucguaucgacgugaaaaaggcauuaaauaacuucaaaaacuuagacgaagacccauugugguauaaugaaucaaaaggaaucaaaauacuauccauaaaacuaaaaacaggccuaaaggacucaguaguaccacuacgauuaaacgaaaagaaugaaguaauaacccuagucaaaacagguaacaaccaccauauagcaaucuaugaagacaacgauggaaaacuaauacaauauaguugcacguuuuggcaugcgguagaacgaaaaaaauauaauauccccaccguaauaaagaacagcucagaaguuuggaaucaaguacuagacaaaaaacuuccagaaagcuuccuaaaucgguuaccagcagauaaacuaaaccuuaaauucagcaugcaacaaaacgaaauguucauccuuggacuacuagaagaagaauuugauaaggcaauaaaagacaaugauaaaagccuacuuagcaaauaccuguacuuaguauggucaauugcagaaggagauuacugguuucgacaucaucuggagaccaaaaauacagaauuaaaaaaaacaaauggagcgaaggaaucaaaacgauacuuucgacuaucaacaaaaggacuaauagauuuaaacccaguuaaaguaagauuaaaucauuuaggcgagaucacaaagaucggagaauacuga

SEQ ID NO: 5232 - RNA, 3810 nt, Artificial Sequence
  Cas9 variant
augaacaacuccauaaaaucaaaaccggaaguuacaauaggucucgaccuaggagugggaagugucggaugggccauaguagauaaugaaacaaacauaauucaucacuuaggaucacgauuauuuucacaagccaaaacagcagaagaccgacggucauucagaggagcaagaagacucauacguagacgcaaauacaaacuuaaacgauucauaaaccucauauggaaauacaauuccuacuucggauucaaaaauaaagaagacauccuuaacaacuaccaagaacaacaaaaacugcauaacacggucuugaacuuaaaacuagaagcauuaaaugcuaaaauagacccaaaagcauuaagcuggauccuccaugacuaccugaaaaaccgaggucacuuuuacgaagauaaccgagacuuuaacguguacccaacagaagaacuagcaaacuacuucggggaauacggauacuacaaaggcauaauagauagcaaagaagauaacgacgauaaacucgaagaaggacuaaccaaauauaaauucucuaaccaacauugguuagaagaaaucaagaaaguauuaucaaaccaaacaggucuaccagaaaaauucaaagaagaauacgaaucacucuucucguacguccgaaauuacucagaaggaccaggauccauaaauucagucucaccauauggaauauaucaucuagacgaaaaagaaggaaaaguaguccaaaaauacaauaauauaugggacaaaacaauagguaaauguaguaucuuuccggacgaauaccgcgcgcccaaaaacucuccgauagccaugauauucaacgaaauaaacgaauuaucaacaaucagauccuacaguauauaccugacaggaugguucauuaaucaagaauuuaaaaaggcuuaccuaaacaaacuacuugacuuacucauaaaaacaaauucagaaaaaccaauagaugcaaggcaauucaagaaauuaagagaagaaacgauagccgaaucaauaggaaaagaaacuuuaaaagacguagaaagagaagaaaaacuagaaaaagaagaccauaaauggaaacuaaaaggacuaaaacuaaauacaaacggaaaaauccaauacaacgaucucuccucauuagcaaaauucguccauaaacuaaaacaacaccuaaaacuagacuucuuacucgaagaucaauauaccacauuagacaaaaucaauuuccuacaaucucucuuuguguaucuuggaaaacacuuaagauacagcaaccgcguagauagugccaauuugaaagaguucucagauucaaacaaacucuuugaacguguucuacaagaacaaaaagaugaccuguuuaaacuauuugaacaaacagacaaagacgaugagaaaauauuggcacaaacacacucacuuucuacaaaagcuauguuacuagcaaucacaagaaugaccaauuuggacaaugacgaagacaaucagaaaaauaaugauaaaggcuggaacuucgaggccaucaaaaacuuugaucaaaaauucauugauaucacaaagaaaaauaacaaccugagucuuaaacaagacaaacgauauuuagaugauagauucauaaacgaugcuauucuaaguccaggaguaaaacgaauccuuagagaagccacuaaaguauucaaugcuauucuaaaacaauucagcgaagaauaugacgugacaaaaguaguaauagaauuggcccgagaacuuagcgaagaaaaagaguuagaaaauacuaaaaauuacgaaaaauuaauaaagaaaaauucagacaaaauaucagagcgccucgaagcccuagacauagcagaagacaaaaucgaagauauccuuaaauccccaacaaaauccuacaaaguccucuuguggcuacaacaagaucauauugauccauacucacaaaaagaaauagcauucgaagacauacucacgaaaacagagaaaaccgaaauugaucacauaauaccauacuccaucucauuugacgauaguucaucaaacaaacuccuaguacuagcagagagcaaucaagcaaaaaguaaccaaacuccauacgaguucauaacaagcggaaacgcagguauaaaaugggaagauuaugaagcauacugcaggaaauucaaagacggagacacgucuuuacuagauuccacacaaagaaguaagaaauucgcaaaaaugaugaaaacagacacauccuccaaauacgauauaggcuuccuagcacgcaaccuaaaugauacccgauaugccacaauaguauuuagagaugcauugaaggauuacgccaauaaccacuuaguagaagacaaaccuauguuuaaaguagucuguaucaacggaggaguuacuagcuuccuaagaaagaacuucgacaaaagcugguacgccaagaaagaucgagacaaaaacauacaccacgccgucgaugcaagcauaaucagcauauucucaaacgaaacuaaaacacuauucaaucaacucacccaauuugcugacuauaaauuauucaaaaauacugacggaucauggaagaaaauagacccuaaaacgggagucguaacugaaguaacagacgaaaacuggaaacaaauccgcguaagaaaccaaguuagugaaauagccaaaguaauaaacaaaugcauacaagauagcaauaucgaacguaaagcgagauauagcagaaaaauagagaauaaaaccaacauaucacuauuuaaugacacaguguauucugcaaagaaaguaggcuaugaagaccaaaucaaaaggaaaaauuuaaaaaccuuagacauacacgaaucagcugaagaaaacaaaaauuccaaaguaaagaaacaauucgucuauagaaaauuaguaaauguaucacuacucaacaaugacaaacuagccgaccuauucgcagaaaaagaagacauacuuauguaucgagcaaaccccuggguaauaaauuuagcagaacaaaucuuuaaugaauauaccgaaaauaagaaaaucaaaucacaaaacguauuugaaaaauacaugcuugacuuaacuaaagaguucccagaaaaauucagugaagcguucguuaaaucaaugcuccgaaacaaaaccgcaaucaucuauaaugucgaaaagaaaguaguacacaggauaaaaagacucaaaauuuugucaagugaauugaaagaaaauaaacugaguaacguaauaauaagaaguaaaaacgaaaguggcacaaaauuauccuaccaagacacaauaaacucaaucgcucuaaugauaaugcgaagcauagauccaacagccaagaaacaauacauacgcguacccuuaaacacuuuaaacuugcacuuaggagaccaagauuucgaucuacauaauauagaugcauaccugaagaaaccuaaauucguaaaauaucucaaagcgaacgaaaucggagacgaauacaaacccuggagaguauuaacaagugggaccuuacuuauucacaaaaaggacaagaaacuaauguacauauccaguuuccaaaaucuaaaagaugucauugaaaucaagaaucuaauagaaacggaauacaaagagaacgacgauucagaccccaagaagaagaagaaagccaauagauuccugaugacgcuaucaacgauccuuaacgauuacauauugcuugaugcaaaagauaacuuugauauucuaggcuuaagcaaaaaucgcauagacgaaauauuaaauucaaaacuuggauuagacaaaauaacuaaauga

SEQ ID NO: 5233 - RNA, 3810 nt, Artificial Sequence
  Cas9 variant
augaacaauagcauaaagucgaaacccgaaguuacaaucggauuagacuuagguguaggaucaguaggaugggcaauaguagauaaugaaacaaauaucauucaccaucucggaucgaggcuauuuucgcaagcaaaaaccgcagaagacagacgcaguuuucgaggugucagaagauuaauucgacgccgcaaauacaaauuaaaaagauucgucaauuuaauauggaaauacaauucauauuuuggauucaaaaauaaagaagauauacucaacaacuaccaagaacagcaaaaacuacacaauacuguauuaaauuuaaaaagugaagcauuaaacgcuaaaauugauccaaaagcucuauccuggauacuacaugauuaucugaaaaaccgcggacacuucuacgaagacaauagagacuuuaacguuuaucccacgaaagaacuagcaaaauauuucgauaaauauggguacuauaaaggaauaauugacucaaaagaagauaaugacaauaaacuagaagaagaacuaacaaaguauaaguuuaguaauaaacacugguuagaagaagucaaaaagguccuaucaaaucagacagggcuaccagaaaaauucaaagaagaguaugaaucauuauucucauacguacgaaacuacagugaaggcccaggaucaauaaacucaguaagcccuuacggaaucuaucaucucgacgaaaaagaagguaaaguaguacaaaaauacaacaacaucugggacaaaacuaucggaaaaugcaauauauucccagacgaguacagagcaccaaaaaauucaccaauagcaaugauuuucaaugagauaaacgaauuaaguacaauaagauccuauaguaucuaccuaacaggaugguucaucaaucaagaguuuaaaaaagcauaccuaaauaaacuacuagaccuucucauuaaaacgaauggcgaaaaacccauagacgcacgccaauucaaaaaacuacgugaagaaacaaucgccgaaucaauuggcaaagaaacuuuaaaagacguagaaaacgaagagaaacuugaaaaagaagaucacaaauggaaacucaaaggacuuaaacucaacacaaaugguaaaauacaauacaacgaccuaagcagccucgccaaguuugugcauaaacugaaacagcaucugaaauuagacuuccuauuagaagaccaauacgcaacacuagacaaaauaaauuuccuccagagccuguucguauaccuaggcaaacauuuaagauacaauaacagaguugacagugcuaaccuaaaagaauuuucagauaguaaccgccuauucgaacgcgucuuacaagaacaaaaagauggacuauucaaacuuuuugaacaaacagauaaagaugaugaaaaaauacuagcucaaacacauucacugucaacaaaggcaauguuacuagcgauaacacgaaugacaaaccuagacaacgacgaagacaaucaaaaaaacaaugacaagggcuggaacuuugaagcaauaaaaaacuucgaucaaaaauucauagauauaacuaaaaccaacaacaaucuaucacucaaacaagauaaaagguaucuagaugacagauucauuaaugacgccauacucucaccagguguaaaacggauccucagagaagccacaaaaguuuuuaacgcaauacuaaaacaauucucacaagaguacgaugucaccaaagucguuauugagcucgcacgagaauugucagaagaaaaggaacuagaaaauaacaaaaacuauaagaaacucaucaaaaaaaacuccgacaaaauaagugaagggcucaaagcgcucgacauugcagaagauaaaauagaagacauauuaaaaagcccaacgaaaucguauaaaguacuauuauggcuccaacaagaccacauagauccauacagccaaaaagagauagcauucgaagacauucuuaccaaaacagaaaaaacagagauagaccacauaauucccuacucaauuagcuuugacgacucaaguuccaauaaacuacuaguucuagccgaauccaaucaagcaaagucuaaccaaacaccauaugaauuuauuacauccggaaacgcaggaauaaaaugggaagauuacgaagccuauugcagaaaguucaaagacggagacacaucccuuuuagacuccacacaaagaagcaaaaaauucgcuaaaaugaugaaaacagauacuuccucuaaguaugauauuggauuccucgcaaggaacuuaaaugauacuagauacgcuacgauaguauucagagaugcacuaaaagacuaugcuaauaaccaccuaguagaagauaaaccaauguucaagguaguauguaucaacggugguguaacaagcuucuugagaaaaaauuuugacaaaucaugguaugcaaaaaaagaucgagacaaaaacauccaucacgcagucgacgcaucaaucauaaguauauucaguaacaaaacaaaaacucuauucgaucaacuaacacaauucgcugacuacaaacuauuuaaaaauacagauggaucauggaaaaaaauugacccgaaaaccggaguaguaaccgagguaaccgacgaaaacuggaaacagaucagagucaggaaucaagucaguaaaauugcagaagagauugauaaaugcauucaagacagcaacaucgagagaaaggcuagauacuccagaaaaauagaaaacaaaacaaacauaaguuuauucaacgacacuguguacuccgccaaaaaaguuggauacgacgaucaaauaaaaaggaagaacuuaaaaacauuagauauagacgaaucaguugaagaaaauaagaauaguaaaguaaaaaaacaauuuguauaccguaagcuaguaaacguaagcuuacuaaauaacgauaaacucgcagaccucuucgcagaaaaagaagacauacuuauguauagagcaaauccauggguaauaaaucuagcagaacaaauauucaacgaauacacagaaaauagaaaaauaaaaucgcagaacguauucggaaaauauauguuggaccucaccaaagaauuuccggaaaaauuuagugaagcguuuguaaaaucgaugcuacgaaacaaaacagccauaauauacaacguagaaaaaaaagucguucacagaaucaaacgucuaaaaauucuaucaucagaacuuaaagaaaacaaacuauccaauguaaucauaagaagcaaaaacgaaagcggcacaaaacuaucguaccaagauacaaucaacagcguugcccuaaugaucaugcgaaguauagauccaaccgcuaaaaagcaauacauacgaguacccuuaaacacacucaaucuucaccucggcgaccaugacuuugaccuacacaauaucgaugcauaccuaaaaaagccaaaguucgucaaguaccuaaaagccaaugaaauaggcgacgaauacaaacccuggagaguccucauaaguggcucacuauuaauacacaaaagagacaagaaacucauguauauaucaucguuccaaaaccuaaacgaucuaauagaaauaaaaaaucucauagagaccgaauacaaagaaaauguagacucugauccaaaaaaaaaaaagaaagcaagccaaauccuuagaaguuuaucuacaauauuaaacgacuauauacucuuagacgcaaaagacaacuuugacauuuuaggucuuucuaagaauagaauugacgaaauacuaaacagcaaacuagaucucgacaaaaucgcaaaauga

SEQ ID NO: 5234 - RNA, 3822 nt, Artificial Sequence
  Cas9 variant
augaagaaaauccucgguuuggaucuaggaacuaauuccauaggaugggcacuuauagaaguagaugaaaacaauuuucccauacgcauaauagcaauggggucgcgaauuauacccuuaagcaguaaugacaaagacgaauuucaaagaggacuaucaauaacuaaaaaccaaaguagaacaguaucacggacacaaaggaaaggauaugacaggaaacaacuaaagaaaagugaugacuuuaaauacagucucagacgaauacugaauaaauacaacaucuuuccgucagaagaacuacuaaaacuuccaaugcucgauuuauggaaacuuagguccgaugcgguaaacccgaaugaaaacauaucugcagaacaauuaggucgaauacuauacauguuaaaucagaaaagaggguauaaaagugcuagaucagaggccaaugcagauaagaaagacacagacuacguacuagcaguuaaagguagauaugcucaauuaaaagacagaaaucaaaccauaggacaauacuuuuacgaagaauuacauaacgccaaaaccacuaauucauacuucaggacaaaagaagaaguuuauccaagagaagccuacauagaagaguucgacacaauaaucaaugcacaaaaaucaaaacacgacuuucugacugaugaaguaguacaccaauuaagaaacgaaaucauauacuuccaaagaaaacugaaaucacaaaaaggacuuguaucaauuugcgaauuugaaggauucgagaaaacaaucuucgacaaagaaaaagacaaaaacaaaguaguauuugugggacccaaaguggcaccgaaaacaagccccuuguuucaacuaugcagaauaugggaagucguaaacacaaucacucuaaaaaucaaaaaccccgaaggcuccaaauacaaauggggagagaaaauaccaaauauaaaagaaaaagaagcacuagcggacuauuuauucaagaaugaaacacuaucauuuaacaaacuucucgauauacuugaauuaaagaaagaaaacguauacguuaacaaacaaauaauaaaaggcauaaaaggaaaugaaacauacagugcacuccauagaauacugggagacaacgaauuauuaaaauucgauguaagcauuauaccgagcaaccauacaucuauguuaguugacaaaaagaccggugaaauacuagaagaacgagcagggcuagaacuagacgucucuuuagaaaaagaaccccuauaccaauuauggcacacuaucuauuccauaaaagaucuggaugaaugcaaaaaugcgcucauuaaaagauucggauucgacgacgaaauagcagaaaaacuaucacaccuagauuucaacaaacaagccuucggaaauaaaucaaacaagucaaugcgaaaaauacugccuuuucuuauggaaggauauaauuacagccaaucaugcacacuggcaggauauaaccauucaaacucacuaacuaaagaugaaagagaacaacaaguaaccuuagacaaacuugaacuacuaccaaagaacagccuaagacagcccaucguagagaaaauacuaaaccaaaugauaaauguggugaacgcaauacuagaagaauacggcaaacccucagaaauaagaaucgaacuugcccgagaauuaaaacaguccaaagacgaacgacacgacgcagaccuucaaaacaguaaaaauaagaaauugaacgaagaaauaggcaaaaggcugacagaacucggacugccagucaccaaaagauacauacaaaaauacaaauuuauauucccaagccucaguaaaucucuuaaagaugcucaagucaauaaccaauguauauacuguggugaaaccuuuaaccuaacugaagcguuauccggagaugcauaugauguugaccauauagucccgaaaagccucuuauucgacgacagucagacgaacaaaguacuggugcacaggaaaugcaauucuacgaagacaaaucaaacggccuacgacuacauagcaucaaaaggugaagaagaaguacaaauauacucagccagagucgacgauugguucaaaagaggaauaauaaguuauucgaaaaugcaaagauuaaaaguaagucacaaagaauaccucgaaagaaaauccuuaaacaaagagacugaaacagacaagaaauuaugggaaaacuucauagaccgucaauuaagagauacgcaguacaucagucguaaaaguaaagaaauauugcaaaaaguuuguaacaacguaaccaccaccgaaggaggaguaacggcuaaacuaagagacuuaugggguugggaugacauauuaaugaauuuacaaaugccaaaauauaaagaacuaagacaaaccguuauaaaagaauggaccagugaacacggcaaacgaaaacaccaaaaagaagagauugaaaauuggacaaaaagggaugaucauaggcaucaugccauagacgcgcuuguaauugcauguacuaaacaaggcuucauacagagaaucaauacacuuaacaguagcgagaccaaagaccuaaugcaacaagaaauuaacgaagcaaagaaacuacuaggagaaaauuauaaagacaaagaauuugaaaacucaaacgaauuagucaaaaaucacaaaggaaggcucucaaagcuagacgacuaucuaagacuacaaaaaccaauaaaauuuaacaccaaauacgucgaaaaagaagcagacaaaauucuaauaucauucaaagcaggaaagaaaguugccaccauaaccaaauucaaagcaacugggaaaaauaaagacacaggagucauaguuccccgaggagcucuacacgaagcaggacucuacggaguaagaacaauauauagcaaaggcggaauagcagaaaaacauauuauuaaaaaguacaaagugggagucagugcacaagaucacauauucacuggaaaagaaaguuacagcguaaagaaagauaaaaacggaaacgaaaaaguugacgauaaaauaaaaguaguccuagacaguauaguagacaguaaagucaaagaaaucgucuuaaacagacuaaauuucggcuuuucagacggagaagacuacaaaaacaacguaaagaaagcacucaacaauuucaaaaaccuagacgaauauccucuaugguacaacgaaaacaaaggaauaaaaauucuauccaucaaacuaaagacaggauuaaaagauuccguaguaccauuaagauuaaacgaaaguaaugaaguaauaacauuaguaaaaacagguaacaaccaccacauagcaauuuacgaagauaaaaacuccaaaccuguccaacacucaugcacauucuggcaugcaguagaaagaaagaaauacaacauacccgcuguaaucaagaaaucaagcgauguauggaaccaacuccuagacaaagaacuaccugaaucuuuucuaaacaacuuaccagaagacaauuugaauuuaaaauucaguaugcaacaaaacgaaauguuuguacuaggguuaucacaagaagaguucaaagaagccauagaaaauaaugacaaaucauuauuauccaaauaccuguaucucguauggucuguuagcgaaaauaauuauugguuuagacaccauuuagaaaccaaaaauucugauuuaaagaaaacagaaggggcaaaagaaaguaaacgacuauacaacauuaggucaguuucaucauuguucagucuaaacccaguuaaaguuagguuaaaccaccugggagaaauaacaaaaauuggggaauauuga

SEQ ID NO: 5235 - RNA, 3825 nt, Artificial Sequence
  Cas9 variant
augacgaaacacauuuuaggcuuagaccuaggaacaaauucgaucggaugggccaucauacaaguagauaacaacaacaauguccccauacaaauuauagcaaugggcagccgaauuauaccuuuagacuccaacgacagagaccaauuccaaaaaggacaagcaauaucaaaaaauaaagacagaacaaccgcacggacacaaagaaaaggauaugacagaaaacaacuuaaaaaaucagacgacuucaaauacucacuuaaaaaaaucuuagagaaacucgacaucuuuccaacagaagaauuaaugaaacuuccaacccuagaccucuggaaacuccgaucagacgcugucucgaacauagaagauauaacacccaaacaauuaggaagaauccuuuacauguuaaaccaaaaaagaggauacaagagugcgcgcucagaggcaaaugcugauaaaaaggauaccgauuacgucgcagaaguaaaaggaagguauacacaacuaaaagacaaaggccaaacgcuuggucaauacuucuacaaagaacucagcgacgcuaaccaaaacaauacguauuauagaguaaaagagaaaguauacccaagagaagcauauaucgaggaauucgacgcuauuaucaacguacaaaaaaguaaacacagcuuccuaacagaugaaguaauccacucauuacgaaacgagauaauuuacuaucaacggaaacucaaaucgcagaaaggucucguuuccauaugugaguucgaaggauuugaaacuacguacuuugacaaaaaaacacaacaagauaaaacaaucuucaccggccccaaaguugcuccaagaacaagcccacucuuccaguuuuguaaaauaugggaaguugucaacaauauaaguuuaaaaacgaaaaauccagaagguucaaaauacaaauggagcgacagaauaccaaccauagaagaaaaacagacaauugccaacuacuuacaagaaaaugaaaaucugaguuucauugaacucuuaaaaauucugcagcucaaaaaagaacaaguuuacgccaauaagcaaauacugaaaggaauacaaggaaacacaaccuuuagcgccauacacaaaaucauaggaaacagugaacacuuaaaauuugauaucgaaacaauaccaucaaagcacuuugcaguccuuguugacaaaaaaaccggggaaauuuuagacgagagagacaguuuagagcucaauucagcacuggaacaggaaccauucuaucaacuuuggcauacaaucuacucuauaaaagaccuagacgaauguaaaaaagcccuaauaaaaagauuuaacuucgaagaagagauagcugagaaguuaaguaagauugauuucaauaagcaagcuuuuggcaauaaaucuaauaaagccaugagaaaaaugcuaccauauuuaaugcuaggcuauaaccaaucagaagcugaaagcuuugcagguuacaaccgucgacuaacuaaagaagaaaaauccaaaaacguaucggaugaaccacuacaacuucucgccaaaaacuccuuaagacaaccagugguugaaaagauucuaaaccagaugauaaacguagucaacgcgaucauugaaaaauauggcaaaccagaagaaauuagaguagaacuagcacgagaacuuaaacaauccaaagacgagcgcgaagaugcagauaaacaaaacgguuuuaacaaaaaacuaaaugaauuaguagcuacaaaacuaacggaauuagguuuaccaacaacuaaacauuacauccagaaauacaaauucauauuuccagcgaaagacaaaaauuggaaagaggcacaggucgccaaucaaugcauauacugcggcgauacauucaaccuuacagaagcacucucaggagacaacuucgauguagaccacaucguaccaaaagcacuucuauucgacgacagccaagcgaacaaagucuuaguucaccgaagcuguaacagcacaaagaccaacaacacagcauaugacuacauaacaaaaaaaggcagccaagccuugaacgauuauguagcuaggguggacgacugguuuaaacgggguauuauaaguuacgggaaaaugcaaagauuaaaaguaucauuugaagaauaccaagaacguaagaaaaucgggaaagaaacagaagcugauaaacggauaugggaaaacuucaucgacagacaacuaagagaaaccgcauauauagcuaaaaaagcgaaagaaauacuggaaaaaguaugucauaacguuacaucuacagaggguaacgucacagcaaaauugagacaacuauggggaugggacaacguucuaaugaaccuccaauuaccaaaauauaaggaauuagagaaaaaaacaaaacaaacauuuacgcagcuaaaagaauggacuucagaccacgggaacaggaaacaccaaaaagaagaaaucauaaauuggacaaaaagagaugaucacagacaccacgcuauagacgccuuaguaauagcuugcacgcaacaggguuuuauacaaagaauaaacacccuuaguuccucagacgucaaagaugaaaugaaaaaagaacuagaagaagacaaaacaguuuauaaugaacgucugacucuccuugaaaauuacuuacuagaaaaaaaaccauuuucuacagaagagaucgaaaaagaggcagacaaaauacucgugaguuuuaaagcaggaaaaaaaguagcaaccuuaucaaaauauaaagcaacagguauaaacgaaaucaaaggaguacuaguuccaagaggaccacuucacgaacaaagcguuuacggaaaaauaaaaguaauugaaaaggacaaaccuuuaaaauaccuauuugaaaacagugauaagauaguaaacccauuaauaaaacaccuaguaaaaacacgauugcuggaaaaugaaaauaaugcccaagcagcauuaguaacauuaaaaaauaaaccaauacuauuaaauaacaaacaaacagaaauccucgaaaaagccaguugcuacaaugaagcgacuguacucaaauauaaacuccagagccuaaaagcuagucaaauagaugauauaguggacgaaaagauaaaauuuuuaauaaaagaaagacuaagcaaauucggaaauaaggaaaaagaagcauuuaaagauauacucugguucaaugaaaaaaaacaaauaccuauuacaucaauaagacuauuugcacggccugacgccaauaaucuccaagucauaaaaaaacacgaaaaagguaaaaacauagguuucgucuuaagcgguaacaaucaucauauugccauauacgaagauaaaaauaacaaauuaauacaacauaucugugacuuuuggcacgcagucgaaagaaaaagaaacaacauaccaguuuuaauagaagacacaaguacaauauggaaucaccuaauaaacgaagauuuuagugaaaguuuucuaaacaaauuaccuaacgacucacuaaaacuuaaauucucuuuacaacaaaacgaaauguucauauuaggacuaccuaaagaacaauccgaagaggcuauuaaaucaaauaacaaaagccuccuaucaaagcaccuauauuuagucuggaguauuaccgauggugacuauuucuuuagacaucaucuugaaacaaagaacacagaauuaaaaaaaauagauggcucaaaagaaucgaaacgauaucuuagacuaucgacaaaauccuuagucgaccuaaauccaauaaaaguacggcuaaaccauuuaggagaaauaacaaaaauuggagaauga

SEQ ID NO: 5236 - RNA, 3846 nt, Artificial Sequence
  Cas9 variant
auggaagaugacagccagcaugauauuagagaaauauacuuagcaauacaucauaugguaaaauauagaggaaauuuucuaguugaaggaacacuagaaaguaguaaugcguuuaaagaagaugaauuacuuaaacuccuagggaggauaacacguuacgaaaugagcgaaggagaacaaaacagugacauagaacaagaugacgaaaauaaacugguugcuccugcaaaugggcaacucgcagacgcccuaugugcaacaagaggcaguaggagcaugagaguagacaaugcauuagaggcuuuaucggcgguaaaugaucuaucacgagaacaaagagcgauaguaaaagcuauuuucgcuggucuggaagggaauaaauuagaccuagcaaaaauauuuguaaguaaagaauuuucgagcgaaaauaagaaaauacuaggaauauauuuuaacaaaagcgauuaugaggaaaaauguguacaaauaguagacucuggacuguuagaugaugaagaaagagaguuccuagauagaaugcaaggacaauacaacgccaucgcauuaaaacagcuauuaggaagaagcaccucggucagugacaguaaaugugcuaguuaugaugcacauagggcaaacuggaauuuaauaaaacuucaauuaaggacaaaagaaaacgaaaaagauauuaaugaaaauuauggaauauuaguaggauggaaaauugauaguggccaacggaaaucaguaaggggugagagugcuuacgaaaauaugagaaagaaagcgaauguauuuuucaagaaaaugauugaaacgagcgaccucucagaaacugauaaaaacagguuaauacacgauauagaagaagacaaacuauucccuauccagagggacagcgauaacgggguuauaccccaccagcuacaucaaaaugagcucaaacaaauaauuaagaaacaaggaaaauauuauccuuuccuauuagaugcauucgaaaaagaugggaaacaaaucaacaaaauagaaggacuccuugcauuccgaguaccguauuuugucggaccgcuagucguuccagaagacuuacaaaaaucagauaauucagaaaaucauuggaugguuagaaagaagaaaggagaaauuaccccguggaauuuugaugaaauggucgauaaagaugcuuccggucgcaaauuuauugaaagauuagugggaacggauucguauuuacucggagaaccgacgcuaccuaaaaacagucuacuguaccaagaauaugagguauuaaaugaacuaaauaaugucagacuaaguguaaggacuggcaaucauuggaacgauaaaagaagaaugagguugggaagggaagagaaaacgcuauuaugucaaagguuauuuaugaaaggacagacaguuacaaaaagaacagcagaaaacuugcuaagaaaagaguauggccguacuuacgaacuaucaggguuaucugaugagucaaaauuuacgucuagucugucgacauauggaaaaaugugcagaauauuuggggagaaauauguuaacgaacacagggaucuaauggagaaaauaguagaauugcaaacaguuuucgaagacaaagaaacguuacuccaccaacuucgacaacuagaagguauaagugaagcagacugcgcacuauugguaaauacucauuauacagguugggguagacugagcagaaaauuauuaacuacuaaagcuggugaaugcaaaauuagugaugauuuugccccacgaaaacauucaauaauagaaaucaugagagcugaagauagaaauuuaauggagaucauaacugauaaacaauuggguuuuucugacuggauagaacaagaaaauuuaggugcugaaaauggaaguucacugauggaagugguagaugaccuaagaguaucuccaaaagugaaacgaggaauaauacaaaguauaagacuaauugaugauauaagcaaagcaguaggaaaaagaccuucacguaucuucuuagaauuagcugacgauauacagcccucaggcaggaccauaucaaggaaaagcagauuacaagaccuauaucggaaugcaaacuuaggaaaagaauuuaaagggauagcugacgaguuaaacgcauguagugauaaagaucuacaagaugacagacuauuccuauauuacacucaauuaggaaaagauauguauacuggagaggagcuagauuuagauagacucucaagcgcuuaugauauagaccacauaauaccacaagcuguuacccaaaacgauaguauagauaaucgcguuuuaguggcgcgggcagaaaaugcaaggaaaacugauucauuuacguauaugccucaaauagcagauagaaugcgcaauuucuggcaaauauuauuagauaacggauuaauuagcagaguaaaguucgaaagguuaacacgucaaaaugaauuuucagagagagaaaaagaaagguuuguacaacgaucauuaguagaaacacgacaaaucaugaaaaauguagcaacacuaaugcgacagagguaugguaauagcgcagcgguuauaggauugaacgcugaacuuacaaaagaaaugcaucgauacuuagguuucucacacaaaaauagggauauaaaugacuaucaucaugcacaagaugcgcuuugcguaggaaucgcaggacaauuugcggcuaauagaggauucuuugcagauggcgaaguaucagauggugcgcaaaauucguauaaucaauaucucagagauuauuuacgagguuauagagaaaaacugagugcggaggauaggaaacaagggagagccuuuggauuuaucgugggauccaugagaagucaagacgagcagaaaagaguaaacccaagaaccggagaagucguauggagcgaggaagacaaggauuauuuaagaaaagugaugaauuaccgaaaaaugcuagucacucagaagguuggugaugacuuuggugcacuauaugaugaaacacgguacgcagcaacggaucccaaagguauaaaaggaauaccguuugacggugcaaaacaagauacaaguuuauauggaggauucagcagugcgaaaccggcauacgcuguuuuaauagagaguaaaggaaaaacuaggcuaguaaacguaacaaugcaagaauauagucuacuaggagacagaccgagugaugacgaauuaagaaaagugcuagcuaaaaagaaaagcgaauaugccaaagcaaacauucuauuaagacacguaccaaaaaugcaacugauuagauauggagggggauuaaugguaauaaaaagcgccggggagcuaaauaacgcacaacaacuaugguugccauaugaggaguacugcuacuuugaugauuuaagccagggcaagggcucucuggaaaaggacgacuugaagaaauuauuagauaguauauugggaucgguucaaugccucuaucccuggcauagauuuacggaagaagaacuagcagacuugcacguugcauuugauaaauuaccggaagaugaaaagaaaaaugucauaacaggaauaguaagugcauugcaugccgaugcaaaaacagcaaaucuaaguauaguaggcaugacaggaaguuggaggcggaugaacaacaaaaguggauauacauucagugaugaagaugaauuuauauuccaaucaccgagcggauuauuugaaaaacgagugacaguaggagaacuuaaacgaaaagcaaagaaagaagucaauuccaaauacagaacaaacgaaaaacgauuaccuacauuaagcggugcaucgcaaccauga

SEQ ID NO: 5237 - RNA, 3861 nt, Artificial Sequence
  Cas9 variant
augaccaaaaauauuuuagguuuagacuuaggaacaaauagcauaggcugggcauuaauugaaguugaugaaaauaauacaccaauacgaaucaucgcaaugggaagccgaauaauaccacuaaguacuagcgacaaagaagaauuucaaagaggacuaucuauaaccaaaaaccaaucucgcacagucucucggacacaacgaaaaggauaugacagaaaacaacuuaaaaagagcgacuuaaagaaaauauugaacaaauauaacaucuucccaucagaggaacuucuuaaacuaccaaugcuagaucuauggaaauugaggucagauucagcuaacccaaacgaaaauauaagcgccgaacaacuaggaagaauccuuuauaugcucaaccagaaaagaggcuacaaaucagcaagaucagaagcaaaugccgacaagaaagauacagacuauguccaagcaguaaaaggaagauaugcacaauuaaaagagagaaaccaaaccauaggacaauacuucuacgaagaauuauacaacgcaaacacaaauaauucuuacuuuagaauuaaagaagaaguauacccaagagaagccuacaccgaagaauuugauacgaucauuaaugcccagaaaaacaaacacgauuucuuaacagaugaagugguacaucaacucagaaaugaaauaauauacuuccaacgaaaacucaaaagucaaaaagguuuaguaucaauaugcgaguucgaagguuuugagaaaacaguauuugauaaagagaaaaauaaagacaagguuguauuugugggaucaaaaguugcaccaaagacaaguccacuauuucaacuaugcagaauaugggaagucgucaauaccauuucguuaaaaaucaaaaauccugaagggucaaaauacaaauggggagagaaaacgccaaaccuaaaggaaaaagaaauacuagcugauuauuuauucaaaaaugacucacuaucauucacgaaauuacucgaaauccucgaccugaacaaaaaugacguauauguaaauaagcaaauacuaaaaggcauaaaaggcaaugaaacuuuuagugcucugcauacaguauugggagauaaugaauuacuaaauuucgauguuucaauaauaccauccaaucacaccucaaugcucguagacaagaaaaccggagaaauuuuggaagaacgagccggauuagaauuagacgcaucgcuagaaaaagaaccacucuaucaauuauggcacacaauuuauagccuaaaaguucuagaugaaugcaaaaacgcacugauaaaaagauuuggcuucgaugacgaaacggccgaaaaacuaucucauauagacuucaauaaacaagcauucggaaacaagaguaauaaaucuaugaggaaaauacuaccauuucugauggaaggauaugauuauucgcaaaguugcucacuugcaggauauaaccacucaaauagccuaacaaaagacgaacgagaacaacaaauaacacuagaccgacuggaacuacuuuccaaaaacaguuugagacagccaauaguagaaaagauauugaaucaaaugauuaacguagugaacgcuauccuagaacaauauggcaaacuaucugaaauaaggguugaacucgcacgagaacuaaagcaaucaaaagaugaaaggaaugaugcagaucuacaaaauucuaaaaacaagaaacucaaugaagaaauuggaaaacgcuuagccgaacuagggcuaccaguaaccaaaagauauauacaaaaauacaaauuuauauucccgucauuaagcaaaaacuuaaaagaugcccacguuaauaaucaauguauuuacuguggcgaaaccuucaacuuaacugaagcacucucgggugaugcuuucgacguagaccacauagucccuaaagcacugcuauuugacgauucucaaacaaacaagguacuuguacaucgaaaguguaacucgacuaaaacuaaucagaccgcauacgacuauauagggacuaaaggagaagaacaaguucgaauauacagcgaaagaguagacgauugguuuaagagaggcauaauaaguuauucaaaaaugcagcgauuaaaaguuucacauaaagaauaucuagaaagaaagaaauuaggaaaagaaacagaaaccgacaagaaauuaugggaaaauuuuauagaucgacaauugcgagauacucaauacauaaguagaaaagcacgagaaauuuugcaaaaaguuugcaacaacguaacaaccacagaaggcgguaucacagcaaaacuaagaaacuuauggggaugggaugacguccuuaugaaucuacaaaugccaaaauacaaagaacuuggacaaacagucaucaaagaguggaccucagaacacgguaaaagaaaacaccaaaaagaagaaauagagaacuggacaaaacgagacgaucauagacaccaugcuaucgaugcccuaguagucgcuuguacaaaacaaggauucauacaaaggaucaauacuuuaaacuccucagauaccaaagaucuuaugcaaagagaaaucaaagaagcaaagaaacuucuaggugaaaacuacaacgagaaagaauuugaaaacgacaaugaauuuguuaaaaaccauaaagaaagacugucccaauuagaugacuacuuaagguuacaaaaacccguaaaauuugacacaaaauauguagaacaagaagcagauaaaguauuagugagcuucaaagcugguaagaaaguagcgacuauaacaaaauuuaaagcaacggguaaaaacaaagacaccggaguaauaguuuuacgaggagcucuacacgaacagucaguguacggaaaaauuaaaguaaucgaaaaagauaaaccguuaaaauaucuuuuugaaaauuccaagaaaauaguaaaccccaaaauaaaaguuuuaguggaggaacguuuagcagaaaaugaaaacaauuccaaauuaaguuuauccacccugaagaaaaacccaauauuccuuaacgaggagaaaaccgaaauacuggaaaaagccuccugcuacaacgaugccacaguccugaaauacaaacuccagucauugaaagcaucacaagcggaugauauaguagaugacagagugaaauuccuaguaaaagaaagauuggcacaauuuggaaacaaagaaaaagaagcauucaaagacacccuuugguuaaacgaagaaaaacaaauaccaauuauaacaguacgauuauuugcuagaccagacgcaaacaauuuacaagccauuaagaaagauaaaaauggcagagacauaggauuuguacuaaccgggaauaaccaccacauagcaauauacgaagacaaggacaauaaauuaguacagcauagcugcacauuuuggcaugcugucgaacgcaagaaaaacaacguaccagccguaaucaaaaacucuagugauguauggaaccagcuauuggacaaagaauuaccagaaucauuuuugaacaaacuaccaauagacaaacuuaaacucaaauucucgcuucaacaaaacgaaauguucguauugggauugcuacaagaagauuuugaagcagccauagaaaauaaugauaaaaccuuacucaguaaacauuuauaccuaguuuggagcauaaccgacggcgacuauuucuuuagacaccaccuagaaacuaaaaauacagaacuuaagaaaacugaaggagcaaaagaauccaaaagauacuuucgauuauccacaaaaggacuaaucgaccuaaauccaguaaaaguaagacuuaaccaccuaggagaaaucacaaaaauaggugaauauuga

SEQ ID NO: 5238 - RNA, 3864 nt, Artificial Sequence
  Cas9 variant
augaaaacaguccuaggauuggauuuagguacaaacucuauaggcugggcauuaauagaauuagacgaaaauaacauaccuauucgaauuguagcaaugggcucacgaauuauaccacuuucaacuucagacaaagaagaguuccaaagaggacuuaguauaaccaaaaaccaaucccgaacgguaagccgaacacaacgaaaaggcuacgacagaaaacaacuaaagaaauccuacuuaaagaaaauacuaaacaaauacaauauauucccguccgaugaauugcuaaaacucccgauguuagacuuauggaaacuuagaagcgauagcgcaaacccaaaugaaaacaucagugccgaacaacuaggcagaauccucuacauguuaaaccaaaaacgaggcuauaaaucggccagaagcgaagccaacgccgauaagaaagacacagacuauauccaagcagucaaagggcgauacgcccaauuaaaagauagaaaucaaaccauuggacaauacuuuuacggagaauuaaaugacgcuaacgaaaacaauucuuauuuccgaauaaaagaagaagucuauccuagggaagcauauacagaagaguucgacacgaucauaaacgcacagaaagacaaacaugacuuuuuaaccgaugaaguuauacaccaacugcgaaacgaaauaaucuacuuccaacggaaauuaaaaagccaaaaaggccuaguaucaaucugcgaauuugaaggauucgagaaaacuguauucgacaaagagaaaaacaaagacaaagucguuuuugucggaccaaaaguagcaccuaaaaccuccccauuauuucaguuauguagaaucugggaaguaguuaauaccauaacacuaaaaaucaaaaacccugaaggaagcaaauauaaauggggugagaaaauaccagacgucaaagaaaaagaaauuuuagcagacuaccucuucaaaaaugaaagucuaucuuuuacaaaauuacuagaaauccucaaacucaauaaaaauaacguuuacuuuaauaaacagauacuuaaaggaauaaaagguaacgaaacauauagcauauugcacuccauacuuggggauucugaacuacuaaauuucgacguuagcauaauaccaucaaaucauacaucuauguuaaucgacaagaaaacaggcgaaaucuuagaagaacgugcgggauuagaacuugauacaucucuugaaaaagaaccuuuaaaucaauuauggcacacaauuuacucaauaaaagaucucgacgaaugcaaaucagcgcuaauaaaacguuuuggauucgaugacgaaaccgcugacaaauugagucgcauagauuuuaauaaacaagcguuuggaaacaaaaguaauaaaucaaugagaaaaauauuaccauuucuaauggaaggcuaugauuacucacaaucuuguagccuagccgguuauaaccacuccaauagcuuuaccaaagaugaacgagaacaacaaauaacauuagauaaauuagaacuacuccccaaaaacucauuacgccaaccaaucguagagaaaauuuuaaaccagaugauaaaugucguaaacgcuauccucgaaagauacgguaaaccaagcgaaauaagaguagaacuagcuagagaacuaaaacaaucuaaagaugaacgcaacgacacugaucuucaaaauucuaaaaauaagaaacuaaacgaagaaauaggcaaaagacucgcggaacuuggacuaccacuaaccaaaagauauauacaaaaauacaaauuuauauuuccauccuuaagcaaaaaccuaaaagacgcacauguaaacaaccaaugcauauauugcggagaaacauuuaaccuaaccgaagcacuuucgggagaugcauuugauguugaucacauuguuccgaaagcauuacuauucgacgauucacaaacaaauaaaguucuaguccaucgaaaaugcaacagcacaaaaacaaaccaaacagccuacgacuauauugccacaaaaggagaugaacaagucagaguauacucugaacgcguggaugauugguuuaaaagaggaaucauaaguuacagcaaaaugcaacgucuaaaagucucccacaaagaauacuuagaacgaaagaaacuaggaaaagaaacugaaacagacaagaaacucugggaaaacuuuauagauagacaacuaagggauacccaauacauaagccgaaaaucacgagaaauuuuacaaaaagucugcaacaacguagcaacaaccgaaggcggaguaacagcaaaauuaagaaaucucuggggaugggacgacguacuaaugaaucuacaaaugccaaaguacaaagaacuaggacaaacaguaguuaaagaauggacaucagaacauggcaaacgaaaacaucaaaaagaagaaauagaaaacuggacaaaacgcgaugaucaucgccaucaugcgaucgacgcauuagucguugcauguacaaaacaaggauucauacaaagaauaaauacacuuaacucaucagaaacgaaagaccucaugcaacaagaaauuaaagaagccaagaaacuauuaggagaaaacuacaaugaaaaggaauuugaaaacaacaacgaaucuguuaaaaaccacaaagaacgccucucacagcucgacgacuacuuaaggcuacaaaaaccaguaaaauucgacacaaaauauguagaacaagaagcugauaaaguauuaguaucauucaaaucagguaagaaaguagcuacuauaacuaaauucaaagccacagguaaaaauaaagauacaggcguaaucguaccacgcggcgcccuacacgaacagaacguauacggcaaaauuaaagugauagaaaaagauaaaucacuuaaauaucucuuugaaaauucagagaaaauaguaaacccaaaaaucaaaaacauaguagaaauuauacuaucugaaaacgaaaacaacaguaaaauggcauuaagcacucucaagaaaaauccaauuuuucuaaacgaagaaaagacagacuuauuagaaaaagcguccugcuaugaauacguaacagugagaaaauauccacuaaauacgauuaaagcaagccaagcagacgauauagucgaugaaagaguaaaauuccuagucaaagaacgucuuacacaauuuggcaauaaagaaaaagaggcuuuuaaagacacauuaugguucaaugaagaaaaacaaauccccauaauuacaguccgacucuuugcuaggccugacgcaaauaaccugcaggcuauuaagaaagacgaaagcggaaaagaaauugguuucguaguaaugggaaauaaucaccauauagcaauuuaugaagauaaagacgggaagcuaguacaacauucaugcacauucuggcacgccguagaaaggaagaaauacaacauauccacggucaucaaaaacucaucagacgcauggaaccaauucuuggacaaugaacugccagagccauuuuuaaauaaauuaccagcagacaaucuaaaucuaaaauucagucuacaacaaaaugaaauguucauauuagggcuaucgcaagaggaauuugacaaagcauuaaaaucgaaugauaaaagccuguuauccaaacaccucuacuugguauggucuauuucugaaaacaauuauugguucagacaccauuuggaaaccaaaaacucggaccuaaagaaaacaaacggcguaaaagaaaguaaaagacuauauaauauacgaagucugggaaguuuauuuucucuaaacccuauaaagauaagacucaaucacuuaggagaaaucacuaaaauaggcgaguacucauga

SEQ ID NO: 5239 - RNA, 3867 nt, Artificial Sequence
  Cas9 variant
augcguuuauuugaagaaggacauacagcagaagacagacgacuaaaacgaacagcucgaagaagaauaucccgccgccguaacagauuaagauaccugcaggccuucuuugaagaagcuaugacagaccuagacgaaaauuucuucgcacgauuacaagaaucuuuccuaguacccgaagauaagaaauggcaccgucaucccauauuugcuaaacucgaagacgaaguugcauaccacgaaacuuauccaacaauauaccacuuaaggaagaaauuagcggauucaucggaacaagcagacuuaagacucauauaccucgcacucgcccauauaguuaaauacagaggacacuucuuaauagaaggcaaacugucuaccgaaaauacuucaguaaaagaucaauuccaacaauucaugguuauuuacaaccaaacguucguaaauggagaaaguagauuaguaucagcgcccuuaccugaaucuguguuaaucgaagaagaacuaacagaaaaagcauccagaacaaagaaaagcgaaaaaguacugcaacaauuuccacaagaaaaagccaauggcuuauucggccaauuuuuaaaacuaaugguagguaacaaagcagacuucaagaaaguauucggacuagaagaagaagcaaaaauaacguaugcauccgaaagcuaugaagaagauuuagaagggauccuagcgaaaguaggcgaugaauacagcgacguauuccuagcagcgaaaaacguauaugaugcaguugaauuaucaacaauucuagccgacagugacaagaaaucacaugccaaauuaucuagcaguaugauuguaagauucaccgaacaucaagaagaccucaagaaauucaaaagauucauaagagaaaauugcccagaugaauacgauaaccuauuuaaaaacgaacagaaagaugguuacgcaggauacauagcacacgcaggaaaaguuucccaacuaaaauuuuaucaauacgucaagaaaauuauucaggauauagcuggagccgaauacuuccuugagaaaauugcacaagaaaacuuccuacggaaacaaagaacuuuugacaauggcguaaucccucaccaaauccacuuagcagaacuacaagccauaauucauaggcaagcagcauauuacccuuucuuaaaagaaaaccaggagaaaauagaacaguuaguaacauuuagaauaccauacuauguagguccacuaucuaaaggagacgcauccacauucgcauggcuaaaaagacaaucagaggaaccaauuaggcccuggaacuuacaagaaacaguagaucuugaccaaucugcgacagcauuuaucgaaagaaugacuaacuuugauacauacuugccauccgaaaaagugcuaccgaaacauucuuuauuauaugaaaaauucaugguauucaacgaacucacaaaaauaucauauacagacgauagagguaucaaagcaaauuucucagggaaagaaaaagagaaaauuuucgauuaucucuuuaaaacccgcaggaaaguuaaaaagaaagacauaauacaguucuaccgaaacgaauauaauacagaaauaguuacgcuaucaggauuagaggaggaccaauucaacgccagcuuuucuaccuaucaagaucuuuuaaaaugcgggcugacaagggcagaacucgaucacccagacaaugcagaaaaauuagaagacaucauaaaaauacuaaccaucuucgaggaucggcaaagaauaagaacacaacuuagcacauucaaaggccaauuuucggcagaaguacugaagaaacuugagaggaaacacuauaccgguuggggacgguuaucuaagaaacuaauaaacgguauuuaugauaaagaaucaggcaaaaccauauuagauuacuuaguaaaagacgauggcguaucaaaacacuauaaucgcaauuuuaugcaauuaauuaaugauucacaacuauccuuuaaaaacgcaauacaaaaagcacaaagcuccgaacacgaagaaacgcuaucagagacaguaaaugaacucgcagggucaccagcaaucaagaaagggauuuaucaaucgcuaaaaauaguagaugaauuaguagcaauuaugggguacgccccaaaaagaauaguaguggaaauggcaagggaaaaucaaacaacaaguaccgguaaaagaagaagcauucaaagacucaaaauaguggaaaaagcuauggcagaaauuggcaguaaucuguuaaaagaacaaccaacuacuaaugaacaauuaagagauacaagauuauuccuauauuacaugcaaaacggcaaagacauguauacaggugacgaacucuccuuacauagauuaucacauuacgacauagaccauauaauuccccaguccuuuaugaaagacgauucucuagacaacuuaguauuaguuggcuccacagaaaacagagggaaaucagaugacgucccuaguaaagaaguaguaaaagacaugaaagcauacugggaaaaauuauaugcugccggacucauaucacaaagaaaauuccaacgccuaacuaaaggugaacagggaggacuaacucucgaagacaaagcgcacuucauacaaaggcaacuugucgaaacacgacaaaucaccaaaaacguagccgggauacuugaccaaagauauaaugcuaaaucuaaagagaagaaaguucaaauuaucacccuaaaagccucuuuaacuucacaauucagauccauuuucggccuauauaaaguucgagaaguaaaugauuaccaccaugggcaagacgcuuaccuaaauugcguaguugcuacaacauuacuaaaagucuacccuaaccuagcccccgaguucgucuauggugaauauccuaaauuccaaacauuuaaagaaaacaaagcaacagcaaaagcaauaauuuauacaaaccucuuacgcuuuuucacagaagacgaaccgagauucacuaaagacggagaaauccuaugguccaauucauaccucaaaacuaucaagaaagaacuuaauuaucaccaaaugaauauagucaagaaagucgaaguccagaaaggcgguuucagcaaagaaucaauaaaaccaaaaggucccaguaauaaacuaauaccagucaaaaacggucuagacccacaaaaauacggaggguucgacagcccuguaguagcauauacuguccuuuuuacacacgaaaaaggcaagaaaccacuaauaaaacaagaaauacuuggaaucaccauaauggagaaaacaagauuugaacaaaauccgauccuauuccuagaggaaaaagguuuccugagaccaagaguauuaaugaaacucccuaaauacacauuauacgaguucccagaagguagaagaagguuacuggcauccgcaaaagaggcucaaaaaggcaaucaaauggucuuaccagaacacuuacucacucuauuguaccacgccaaacaaugccuccuaccaaaucaguccgagucucuagcauacgucgaacaacaucaacccgaguuccaagaaauccucgaaagaguagucgauuucgcugaagugcacacacucgccaaaucaaaaguacaacaaauaguuaaacuauuugaagcuaaucaaacugccgacguuaaagaaaucgcagcaucuuucauacagcuaaugcaauucaaugcaaugggugccccaaguacuuuuaaauucuuucaaaaagacaucgaaagagccagguauacgucuauuaaagaaaucuuugaugcaacaauaauauaccagagccccacaggauuauacgaaacaagaagaaaaguagucgacuga

SEQ ID NO: 5240 - RNA, 3903 nt, Artificial Sequence
  Cas9 variant
auguggggaguuucacuauuugaagccgggaaaaccgccgcagaacguagggguuaucggagcacacgaagaagacuuaaucacaggaaauuccguuuacgacuuuuagaagacauguucgaaaaagaaauauuaucaaaagauccaaguuucuucauaagauugaaagaggcuuuccuuagcccaaaagacgaacaaaaacaauucaaaggaaacauauuauucaacgacaaagacuauaccgaugcagacuacuacgaacaauacaaaaccaucuaucacuuacguuacgauuuaauaucacaacaucgccaauucgauauacgcgaaguguaccuggcgauacaccaccucauaaaauacagaggccacuuuauauacgaggaccaaacauuuacuacugacgguaaccaacuucagcaucauauaaaagcaauaaucacaaugaucaauuccacauuaaaccgcaucaucauaccagagacuauagauauaaacguauucgagaaaauccuucuagaccgaaugaugaaccgcucgaguaaaguaaaauuucuaauagaacuaacuggagaagacaaacaagauaagcccuuacucaaagaacuguuuaaccucaucguuggacuaaaagccaagccagcaucuaucuucgaacaagaaaaccuugcaacaauagucgagaccaugaacaugucaacagagcaagugcaacuagaucuccucacucuagcagacguucuugccgacgaggaauaugacuuacuucuaacagcacagaaaauauauucagcaaucauccuugacgaaucaauggauggauaugaauauuuugcagaagcaaagaaagaaucauauagaaaacaccaagaagaacuuguauuaguaaagaaaaugcucaaaucaaacgcuauaacaaacgaugagagagcaaaauuugaauacuucuacacagacuauaucggagcaaaaucaagcaacuaugaggaaucuaaaaacaucaagaaaggccuuagugccgcauacgggaaauauagcaaagaagaaagguuauucaaacauauagaauuacuacuagcuaaagaaaacguccuuacaacuguagaacaugcacucuuagagaaaaauauaacauucgcuuccuuacuaccucuccaacguucgucuagaaacgccguaauaccauaccaaguccacgaaaaagaauuaguugcuaucuuagaaaaccaagcaacauacuauccauucuuacuagaacaaaaagacaauauacacaaacugcuuacguuuagaaucccauauuacgucggaccacuugcggaccaaaaagacagugaguucgccuggaugguacgaaaacaagcugguaaaaucacaccauuuaacuucgaagaaauggucgauauugacgcaagcucagaagcauuuauaaagcgaaugacuaauaaauguacauacuuaauucacgaagacguaauaccaaaacauuccuucucauacgcaaaauuugaaguccuaaaugaacuaaauaaaauacgacuugacggaaaaccaauagauaucccauuaaagaaaaggauuuuugaaggacuauuucucgagaaaacaaaaguaacacaaacaucacugaagaaauggcuagcagaacacgaacacaugacagucucaguuguucaaggcacacaaaaagaaacagaauuugcuacaucacuccaggcguuccaccgauuugugaaaaucuuugaucgcgaaacgguaucaaacccagcaaaugaagaaauguucgagaaaauaauauauuggucaacaguuuuugaagacaagaaaauaaugagaagaaaacuaucagaauauccacaauuaaccgaacagcaacaaguacaauuagcacaaguacgauuuagaggcuggggaagacuaucgcaaagauuaauuaacagaaucaaaacgccagucucuggagacgaagaccauaaauuaucgauaaacgaaaucuuauggcaaacaaacgaaaacuucaugcaaauaauacgaaacaaagacuaucuauucaagaaaauaauagaagaacaauucgaaaacgaaaccgcauugcucaauaaacaaagaauagacgaacuagcagcgucacccgccaacaagaaaggaauauggcaagcaauaaaaaucguuaaagaacuagaaaaaguccuacaacaacccgcggaaaacauuuucauagaguucgcuagaucagacgaagaaaguaaacgaaguaccccaagagacaaauucauagaaaaggcuuaugcucaacuaaagaaagaaacggauacauucaacuuagaacaccuaaaagaauuaaaacagcgaaguaaacaacuaaguagccaacgauuauuucuauacuuuauccaaaacggaaaauguauguauucaggcgaacaccuugauauagaacgacucgacucuuaugaagucgaccauauccucccucaauccuacauaaaagacaacuccauagaaaacuuggcacuggucaagaaaguugaaaaccaacgaaagaaagacucuuuacuacucaauaguucaauaauuaaccagaauuauuccagaugggaacaacuuaaaaaugcaggacuaauaggagagaagaaauuuagaaaccuaacaagaacaaaaaucacagacagagauaaagaaggauucauagccagacagcuaguagaaaccagacaaaucacaaaacacgucacacaacuacuacaacaagaauauaaagacacaacaaaaguauucgcgauuaaagcaacauuagucucaggccuucgaagaaaauucgaguucaucaaaaacagaaacguaaaugacuaucaucacgcccaagacgccuucuuaguugcauuccuugguacaaacaucacaucaaacuacccaaaaaucgaaauggaauaucuuuuuaaagguuaccaacauuaccuaaacgaaguaggcaaaagugccgcuaaaccaaaauuuacauucauaguugaaaaccucaguaaacaacaauacaacucaacgacaggagaaguuaaauggaacccugaagucgacauagcaaaauuaaaacgcauacucaacuucaaacaguguaacauaguacguaaaguagaagaacaaucuggagcacucuuuaaagaaacaauauauccagucgaagaaucuaguucuaaaaccauaccacugaagaaacaccucgacacagccauauaugguggcuacacugcaguaaauuaugcaucuuaugcacuaauacaauuuaagaaaggucgaaaauuaaaacgagaaaucaucggcaucccacuagcugugcaaacacgcauugauaacagcgaaacaucguuacaagcauauauugcagaacaaaucaaaucagaaguagaaauauuaaacggccgcauacuuaaauaucaauuaaucagcaauaauggaaaucgacuuuauauagcaggaccaucagagcgacacaaugccagacaauuaauaguaucagacgaagcagcaaaaguaauauggcuaaucucaacaaaacaggccgacgaagcaauguuccuaaaauauuauagauuagagcaccucgaagccguuuucgaagaacucauacgaaaacaagccgcggauuaucaaaucuuugaaaaacuaauaaagaaaaucgaaguaaacaaaguuuacuuuuauagcugcacauacaacgaaaaaguuaaaguaauagaagaacuacuaaaaauaacacaagccaacgcaacaaauggagaccucaaacugcucaaaaugucaaaucgcgaaggacgacucgggucaguuucaguagcccuggacuuuaaaauaaucaaccaaucaguaaccggauuauaucagucaaucgaagacuauaacaacuga

SEQ ID NO: 5241 - RNA, 3930 nt, Artificial Sequence
  Cas9 variant
augggaucugugggguucgcuggaauugauaaccaauauaacuuaguuagaaccaaaggaaagaauguaauaggagucagguuguuugacgaagccgauuccgcagcagaacgccgaggacauagaacaaauaggagaaggcuacaaagaagaagauggcgcuuacgcuuacucgaugacauauucgcaaaaccacuacaagcaguagacccaaauuucuuagcacgccuuaaauauucauauguaaauaaaaaagaccagggacaacaggaccauuacuauggcggauauguuuuuggaaguaccgccgcagaucaagcauaccaccaagccuacccgaccauauaccaccuaaggaaaagacucauggaagaugaucaaaaacaugauuugagagagguauacuuagcaauacaucacauaguaaaauacagagguaacuuuuugaauccacaaaguagccucgacauagaucaacaauuugacguaacagauuucgcacaagcacuugcgagauuugcagaccaucaagcacucagcugggcauuagaagcuccaauuagauuuuuagaagcugaacuagcaacuggacuaucgaacucugcccguguagaugccgcuaucgaggcauucagcuuugauacaaaaguugacagagccgccauaaaagaaauguuaaaaggcuuauccggaaaucaaauagacuucaccaaacuauucguaaauguugauucagccgacugggaucaagaagaaagaaaacaguggaaaaugaaacucucagaagaagacuucgacgaacaagcgcuaccaauauuagaaagauuaucucaagaugagacugaauuuuuucuugcaauuaaacgagcauaugacggaauugcccugaugcgauuucuaggugaugaacaaucucuuucuuccgcuaugauaaaagcuuacgaagaccauagacgagaccuaacuuucuuaaaaacacaagugcguacaccacaaaauagacaagcacucagugaaggauauacgaacuaucugucuguagaugacaaaaagcauaaaaggggagccaaagaacuugcacaauuaaucgaagcaagcgaugcaucugaacaagacaaagcaacaaugcuagaccggaucgcuaacgaucaauuugccccaaaacagagaacaaaagcuaacggcuuaauuccuuaccaacugcacuuagcagaacuaaaaaaaauauuagcgaaacaaggucaauauuauccauucuuauuagauaccuucgcaaaacaaggccagagcguuaacaaaauagaagaacucguacaauucagaguaccauauuacguagguccaaugguaccuaaaucugaaaccgcaggaaaugcagaaaaucacuggguugaaaaaaaugauggacaaacaaaaguaagcguuaccccauggaauuuugaccaaguuuuuaaccgcgauagggcagcaaaaucauucauagauagauuaacaggaaccgauacauauuuaauaggugaaccuacuuuaccgagacauucacuaacguaugaaaccuuuacaguauuaaaugagcuaaauaacauaagaaucgaugggaaaagauuaccagucgaaacgaaacaagcaauaguagaagaucuauuuaaaaaauaucggcuaguaacaaaaaaaagacuucaagacuacuucgcaucauuuggcaaaagagaaguagaacucaccggacuugcagacgaaucacgauucaccucuaguuuaaccucuuaucacgauuugcaaggcuuauuaggaacagacuucauaacaaacccacaaaaccauucacuacuggaaaaaauuguagaaauucagacugucuuugaagauuccgauauugcugaacgcgagcuuggcaaauuaggcuuagaacaaaaauuaauaccacgucuagcaaaaaaacacuacacugguuggggaaaucuuucaagaaaauuguuagacaccaguuucauacaugaucccgaaagaccagaagaaccgguaucaauaauggaucugcuauacacaacaaacaaaaacuucauggagauacuacaugauucagaauacggaguagaagaaugguugaaaucccaaaauaugaucgacgaucaaaaagauauacaaaugcgaauagaugaacuuacuacaucacccgccaauaagagaggaauaaaacaagcuuucaauguauuggaugauauaacucaagcaaugggggaagaaccagcuuacguauaccuagaauuugcaagagaaaaacaagcaucacgcagaacggugucacgaaagaagcgauuagaaacucuauauaagaaugccgcucuaaaaacagaguuuaaagcaauaaaagaagcguuagcugaagaaagcgaugaccgcaugcaagacgaucgauuauaucuuuacuaugcacaauuaggaagagauauguacaccggacaaucaauauccauugaucaacuuagcucucacuaugacauagaucacaucgucccacgugcguucauuaaagacgauaguuuagaaaauaaaguccuaguaaauagaaccgauaacgcaagaaaaaccgacagcgcaacauucacagcagacguuaaagccaaagcauucccuuuauggcaacaacuaaaaaaacuaggacucauaagugccaaaaaauuucgucuacuaacaagaacaggugauuucacggaaauggaaagggaaagguucauagccagacagcuuguugaaacaagacaaauaauaaaaaauguagcggcccuaauagaaggacauuucagucagacccaagcuguagcuauaagagcggaaguuacuggugaacuacgacagcucacacagauaaaaaaagaucgugacauuaacgauuaucaccaugcucaagaugcacuccuaguugcaacagcuggcacuuauuuacauagacacuuuccuaagcgugacgcucgcuuuauauauaacgaauucgacuauuauacacaacacuggcuaaaaaaccaaggagagaaucgaagacgucacccauacucauucgugguaggaacaaugucuaaagggaacgaagacuggacgccagauaacuuaaacuauuuacgaaaaguaaugcaauacaagacaauguugaugaccagaaagccgguagggccagaaggugcauuauauaaagaaacuuuaauugcugcugauccuaagaaaagacuuguaggagcuuccaaagaaagacaagauccaaccaucuacggcgguuacacaaaagaaucaucagcuuacaugucauuaguacgagcuggagguaaaaaucaauuggucaaaauaccuguuagaaucgcaaacgagauacacaguggacaacgaaaguuagaugauuacguccaagcaaaaguaaaaaaguuugagaggaucuuacuuccaaaaaucucgcuugggcaauuggucgaagaugaagggcagcgauuuuaucuagcuaccaacgaaaugaaacacaacgccaaacagcuaugguuagaccaaaaagucgucacaacauacaaacgacucacagcagaaucaccaguagaagauuuccucacgguauuugaugcacuaacaucaagugcuacuauacaucacuuuaaauucuaucaacgagauuuggaacuauuacgagacaauagagcaggauuccaagacuuagcaaaagcuacacagcuuaaaguguuaaaggacguccuauaugaauuacacgauaaugcuggauggcgagauccaauaaaacaauacuuuaaagaaauaggauuaaaaguucgaauguggacaaaacuacaaaaagaagggggaaucaaacuuacugaucaagcagaacuuauauaccaaucacccucaggacucuucgaaaaacgaagaagaguacaagauuuauuauga

SEQ ID NO: 5242 - RNA, 3939 nt, Artificial Sequence
  Cas9 variant
augcaaaauggauuucuuggaauuacaguaucaucagaacaaguaggcugggcugucacaaauccaaaauaugagcuagaacgagccaguagaaaagaucucuggggaguaagacuauuugauaaagcugaaaccgcagaagacagacggauguucaggacuaacagaagacuaaaucaacgaaaaaaaaauaggauacauuacuuacgagacauuuuccaugaagaaguuaaccagaaagacccaaauuucuuucaacaauuagacgaaucuaauuucugcgaagaugaucgaacgguagaauuuaauuucgacacaaaccucuacaaaaaccaguuuccaacuguauaccaucuacguaaauaucuaauggaaaccaaagacaaaccggauauacgccuaguuuaucucgccuucaguaaauucaugaagaauagaggacauuuccuauauaagggaaacuuaggagaagucauggacuucgaaaacucuaugaaaggauucugcgaaagucuagaaaaauucaacaucgauuuuccuacacugucagacgaacaagugaaagagguacgagacauuuuaugcgaucacaaaaucgccaaaacaguuaagaaaaaaaauaucaucacaauaacuaaagugaagaguaaaacagcgaaagcauggaucggccuauucuguggcuguucaguaccuguaaaagugcuauuucaagauauagaugaagaaauaguaaccgacccggaaaaaaucagcuucgaagacgcaucauaugaugauuacauagcgaauauugaaaaaggaguagguauauauuacgaagcaaucguaagugcaaagauguuauucgauugguccauaaugaacgaaauacuaggagaucaucaauuacuuucagaugcaaugauagcagaauacaacaaacaccacgacgaucugaaacgacuucagaaaauaauaaagggaacuggcagucgagaacuauaccaagacauauuuauuaacgauguaaguggaaacuacgucugcuacguagggcaugcaaaaacuaugaguucagcagaucaaaaacaauuuuacacauuucuaaagaaccgccuaaaaaacguuaacgggauaucaagcgaagaugcagaauggauagauacagaaauuaaaaacggcacauuacuaccaaaacagacaaaacgagauaacucaguaauaccacaccaauuacaacuucgugaauuugaacuaauacuagacaauaugcaggaaauguacccauuucuaaaagaaaauagagaaaaacucuuaaaaauuuuuaacuucguaauaccauauuacguaggaccgcuaaagggcguaguacgaaaaggagaaucuacuaauuggauggucccaaaaaaagacggaguaauccauccguggaauuuugaugaaaugguagacaaagaagccagugcagaaugcuucauaucgagaaugacagguaauuguaguuaucucuucaacgaaaagguacugcccaaaaacucauuacuauacgagacauuugaaguacuaaaugaacucaacccacugaagaucaauggagaaccaauaucaguagaacuaaaacagaggauauaugaacaauuauuucuaacuggaaaaaaagucaccaaaaaaucccucacaaaauauuugauuaaaaacgguuaugacgaagacaucgaauuaucagguauagauaaugaauuucacucaaauuuaaaaucucauauagauuucgaagacuacgacaaccuaucagacgaagagguagaacgaauaauucuuagaaucacaguauuugaggacaagcaauuauuaaaagacuaucucaacagagaauucguaaaacugagugaagacgaacgaaaacaaaucugcucgcuuucauauaaaggauggggaaacuuaucagaaaugcucuuaaauggaauaaccguuacugacaguaacggcguagaaguaucagucauggacauguuauggaauaccaaucuuaacuuaaugcaaaucuugucaaaaaaauauggauacaaagcggaaauagaacgauauaacaaggagcaugagaaaaacauauacaauagagaagacuuaauggauuaccuuaauauaccaccugcucaaagaagaaaaguuaaucaauuaauuacaauagucaaaucccuuaaaaaaagaugcgguguaccaaacaaaauauuuuucaaaguaucaagagaacaucaagacgaucccaaacggacuagcucacguaaagaacagcucaaguaucuauauaaaucacuuaaaucagaagacgaaaaacacuugaugaaagaacuagaugaacuuaauggucaugaacuuucaaaugauaaaguauaucuuuauuuucuccagaaaggcagguguaucuacagcggaaaaaaauuaaaccuaagccguuuacgaaaaucaaauuaccagaacgacauugauuacaucuauccauuaagugcaguaaaugaccgcagcaugaauaacaaagucuuaaccgguauccaagaaaaccgagccgacaaauacacauacuucccuguagacccagaaauacaaaaaaaaaugaaaggauucuggauggaauuaguccuucaaggcuuuaugaguaaagaaaaauacuuccgacuauccagagaaaacgauuucagugaaaaugaauuaguaaguuuuauugaaagagaaauaagugacaaucaacaaucuggacgaaugaucgcuagcgucuuacaauauuacuuuccggaaucuaaaauaguguucguuaaggagaaacuaauaucaucauuuaaaagagacuuucauuuaauaucaaguuauggacauaaccaccuacaagccgccaaggacgcauauauuacaauaguaguagggaauguauaccacaccaaguucacaauggaucccgccauauauuucaagaaucauaagcgaaaagauuacgaccuaaaucgauuauuuuuggaaaacaucucgagagacggacagauagccugggaaucuggaccauacgguucuauacaaacagucagaaaagaauacgcacaaaaccacauagccguuacaaaaaggguaguagaaguaaaaggcggccuguuuaaacagaugcccuuaaaaaaagggcacggagaauauccauuaaaaacuaacgacccaagauucggaaacauugcacaauacggcgguuauacaaacguaacgggaagcuacuucguguuagucgaaagcauggaaaaaggaaaaaaaagaaucagucuugaauauguaccaguuuaccuacacgaacgacucgaggaugacccgggacauaagcucuuaaaagaauaccuuguugaucauagaaaacuaaaucauccgaaaauauuacuggcuaaaguaagaaaaaacagcuuauuaaaaaucgacggcuucuauuaucgauuaaauggaagauccggaaaugcguuaauucucaccaacgccguagaauuaaucauggacgauuggcagacuaaaacugcaaacaaaauaaguggcuacaugaaaagacgugcgauagauaaaaaagcgagaguauaccaaaaugaauuccacauucaagaacuagaacaacuauaugauuucuacuuagacaaacuagaaaauggaguauauaaaaacagaaaaaauaaccaagcagaacucauacacaacgagaaagaacaguucauggaauuaaaaacagaagaucaaugcguuuugcuaacagaaauuaaaaaauuauuuguuugcucucccaugcaagcagaucugacacuaauaggaggaucaaaacacacaggaaugauagccaugagcucaaauguaacaaaagcagauuucucaauuauagcugaagacccuuuaggcuuaagaaauaaagugauauacucacacaugggugagaaauga

SEQ ID NO: 5243 - RNA, 3939 nt, Artificial Sequence
  Cas9 variant
augcagaacggcuuuuugggaauaacaguauccuccgaacaagugggaugggcaguaacgaacccuaaauaugaacucgaacgagcgucacguaaagaccuauggggaguaagacucuuugacaaagcagaaacagcagaagaccgacgaauguuuaggacaaauagacgauuaaaucagagaaaaaaaaacagaauacauuaccucagagauauauuucaugaagaagucaaucaaaaagacccaaauuucuuccaacaacuggaugaaucaaacuuuugcgaagacgaucgcacgguagaauucaacuucgacaccaauuuauauaaaaaucaguucccaacagucuaccaucuacgaaaauaucuaauggaaaccaaagauaaaccagacauaagacuaguauaucuggccuuuaguaaauuuaugaaaaaucgaggccacuuccuauacaaagguaaucuaggcgaaguaauggacuucgaaaauagcaugaaagguuuuugcgaaaguuuagaaaaauucaauaucgauuuuccaacacucucagacgagcaaguaaaagagguaagagauauacucugugaccacaaaauagcaaaaaccguaaaaaaaaaaaacauaauuacgauuaccaagguaaaaagcaaaacggcaaaagcuuggauaggacuauucuguggauguucaguacccguuaaaguacuauuccaggacauagaugaagaaaucguaaccgauccagagaaaaucagcuucgaagacgcaucauaugacgacuacauagcuaacauagaaaagggcguaggaauuuauuacgaagcaauugucagcgcaaagauguuauuugauuggaguauauuaaacgaaaucuuaggugaccaccaauuauuaucagaugcaaugauagccgaauauaauaaacaucaugacgacuuaaaacgacuacagaaaauaauuaaaggaacgggaucacgagaacuauaccaagacaucuucauaaacgacguguccgggaacuacgucuguuauguaggacaugcaaaaaccaugaguuccgcagaucaaaaacaauuuuauaccuuucuuaaaaacagacuaaaaaauguaaauggaauaucaagcgaagacgcagaguggauagacacagaaauuaagaacggcacuuuacuucccaaacaaacaaaaagagauaauagcguaauaccacaccagcuucaacuucgagaguuugagcuaauucuugauaauaugcaagagauguauccauuuuuaaaagaaaacagagaaaaauugcuaaagauauucaauuucguaauaccauauuauguaggaccacuuaaaggaguagugagaaagggcgaaucaacuaacuggaugguaccuaaaaaagacggaguaauccacccuuggaauuucgacgagaugguagacaaggaggcaagugcagaaugcuuuauaucuagaaugacaggaaacuguaguuacuuauucaacgaaaagguauuaccaaaaaauucacuauuauaugaaacauucgaaguucuuaacgaauuaaauccauuaaaaauaaacggagaaagcauaaguguugaguuaaaacaaagaauauacgaacaauuauuccuaacgggcaaaaaagugacgaagaaaucccugacaaaauauuuaauaaagaacggauacgauaaagacauagaacuaucuggcaucgacaaugaauuccauagcaaccuaaaaucgcacauagacuuugaagauuaugacaaucuaucagacgaagagguagaacaaauuauuuuaagaauaacagucuucgaggacaaacaauuacuaaaagauuacuuaaauagagaauuuguaaaacuuucagaagaugaaagaaaacaaaucugcucauuaaguuauaaaggaugggguaacuuaagcgaaaugcuauuaaauggaaucaccgucacugauucaaacgggguagaaguuucaguuauggauaugcuuuggaacacgaauuuaaaccucaugcaaauauuaaguaaaaaauacggauauaaggcggaaauagaacauuauaauaaggagcaugagaaaacaauauacaauagggaggaccuaauggacuaucucaauaucccaccagcacaaaggagaaagguuaaccaacuaauaacgauaguuaaaucccuaaaaaaaacauacggaguaccaaauaaaaucuuuuucaaagugucccgagaacaccaagacgauccuaaacguacgaguaguagaaaagaacaacuaaaauaccuauauaaaucacuuaaaagcgaagaugaaaaacacuuaaugaaagaacucgacgagcuaaauggucacgaauuaaguaacgauaaagucuaucuauacuuucuccaaaaagggcgauguauauacucgggcaaaaagcuaaaccuaagcagauuacgaaaaucaaacuaucaaaacgacauagacuacauauauccccuaagugcagucaacgaucguucaaugaauaacaaaguauuaacuggcauacaagaaaauagagcagauaaauacacauauuuuccaguugauccagaaauccagaaaaaaaugaaagguuucuggauggaacuaguguuacagggauuuaugucaaaagagaaauacuuuagacuaagucgagaaaaugauuuuucagaaaaugaauuagucucauucauagaacgcgagauuuccgacaaucaacaauccggacgcaugauagcaucuguacuccaauacuauuucccagaaagcaaaauaguauucguaaaagaaaaacucaucuccuccuucaaacgugauuuucaucuaauaagcucguauggacauaaccacuuacaagccgcaaaagaugcauacauaacuauagugguuggaaaugucuaucacgcuaaauucacaauggacccagcuauauauuuuaaaaaccacaaaaggaaggauuacgaccuaaacagacuauucuuagagaacaucagcagagacggccaaauagccugggaaaguggaccguaugguucaauccagacaguuaggaaagaguaugcacaaaaccacauagcaguuacuaaacgaguaguugaaguaaaaggggguuuguucaaacaaaugccauugaaaaaaggccacggagaauacccacuaaaaacuaacgauccuagauuuggaaauauugcccaguacggcgguuacacuaauguaacagggucguauuucguauugguagagucaauggaaaaaggaaaaaaaagaauaucauuagaauacguaccagucuaccuccaugaaagauuagaagaugacccagggcauaaacucuuaaaagaguauuuaguagaccacaggaaauuaaaucauccaaagauauuauuagcuaaaguacgaaaaaauucacuacuuaagauagacggguuuuacuaccgacuaaacgguagaagcggcaaugcuuuaauacuaacgaacgcaguggaauuaauaauggacgacuggcagacaaaaacagcgaacaaaauaucugguuacaugaaacgaagagcaauagacaaaaaggcacgaguuuaucaaaaugaauuucacauacaagaacuagaacaauuguaugacuucuaccuugacaaacucgaaaacggcgucuauaagaacagaaagaacaaucaagccgaacuaauucacaacgaaaaggaacaauucauggaguuaaagacagaagaccaauguguccuauuaacagaaauaaaaaaauuauucguaugcucaccaaugcaagcagacuuaacccuuauaggggguucaaaacauacaggaaugaucgcaaugagcucaaacgugacaaaagcagauuuugcaguaauagcagaagauccuuuaggcuuaaggaacaaaguaauauacucacauaugggagaaaaauga

SEQ ID NO: 5244 - RNA, 3942 nt, Artificial Sequence
  Cas9 variant
augcauuacuuggaugagaucuucgcgccccaucuacaagaaguagaugagaauuuccucaggcgacuaaaacaaagcaacauucauccagaagauccagccaaaaaucaagcauucauaggaaaacuauuauuucccgauuuacuaaagaaaaaugaacgaggcuauccaacacuaauaaaaaugagagaugaacugccugucgagcaaagggcucacuauccagucaccaacaucuacaaacuaagagaagcaaugaucaacgaagaccgacaauuugacuugcgggaagucuauuuagcaguacaucauauuaugaaauacagaggacauuuccuuaacaaugccucaguggauaaauucaaagugggaagaauagauuuuuauaaaucuuucaacguacuaaaugaagccuaugaagaacuucaaaauggcgaaggaucauuuacgaucgaaccaucaaaaguugagaaaauaggucaacuguuacuugauacaaaaaugagaaaauuaaaccgacaaaaagcuguagcaaaauugcuagaagucaaaguagcagacaaagaagaaacaaaaagaaacaaacaaauagcaacagcuaugucgaaacuuguauuaggauacaaagccgacuuugcaacuguggcaauggccaaugguaaugaauggaaaauagauuugucuucagaaacaucugaagacgaaauagaaaaauuuagggaagaauugucagacgcacaaaaugacauucuaacagaaauaacaucuuuauucucacaaauaaugcuaaaugaaauaguacccaacggcaugucuauaucugaaagcaugauggacagauacuggacucacgagcgucaauuggcagaagucaaggaauaccuagcaacccaacccgcaucugcgagaaaagaguuugaccagguguacaauaaauauaucggucaagcacccaaagagcguggcuucgaccucgaaaaaggacugaagaaaauacuuuccaagaaagaaaacuggaaagaaauagaugagcuucuaaaagcaggagauuuucuacccaaacaaagaacaucagcaaauggagucauuccgcaccaaaugcaccagcaagaauuagacaggauaauagagaaacaagcaaaauacuauccauggcuugccacugaaaaccccgcaacuggugaaagagacagacaccaagcaaaauaugaacucgaccaauuagucaguuuuagaaucccuuacuacguaggacccuuaguaacuccagaaguucaaaaagcuacaucgggagcaaaauucgcaugggccaaaagaaaagaagauggagaaauuacaccauggaauuuaugggauaaaaucgaucgagcugaaagcgcagaagccuucauuaaacgcaugacagucaaagacacuuacuuauuaaaugaagacguauuaccagcaaacagccugcuauaccaaaaauauaacguauuaaacgaacuaaacaacguuagaguaaacggaagaagacucucuguaggaauaaaacaagacauuuacaccgaacuauucaagaaaaagaaaacugucaaagucucggauguggcaucacuggugauggccaaaacacgaggaguaaacaaaccaucagucgaaggauuaagugacccuaaaaaguucaacuccaacuuagcaacauacuuagaucucaaaucuauuguuggggacaaagucgaugacaauagauaucaaacagaccuagaaaacaucauagaauggagaaguguauuugaagacggagaaauauuugcggacaaacuuacagaaguagaauggcuaacggaucaacaacgaucagcauuaguaaagaaaagauacaaaggauggggaaggcuaucaaagaaacuacuaacaggaauagucgaugaaaauggacagagaauuauagaucucauguggaacaccgaccaaaauuuuaugcaaauagucaaccagccaguauucaaagagcaaauagaccaauuaaaccaaaaagcaauaacaaaugacggaaugacucuucgagaauggguagaauccguacuagauggagccuacacaucaccacaaaauaagaaagccauuuggcaagucguacgaguaguagaggauauaguaaaagcaguagguaacgccccuaagagcauaucuauugaauuugcaagaaacgagggcaacaaaggugaaauaacaagaagccgcagaacacaguuacaaaaguuguuugaagaccaagcucaugaacucgucaaagacacgagcuugaccgaagaacuugaaaaggcaccagaucuuucagauagguauuaccuauauuucacucaaggcggaaaagacauguacacaggagauccaauuaauuucgaugaaaucucaacgaaauaugauauagaucacauacuaccucaaaguuuuguaaaagacgacucauuggauaaccgaguguuaguaaguagagccgaaaauaauaagaaaagcgauagggucccagcgaaacuuuaugcagcaaaaaugaaacccuacuggaaucaguugcuuaaacagggacuaauaacacaacguaaauuugaaaaucuuacaauggacguugaccaaaacauuaaauacagauccuuaggguuugucaagcgacagcuaguagagaccagacaaguaaucaaauuaacagcuaauauauuaggaagcauguaucaagaagcaggaacagauauaauagaaacgagagcgggacucaccaaacaacuacgugaagaguucgaccuaccaaaaguaagggaagucaacgauuaccaucacgccguugaugcauaucucacaacauuugcuggacaauauuuaaaccgaagauacccuaagcuaaggucauucuuuguauacggagaauauaugaaguucaaacauggaucagaccuuaaauuaagaaauuuuaacuuuuuccacgaacucauggaaggugauaagucucaaggaaaaguuguagaccaacaaacuggagaacuuauaacaacgcgagaugaaguagcuaaaucauucgaccgauuacuaaauaugaaauauauguuaguaucaaaagaaguacacgauaggucagaucaacuuuacggggcaacaauuguuaccgccaaagaaaguggcaaauuaacgaguccgauagaaaucaaaaagaaacguccaguggauuuauauggagcauauacuaaugggacuucugcuuuuaugacuauuaucaaauucacaggcaacaaaccaaaauauaaaguuauaggaguaccaacaaccucugccguaggacuaaaaaggguaggcaaaccagggucagaaucuuacaaccaagaacuacaccgaauaaucaaaucuaauccuaaaguaaagaaagauuuugaaauaguaguaccacacguaucauauucacaacuaauaguugaugaugauuguaaauucacauuagcgagcgacacauaccaacacccagccacucaauuaguuuugagcaaagaaagcauggagauaauagccgacgauuucaaauuuguaaaagaaaauacagcaacagcagacgaacaguuaguacgagucuucgacgaaauaguaaaccagaugaaucacuauuuuacuauauucgaucaaagaucaaauagacaaaaagucacaaaagcacgagauaaauucguuucucuaccaacagagucggaauacgaaggcgccaagaaaacacaaguuggcaaaacugaaguaauuacaaauuuacucaugggacuacaugcaaacucagcacaaggagauuuaaaaguuuuaggacuaucuaccuucggauucuuucaaucuucaggaggucuaaaccuaucagaagaugcaaugauaguauaucaaaguccaacaggacucuuugagagacgcaucuguuuaaaagacauauga

SEQ ID NO: 5245 - RNA, 3942 nt, Artificial Sequence
  Cas9 variant
auguccuucaaagaaaacucgaaaauauauuauggauuagacauagggacagauucuguaggcuggagcacaaccaacgaaaaauacgaauuacuaagguacaaaaauaaccucaugugggguguaucacucuucgaagcagcaagucuagcagaagaacgaagaggacauaggacacaacggagaagauacgauagacgccaacaaagaguagcccucuuaggagaacuuuucgcgaaagaaauccuaaaaacagacccagauuucuuucuccgacuaaaagaaucaagucuauacccagaagaucgaacuagcaaaaacguuaacacuuauuuugaugaugcugauuuuaaagauucagauuauuuuaagauguaccccacaguacaccaccucauuaaagagcuaagugaaaguaacaagccucacgacguaagauuaguauaccuagcuugcgccuucauaguagcucaccgcggacacuuccuuaacggagccgacgaaaauaauguacaagcagucuuagacuuugauagcaguuauugugaauuuacagacugguuuaaaagcaaugauauagaagauaaucccuucucugaaucagucaaaaaugaauuuucaguaauacucagaaagaaaauaggaaucacggcuaaggaaagagaaauuaaaaacuuacuuuucggaacaacaaaaaccccagacuguuauaaagaugaagaauauccuauagacauugacguauuaauaaaauucauauccggaggaaaaacaaacuuagcaaaauuauuuagaaauccaagcuacgaugaacuagauauccaaacagucgaaguaggcaaagcagacuuugcagauacaaucgaccuauuagcaagcucaauggaagauacugacguaccacuacuaagugcaguuaaagcaauguacgauuggucauuauuaauagauguacuaaaaggacagaaaacuauauccgacgcaaaaguaugugaauacgaacaacauaaaucggaucuuaaagcucuuaaauacauagucagaaaauacuuagaucgagcacaauaugaugaaaucuuuagaacugcgggugaaaaacccaacuauguauccuauucauauaaugugacagacguaaaacuaaaacaacucccaucaaauuuuaaaaagaaaaacucagaagaauuuugcaaauauauuaaaucaaaauuagagaaaauuaaaccggaaucagaugaugaagccguuuacaacgaacuaaucgaaaaauguaacucaaaaacacuauguccuaaacaagucacagacgaaaauagaguuauucccuaucaauuauacuaccaugaauuguccaugauacuagacaaagccucagccuaucuagauuuucuaaauaaaaccgaagacggcauaucaguuaaacagaaaauacugacauuaaugaaauuucguauuccuuacuucguugguccauuaguaaaaagaaacgagacggacaacguauggauuguaagaaaggccgaagguagaauuuauccauggaacuuugaaaacaugguagacuuugauaaaucugaagacggcuucaucagaagaaugaccuguaagugcaccuaucucgccggagaagacguacuacccaaauauucacuacucuauuccaaauauaccgucuuaaaugaaaucaauaauauuaaagucaacggcgagaaaaucuccccagaacuaaaacaagauauauuuaacgaacuuuuuaugaaaacgucaagaguaacaguuaagaaaauaacugaacuccucaaaagaaaaggagccuuuucagaagaaaaaggagauucauuaaguggaguggauaucaauauaaaaucaucacucaaaucauaccuugacuuucgacgcuuacuggaaaauggaucucucucagaaaaugacguggaacgaaucauagaaaggauuacaguaaccaccgauaaaccacgucuaguuaguugguuaaaagcagaauauagcgacuuaccagcugaagacauaagauauauaagcagacuauccuacaaagacuacggaagacuaucagcgaaacuuuuaacaggauguuaugaguuagauacaaacacaggggaaauagguggcagaagcauaaucgauuuuaugugggcagaaaacauaaacuuaaugcaaauucuaagcgauucauaugguuacaaaucuuucauagaagaggaaaauaaaaaguauuacaugauaaaucccacaggaucaauagcacaaacauuacgagaaauguauguaucaccaagcguauccagagcaauaauacgaacaauggaaaucguaaaagaacugagaaaaauaacaaagaaagauccagacaaaauauuuguugaaauggccagagggggaaaacccgaagagaaagggaaacgaacaucuucuagacgugagcaaauagaaaaacucuaugauucagcaaaagcguuuguaagcgacgaagauauaucucauaugagaucacaauuaggaucacucagcgaugaacaacuaagacgagagaaauauuaccuauacuuuauccaguucggaaaaugcauguauucgggagaagcaauagauuucagucgauuaggcgacaaccacugcuacgacauagaccauauauuuccccaaucaaaaauaaacgacgacucgcuucauaauaaaguauugguuaaaucucaauuaaacggagagaaaagugaugauuacccaauuaaagcugaaaucagaaauaagaugcaccccuuauggaagaaucuauucuacagagacccaaagaaucccgcagacaaaguaaaguacgaaagacuaacgagaucaacaccauuuacugaggacgaacuagcuggcuuuauagaaaggcaauuaguggagacccggcaaucaaccaaggcuguugcuacucuccuaaaagagauguucccugacagcaagaucguuuacguaaaggcaggucaaguuuccgaauuuaggcaugauuucgauaugcuaaaaugcagagaaaucaacgacuuacaucacgcaaaagacgcuuaccuaaacauuguaauaggaaauguacaugacgugaaauucacaagcaacccuaugaauuucguuaaaaacgcagauaaacacuacacaauuaagguaaaagaaacuuugaaacauaaggucucaagaaacggcgaaacagcauggaacccagaaaccgacuucgauacagugaaaaggaugaugaguaaaaauucagucagauacguacgcuauuguuacaaaagaaaaggaggauuuuucaaucaaaacccagaucgagcuggaaaucccgaccucgcaagacugaagaaagaucuagauccaguuaaauauggaggauacaauucaaaaucaaucucauguuuuucgcuaauaaaauguacagggguaggagcaguaaucauccccguagaauuacuaugcgagaaaagauauuucagcgaugauucuuucgccagugaauacgccuauucaguacuuaaaaacgcgcucccggcaaagaacauagcaaaaauuaguauugaugauauuaguuucccguuaaagagaaggccaauaaagaucaacacgcuauucgaauuugacggauacagaguuaacauucguagcaaagauucauaucacuacuuuacgauaucuagcgcuauggcugcuauauacaguaaagauacaucugacuauauaaaagcugugagcagcuacauugauaaaucugacaagggaucaaaguucaaaccuggagaagcguucgacguacucucuaaccuaaaggucuacgaugaaaucgcuaagaaauguauaucggaaccauuuagcaaaauaagcaaacuagcagaagcaggaaaaagauggaagaaagaagaaauaucacuacaaaacugcuuacucuga

SEQ ID NO: 5246 - RNA, 3945 nt, Artificial Sequence
  Cas9 variant
augcucaaaaaggacuacagcauaggucuagauauuggaacaaacaguguaggacaugcaguaguuaccgaugauuauaaaguaccuacuaagaaaaugaaaguauucggcgacacaucaaagaaaacuaucaagaaaaacauguuaggcguccuacuuuucaaugaaggucaaacagcagcagacacgcgccucaaaagaggagcaagaagacguuacacaagaaggaaaaauagauuaagauaccuucaagaaauauucgccccugcauuagcaaaaguagacccaaacuucuuuuaucgccuagaagaauccagccuaguagcagaagauaagaaauacgacgucuauccaauauuuggaaaacgugaagaagaacuccuauaucacgauacacacaagacaauauaucacuuaagaagugaauuagcaaauaacgauagaccagccgaccuaagacucguauauuuagcacucgcucauauaauaaaauauagggguaauuuccuguuagaaggagaaauagaucuaagaacaacagauauaaauaaagucuuugcugaauuuucagagacacuaaacgaaaacucggacgaaaauuuaggcaaacucgacguagcagauauauuuaaagauaauacauuuucaaaaaccaagaaaucugaggaacuucuaaaacuuucuggcgcaaagaaaaaucagcucgcucaucaacucuuuaaaaugauggucggaaacaugggaucuuuuaagaaagugcuaggcacggacgaagaacauaaacuaaguuuugguaaagacacauaugaagaugaucucaaugauuuacuugcagaggcuggagaccaauaccuagacauauucgucgcagccaagaaagucuaugaugcagcaauccuagccuccauccuugauguaaaagauacacaaacuaaaacuguuuucucacaagccaugaucgagcguuacgaagaacaccaaaaggauuuaauugagcuaaaacgaguauucaagaaauaucuacccgaaaaaugccacgacuucuuuagcgagcccaaaauaagcggauacgcugguuacauagacggaaaaguauccgaagaagauuucuacaaauacaccaagaaaacauuaaaagggaucccugaaaccgaagaaauccuccagaaaauagaugcaaacaauuaucuucgcaaacaacgaaccuucgacaacggagcaauaccacaucaaguacaccuuaaagagcuaguugccauaguggaaaaccaagggaaauauuaucccuuccuacgagaaaauaaagacaaauuugagaaaauauugaacuuucguauacccuacuauguaggaccacuagcgagagguaauucaaaauuugcuuggcuaacccgagccggugaaggaaaaaucacaccauauaacuuugacgaaaugauagacaaagaaaccagugcagaagauuucauaaaaagaaugaccaucaaugaccucuaucucccuaccgaaccaguauuacccaaacauagccuacuauaugaaagauacaccauauuuaacgaacuggcaggaguuagauacguaaccgaaaauggagaagcaaaauacuuugacgcacaaaccaaaagaucaaucuucgaauuauuuaaacuagaccguaaagugucagagaaaaugguaaucaaacauuuaaaaguggucaugccugcaauaagaauacaagcacuaaaaggacucgacaauggaaaauucaacgccaguuacgguaccuacaaagaccuaguagauaugggaguagcaccagaauuacuaaacgaugaaguaaacagcgaaaaaugggaagacauaauaaaaacgcuaacaauauucgaaggucgaaaacuuauaaaacgacgucuugaaaacuaccgugauuuucuaggcgaagacauuuuaagaaaacuaucucgcaagaaauauacaggauggggaagacuaucagcaaaauuacuagauggaauauaugauaagaaaacacauaaaacaauacuagacugucuaaugacggaagauuacucacaaaacuuuaugcaacuaauaaaugacgacacuuauucauucaaagaaacaaucaaaaacgcccaagucauagaaaaagaagaaacacuagcuaaaaccguacaagaacucccaggaucuccugcgauaaagaaaggaauacuacaaagccucgaaauaguagaugaaaucauaaaaguuaugggguacaaaccaaaaaguaucguaguugagauggcgcgcgaaacacagaaaacacaugguacacgaaaacgagaagaccggguccaacaaauaguuaaaaacuuaaaagacgcaaaugaauuacccaagaaauuaccaaguaacgcugaacuuucagaugaacgcaaauauuuauacuguuuacaaaauggccgcgacauguacacaggugcaccucucgauuacgaccaucuacaauucuacgacgucgaccacauaauaccccaaucauuccuaaaagacgacagcauagaaaauaaaguacucacaauuaagaaagaaaaugucagaaaaacaaacggucuccccagugaagcaguaauacagaaaauggggagcuucuggaagaaauuacucgacgccggagcgaugaccaacaagaaauacgauaaucucagaagaaaucuucacggaggccuuaacgaaaaauugaaagaaagauucauagaaagacaacuugucgaaacccgccaaauaacgaaauacguugcucaacuauuggaucaaagacuaaacuaugauggaaacgguguggaguuagaugagaaaauagcuauaguaacacuaaaagcacaacucgcaucacaauuuagauccgaauuuaaacuaagaaaaguacgagcauuaaauaacuuacaucaugcucacgaugcguaccuaaaugcugucguagcaaaucucauaauggccaaauauccagaauuagaaccagaauuuguuuauggcaaauaucgaaaaacaaaauuuaaaggacugggaaaagcaacagccaaaaauacauuguaugcaaacguacuauauuucuuaaaagaaaacgaaguauauccauucugggacaaagcaagagauuuacccacuauuaaaagauaccuuuaccgcgcacaaguaaacaaggucagaaaagcugaaagacaaacaggaggauuuucagacgaaaugcuagucccuaaaagcgacagcgguaaauuauuaccccgaaaagaagggcuugacccgguuaaauauggaggcuacgcuaaagcugucgaaaguuacgcuguauuaauaaccgccgacgaggugaagaaaggaaaaacuaagaaaguaaaaacucuaguaaacauaccaauaaucgauaguaagaaauaugaagccgauccaaccgcuuaucuagcaucaaggggcuacacaaacguaacaaauuccuucauacuucccaaauacagcuuauuagaggacccagagggccgaagacgauaucuagcuucauuuaaagaguuucaaaaagcaaacgaacuaauacuaccccagcaccugguagaacuguuguauuggguaaaugcaaaagacggugaacaaaaacucgaagaucauaaagcagaauuuaaagaacucuuugauaaaauaauggaauuugcagacaaauacguaguagcgccgaaaaacagcgagaaaauaagaagauuauaugaagaaaaccaagaugcuacgccaauggaacuagguaagaauuucguugaauuacuccgauauacagccgacggugcagccagugacuucaaauucuuuggugaaaauauaccuagaaaaagguacaacucagccggauccuuguuaaauggaacucuaauauaccaaucgaaaacaggauuauaugagacuagaauugaccuugguaaacuuuga

SEQ ID NO: 5247 - RNA, 3948 nt, Artificial Sequence
  Cas9 variant
auggguuacuccguaggccuugauaucggaacagggaguguagguuggguaguaaccaaugaagauggaaaacuagcucgcgccaaagguaaaaaucuaauuggagugcgacuauucaaaacagcagaaccagcagcggacagaagaacaaauagaacuacccgaagaagauuaagccgucgaaaauggcgacuacgacuauuagaugaauuauucgccaaugaauuaggaaaaauugauucaaacuucuuaacacgacucaaauacucauauguucauccuaaagacgacgcuaaccgggcaaauuacuacggaggauacuuauuuccaacccaagaagaaacaaagaaauuccacgcaaaauacccaacaauauaccaucuuagauuagcacucaugacagaaagcagacaauuugaccuacgagaaauuuaccuugccaugcaucaaauagugaaauaucgaggacacuucuuaaauagccagaguaaaaugacaauagggaacacuuauaacccccaggauuugcaaaccgcuauggaaaacuaugcugaagcaaaaggcuuaagcauagaacuaaaacaaccagaagaaaugguagcgauucucacaggugaagcuggauucggucuaucuaagaaagcuaaagccgaaaaacuccucaacaacuucuucuuugauacuaaagaagaaaaagcaacaguucaggcuauacuagcaggaaucgucgggaacacaauugauuuuacaaaaguauucaaccgccaacucacuggagacacucuaaaagcguggaaacuaaaacuagacucagaaacauucgacguugacucagaaccuauacucagugaucuagaugaugacgaaaccgaacuuuucuuugcaauaagacaggcuuuugauggauuuacacuuaugaacuuacuuggagaccaaacgucaaucuccgccgcgaugguagaacgguacacacaacaucacgaugaucuauuaacaguaaaacaaguggcaaagaaacaaggacucucacacaaagaguucucaaauauauacucagcauuccuuaaagaugauaccgacaaagggaugaagaaacuucucgaagaaucaaauuuauccacagaagauguaaauggcauacaauuaagaauggauagccaugacuuucuaccccaacaaagaacaaaagcaaacagcguaaucccacaucaacuacacuuagcagaauuagaagccauaauagaaaaccaagggcaauacuacccauucuuauuagaaacauuugaaaaagaaggaacagcagcaaacaaaauagcagaacuuuuaaaauuccggauaccauauuaugucggaccuaugguaaccaagaaagacguagaaaaugcaggaggagaugcgacaaaccacugggucacaagaaacgaaggauacgaaaaaucagcuguaacggccuggaacuuugaccaaguauucaauagagaucaagccgcgcuugacuuuauacagcgucuaaccgggacugacaccuaucuaauaggcgaacccacauuaccacagaacuccuuaaaauaccaaauguucacuguauuaaaugaauuaaauaauguaaaaguuaauggacgaagaauagauaaucaaaccaaacaugauuuaauacaagaucuauuuaaaucuaagaaaacaguaucacuuaaagcauuucaagauuacuaccaaucacaaggaaaaagcgacauacagguagugggucuagccgacaaaacgaaauuuaauucaaaccuaucuaccuauauugaccuaucgaaaaccuuuagugccgaagaaauggaaaauccacaaaaccaagaucuccuagaacaaauaguugagauacagaccguauuugaagacagcaaaauagcagaaagggaacuaagcaaauuagaacuaacaccugaacaagugacaaaacucgcuaaaacacacuacaccggauggggaaaccuuuccaauaaauuacuuacgacccccauuguagacgucagugguaagaaagucucaauuuuagaccaacuagcaaaaacaagcaaaaacuucaugucgauaauuucaaaugaacaauaugguguccaagauuggaucaaagaacaaaauacgacugagaccacuggaacuuuagaagauaaacuagccgauuuaacuacgagcccagccaauaaacgagguauaaaacaagcauucaacguacuuuucgauauacaaaaagcaaugaaaucugaaccagauagagucuaccuagaguucgcaagagaaacacagacaucagucagaacaaugagccguuacaacuacuuaaaaggacucuaucaaucaaaaucucuugaugcagaagcuaaaaaucucaagaaagaacuugcagaaaccgaccaaaagaaauuugacaaugaccgauuauaccuuuacuuccaacaacaagggaaagauauguauacaggucaacccauuaacauagauaaacuaaguucagacuacgauauugaccacauuaucccucaggcuuucacuaaagacgacucaaucgauaaucgaguucuaguaagucgacccgaaaaugcuagaaaauccgacucgggcacauauacaacagaaguccaagcggcggccucaggccuguggaaaacauuaguacaauccggauuuaucagcagaaagaaauacgaucgguugacucaugcuggugacuacucagaaggacagaaaacgggcuuuauagcacgccagcuaguagagacaagacaaauaauuaaaaaugucgcugcucuaauagaaagugaguucgaccaaacgcaagcagucgcaauacgagcagaaauaacaggagacaugagaagacuuguagcuauaaagaaacaucgagaaauaaacuccuuucaucaugccuuugaugcacuucuaauaacagcggcaggacaauacaugcagaaaagauaccccgauagagacaguaauaacguauauaacgaguucgacagguauacgaaugacuaucucaagaaauuaagagaaucaucaagcaaagacgaagugcguaaacuuaaaccauuuggauucaucguaggaacaauggcaaaagguaacgaagacuggacaacagaacaaacggaauacuuacgucauaucaugaauuuuaaaaauauacugaccacauauaaaaccggaccagacagagguccacuaagcaaagaaacuauauacgccguagacccaaaagcaaaauuaauuggaacaaacaaacaucgacaagacguaucauuauauggcggguauaccuaccccuauagcgcuuauaugacucuuguacgagcaaaugguaaaaaccaauuaguuaaaguuucuagaucugccgcaucauuaaugaaaucaggacaacucaaauuagaagacuacguacaacaacaaccagaaguuaagaaauucgagaaaauauuacuagaacaucuaccucucggucaacucguagauaacgacgguaaauuaauguauuuaacaagcuaugaguucuaccacaaugcaaaacaacuguggcuaucaacagaaaacgcugaccuuaucucaagccucaguauagauagcgaugaucaaaaacuaaucaaggcuuucgauauccuuacugcagacucagucauagaaagauucccauuuuacgaaauagaucugaaaaaguuaaucgaauuaagagacaaauuuguacucauagauaacaaauuagauguacugagagucguuuuaaaagcauuacaacuagauagugcacaacaaaaaccacuaaaacucauagauaaagcagcaacagauuggaaaaacuaucgacaagcaggaggcauaaaacuuagugauaaugcagaaaucauauaucaaucaacuacaggaauauucgaaaagagaauuaaaaucucagaucuucuuuga

SEQ ID NO: 5248 - RNA, 3951 nt, Artificial Sequence
  Cas9 variant
augcugcaaaaaaauuauacaauaggccuagacauaggcacuaacucuguaggauaugccguuauaaacgacaacuauaaaguuccagcaaaaaagaugaagguauuaggaaauacugacaaaaaaacuauaaaaaaaaacuuaaugggcguauuauuauucgaugcuggagaaacagcugcaacaacaagauuaaagagaggcacucgacggcgauauacacgacgacgaaauagauuacgguaucuacaagaaauacuaggaccugaauuagcaaaaguugaugcaaauuuuuuacauagacuagcagaaucaucacucguaacagaagacaaagaauucagcgccuacccuauauuuggagauagggaagaagaacuuuuauaccacaaaaccuacaaaacaauuuaucaucuuagaucagcacuagcaaacaaggacgaaaaagccgaucugcgacucauuuacuuagcucuagcccauauuauaaaauauagaggaaauuuucucauagaaggagaaauagaacuaagcgauaccgauauugauaaaguuuaugcugauuuuuguagaagcuucaaugaacuauucgacacugagguauuacaagaaauagagguagaagccauuuucaaagacaaaacacuaagcaaaacaaaaaaagccgaagaguuaguaaaaguaucaggggucaaaaagaaucaaguagcucaucaauuucuaaaaaugaugguaggaaacacuguuaauuucaaaaaaguauucaauuuaacggaagaccagaaauuaucuuuuggaacagacucauaugaagaugaguuaaaugauuuauuagccaaauccgaugaucgauauuuggacguuuucguugcugcaaaaaagguauaugauacugcaauauuagccaauauucuuaauacaaaaaacagcguggcaacaaaaacaauauucagccaaaguaugauagaaagauuuaaagaucaccaaaaggaccuaaaagaacuuaaacaauuguuuaaaacuuaucuaccagaaaaauacccagauuucuuuggaaauucuaaagaagauggcuacgcuggcuacauagaaggaaagacaaaugaagaaaaauucuauacccacacaaaaaaaauucucaaaaauaucccacaagcugcaaguguauuagcucaaauugacgucggaaacuaccuacgaaaacaaaggacauuugauaacggaguaauaccacaccaaauacaacuaaaagaacuucuagcaauaauugaaaaucaaggcaaauacuacccuuuccugcucgaaaacaaagaaaagauugccaaaauacucacauuccguauuccauacuauguagguccacuggccaggggaaauuccagauuugccuggcucaaacguguaggaaaagaaaaaauaacaccauuuaauuucgaaaauguuguugaccucgaaucaagcgcggaacgcuucauagaaagaaugacuuuaaaugaccuauauuuaccagaagaaaaaguacuccccaaacauagcauguuauaugaaaaauuuucaauauucaacgaauuagcaggaauucgauacauaacggacaauggagaaaugaaauuccuggacgcacaaacuaagcaaucgauauucgagcuuuuuaaacaagagaggacaguaaaggaaaaaaagguauuagauuuacuaaaaacgcucaugccuagcgaacgcguaguugcaauuaaagguauagacaacggaaaauuuaacgcaaguuuuggaacauaccacgauuuaucgaagaugggguucaaaacagaaaaaauagcuagcgagucuaaccaagcccgcugggaggaaaucauaaagacgcuaacaaucuuugaagacagaaaacuaauuaaaucgcgacugcgaaaauaugaugauuuccugaaugaaaaagaaaucggagcauugucaaaacgcaaauacacaggauggggacgauuaagugcuaagcucaucgacggaauauaugacaaaaaaacacaucaaacaauacuagacuuucuuaugaaugaagauuacaaucagaauuucaugcaacucauaucaaacgauaauuauucauucaaaaaaauaaucgaagauucacaaguuaucaaagaagaaggaucgcucacagaaguaauacaagaauuaccuggaucaccagcaauaaagaagggaauucuacaaagcauagaaaucguagacgaguuagucaaaguaaugggcggaaauccaaaaaaaauaguuguagaaauggcgagagaaacccaaaaaacacacgggacuacacgcagagaagcaagaauuaaagaaauaaucaagaaccucaauaaacuaaaguuaaacgaacuuccaaaagaccucccaucaaaugaggagcuaucugacgaaaaaguauaucuauauugccugcaaaauggcagagauauguacacuggagcaccacuugaccuagauaaccugucacaauaugaagucgaccacauaauaccccaaucauuucuaaaagaugacucuauugaaaacaaagucuugacagcaaaaauagaaaauaguagaaaaacaaacggacuaccaaguguagaaauagcgaaaaaaaugggagccuucuggaggagcuuacuaaaaguaggagcaauaucugagaaaaaauacagaaaucuaagacgaucucuacacggaggaaugacagaaaaauuaaaggaaacauuuguaaaaagacaauuagucgaaacucggcaaaucacaaaauaugucgcacaaauacuaaauucacgguucaaugaagagaaaaacgaagacaagguugccaucgugacacuaaaagcccaacuaacaucucaguucagaaaggauuuugaacuguauaaaguacgcgagaucaauaaucuacaccacgcacacgaugcuuaccuaaacgccguuuuagcaacauuacugaugaccucauuccccgagcuagaaccagaauuuguauaugggaaauacagaaaaacaaaauuuaaaggguugggaaaagcaacagcaaaaaauaauuuauacacgaauauacuccaacugcuaaaggaagaaucugcccaauauugggauacaaaagagcgcgaucuagcaacaauuaaaaaaaaugucuaucaagcccaaguaaacaaaguacggaaaguagaaagacaaacaggcagcuuuuaugaugaaaccguagcaaaaaaaucagcaucucaaaaacuauucccuagaaagaacgggcuagauccaguuaaauauggaggguaccaacgugcuaaugaaggauauagucugcuguuuagagcagauaugcuaaacaagcgagguaagacaaagucaguaaaaacguuagugaagauaccaauaauugaaagugcucaauaucuggcagauccuacagaauaucuggccaaacgcggcuauuacaauguuucagaacauucgcucuuacuaccuaaauucucucucuuggaaaacaacaauggacucagaagauaccuagcuagcucaaaugaauuccaaaaagcaaacgaacuaaucuuaccaaaacaccuagucagacuauuauacuggucacaaucaaagcaaagaaaggaagaacuaaacaaacaccgcgcagaauuugcugaauuauucacuuauaucauggacuuugcugauaaauacguaguagcacccaaaaacagugaaaaaauuaaaaacaucuacgaaaacaauaaagacucaaguguagaaguacugggaaaaaacuucauagaacuauuaaaauauacugcagacggugcagccagcgauuucaccuucuucgacacaaaaauacccagaaaaagauauaauucugcaggugacuuauuagauggaacucuaaucuaucagagcaaaacaggauuauacgaaacacggauagauuugggggcaauauga

SEQ ID NO: 5249 - RNA, 3957 nt, Artificial Sequence
  Cas9 variant
augaugauaaaacuuaacaacaugaagaaaauucuaggacuagacuuaggaaccaauucgauuggaugggcaguaguugagacggaagauaacaagaaauuugaacuacuggacaaaggaguacgcauauuccaggagggcgugaaaauagaaaaaggaauagagagcagcaaagcagcagaaagaaccggauaccgaagcgcaaggagaauaaaauuccgcagaagacuucgaaaaaucgaaacacuaaaaguauugauagaaaacaauaugugcccccucucaauggaugaacuuaucgucuggaaagaaaacaaaaacaacuaccccaaaaauaaaauauuuuacaauuggcuaaaaacaaaagaccccaaagaaggaacuaaugguaccuacauaaacccuuacuacuucagaacagaagcaauaaaacggaaauuagaaaacacgaacgauguagguagagcacuauaucaccucgcacaacgccgaggcuuuaaaaguaauagguuggaaagcacagacgaaaaaucaagagguauaguuaagacugaaauaaacaaacuuagcucggaauuaaacggacgauacuuaggagaauacuuuuacgaacuauaccugaagggugaaaagaucagaaaacgacauauaaguagagaggaacauuauuuaaaugaguucaagaaaauaugugaagugcaaaauuuuaacaaagaacuugcagaaaaauuagaaagagcaauauucuaccaacgaccguuaaaaucgcaaaaaggacugguagggaaaugcacguuacaaaauaacaaacaccgcuguccaauaucgcgaccagaguucgaagaauuuagaauguggcaauucauaaauucaauaaaauauaaaaacucagacgguaaauucgacuucuuaaauaaagaacagagagaaaacauaauaccagcuuucgucaguaauaaaaacgccacguuugaauuuucaaaaauagagaaaauccucaauaaaggcguccacauauaccaauuuaauuauaaauccaaucauacaauaggaucgaaccaaacaaugauaaauuuuauggaugucuuugacauagauaggaaacugaccaacgcauggcuccuaugcguaaacaaaauuuacgaacuauauaccgcgaagacaaagaaggauggaagccuaaaauccaagagugaagucauaacugauguauggcauguacuauucaccuucgauaacgaagaaaacuuaaaagaguucgcaaggaauaaauuacuacuagaugaaucaagcgcgcagaaauuuucaaaaaucaaucucaaacaagacuauagucaacuuucccuaaaagcgauuaauaaaauuuuaccauaucuacaagaaggucuuauauacaguuacgccgucuuuauugccaacauagaaaaugugauaggcaaaucaauauggaacauuaaggaaaaccaacaaauaaucagaacuuccaucaaaaagauaauagacaaccauaaaacagaauuagauauaaacacgaucacaaacucauugauaaacgacuucaaagucaauuacaauaacgcgcacaaagaauauaaagucgacgacauagauuuaaagaacauccgcgagaaaauaauaaaauacuaugggaacaaaacuuggaacugucuaccagaagacgaaaaacuauaugugaaagaaaaaguagaaaaacuauaugaaaaacaacuaaaaagugguaaaagaggaauauucauagagaaaauacgauuggaugaucggauagaaaauuuccugaaagacaauuuugacagcucagaacuuaacuuaaagaaacuauaccauccaucugauguaucaguauacaaaagugucaaaauaaccgacuuaggucuacgacuauugggauccccaaugauaccuucaauuaaaaaucccauggcuaugagggcaaugcaccaacuaagaaaacuaauuaaucaucucauaauagaaggugucaucgacgauagcacuauaauaaaugucgaaaugucucgggaauuaaaugacgcaaacaugagaaaggcgauagaaagauaccagagacaacgggcaacagaaaaugaagaauuuaagacaaaaauaaaagaacucuauaagaaagaaugcgguacugacuucgaacccaacaacgacgacaucaugaaauacagacuaugggaagaacaaaaccacaaauguuuauauacaggaaaaucaauagguaucugcgauuuuaucggaucuaacccagcuuucgaaauagaacauacuauuccaagaagucuaaguuacgacaacagccuggaaaacaaaacucuaugcgaaaaagaauuuaaccaacaaguaaagaaaaaucgaauacccuucgaauuaaguaauuauaaagaaaucauaaguaggauaaauaauugggaaauaaaagcggaagaauuguucaaacaaauacaaaaagugaaaauucagucacgcauggcagccacuaaagaaauaaaagacaacgcaauccaaaggaaacaccuacuacaaauggaguucaauuauuggaauggaaaacuaucacgauucacaagagaagaugucccggaaggauucaaaaacagucaacuuguagauauagguaucauaacaaaauacgcuagggcauacuuaaaaaccguauucaacaacguaaacacgguaaaaggaagcacgguugcugaguucaggaacaucuggggucuucaagaauauuucgagaaaaaggauagaaguaaucauauacaccacugcauugaugcaauaacuaucgcaugcuuaacuaaagauaaauaugacuucuuagcacaccucuaucaucuggacgaacagaacaaccgagacgcaguccacagagcuaugaucaaaucaaaacccugggaaaacuucguacaggaugugaaagaaauagaaaaccaaauccuagucagccauuacacaccggauaaccuaccaaaacagucaaagaaaauacuucgaaaaagaggaaaaauccagaaaaacgaaaauggagaucuaauauacgaaaaaggcgacgcaguucgagggaguuuacacaaagaaucauuuuacggagcuauaaaacgugaaauaauaaauaagaaaggcgaaacagaagaaaaaguacuguauguaaaaaggaaaccacucgaauuuagcgaccuaggauucaagacaauaucagaacucgaaaacauaguagaugacgcaguaagagauaaaguuuuaaacgcaguaaaagacaaaggauuaaaacaagcacuaaacgaaccaauauggaugaaugaagaaaaacaaauaccuauaaagaaaguucgaugcuacacaccaucaguaaccaaccccaucaaucucaagaaacaucgagacaaaagcaaacaugaauauaaacaaucauaccauguuacaaacgauggcaacuacuuaauggugauauaugaaggaaaagacagccaagaaaaaguaaaacgagacuaugaaauaguaaguaacuuacaagcaggagaauauuuuaaacaaucaguacacggugucuuaaaagcacaaggaauaaacaaucuagaaggacuaauaccaaaauucaaagaaucagguaaaaauauacuaccucucaaauacauacuaaaaacaggaaccauggucauauuuugggaaaauuauccagaagaaauaugggauauugauaaaaaccaauuauacaagcgacuguucaaaguaacacaguuugaaucagacgggcguauacaagcaagauuucaucagaucgcaaaaccggacaacgaacuaacuaaaguuagugaauuagacuuuuccaacauagcagaaaagauaagacuaucaaaaggaaauuuaaacaugcuggugaauggauaugacuuuaagaucaacguacuagggcacauagaaaaguuaaguuga

SEQ ID NO: 5250 - RNA, 3957 nt, Artificial Sequence
  Cas9 variant
augggaucuaacaugcuuaaaaaagauuacagcaucggccuugauaucgggacuaacucgguaggacaugccguagucacagacgacuauaaagucccuacuaaaaaaaugaaaguguucggagacacgucaaaaaaaacaauaaaaaaaaacauguuaggaguuuugcuauucaacgaaggucaaacagcggcagacacaaggcucaaaagaggaacacgaagaagguauaccaggcgaaaaaauagacuucgauaccuccaagaaauauuugcaccagaacucgcaaaagucgacccaaacuuuuuauacagauuagaagaaucaagcuuaguagcagaagacaagaaauaugacguauacccaauuuucgguaaaagagaagaagaacuauuauaccacgauacauacaaaacaauauaccacuuaagaucugcgcuagcaaacaacgaccagccagcugaccuaagacuuguuuaucuagcuuuagcucauauuauaaaauacagaggaaacuuuuuauuagaaggugaaauugaccuaagaacuacagacauuaauaaaguuuucgcagaauucucagaaacuuuaaacgaaaacucagacgaaaacuuaggaaaauuagaugucgcggacauauucaaaaacaacacuuuuucaaaaacaaagaagagcgaagaacucuuaaaguuaucaggagcuaagaaaaaucagcuagcgcaucagcucuuuaaaaugauggucggaaacaugggcucauucaaaaaaguacuaggaacggaugaagagcacaaacuauccuuuggaaaagacacauacgaggacgaccuuaaugaccuauuagcagaagcaggagaccaauaucuagauauuuucguagccgcaaaaaaaguauacgacgcagcgauuuuagccaguauacuagauguuaaagacacccaaacuaagacgguauuuagucaagccaugaucgaaagauacgaagagcaccaaaaagacuugaucgaguuaaaacgaguauuuaaaaaauauuuaccagaaaaaugccacgauuuuuuuagcgaaccaaagauaaguggcuaugcaggguauaucgacggaaaaguaagcgaagaagauuucuacaaauauacuaaaaaaacauuaaaaggcauucccgaaacagaagaaauacuacaaaaaauagaugcaaauaauuaccuaagaaagcaacgaacauuugacaauggcgcuauaccacaucaaguucaucuaaaggaacuaguagcuauuguagaaaaccaaggcaaguauuauccauuccuucgagagaauaaagauaaguucgaaaagauauugaacuuucgcauaccguauuacguuggaccauuagcccgcggaaacucaaaauucgcauggcucacccgagcuggugagggaaagauaacgccauauaauuuugaugaaaugauagacaaagaaacuucagccgaagauuuuauaaaacauaugaccauaaacgauuuauaccuacccacagaacccguacucccuaaacacucacuuuuauacgaaagauauacaauauuuaacgaacuagcuggcguaagguacgucacagaaaacggcgaagcaaaauacuucgaugcacagacuaaacgaaguauauucgaguuauucaagcuagaucgaaaaguaagcgagaaaauggugauaaaacaucuaaaaguugucaugccagcaauacguauacaggcccuaaaaggacuggauaacggaaaauuuaaugcuucauacggaacauacaaagaccucguagacaugggaguagccccugaacuauuaaaugaugaaguaaauucagaaaaaugggaagauaucauaaaaacgcuaacaaucuucgaaggcagaaaauuaauaaaaagacggcuugaaaauuaccgagauuuucuaggagaagacauccugagaaaauuguccaggaaaaaauacaccggauggggcagacuaucagcuaaacuauuagacggaauauacgauaaaaaaacccacaagacaauauuagauugucuaaugacagaggacuacucgcaaaacuucaugcaguuaaucaacgacgauaacuacagcuucaaagaaacuauaaaaaacgcccaagucauagaaaaagaagaaacguuagccaaaaccguccaagaacucccaggaucaccugcaauaaagaaaggaauucuacaaucuuuagaaaucguugaugaaauaauuaagguuaugggguauaaaccaaaaagcauaguaguagaaauggcucgagaaacacaaaaaacccauggcacccgaaaaagggaagauagaguccaacaaauaguagagaacuuaaaagaugcuaaugaacuuccagaaaaauuaccaucaaacgccgaacuaagcgaugaaagaaaauaucuuuacugcuugcaaaaugggagggauauguacacaggagcaccacuggacuacgaucaccuccaauuuuacgauguagaucacauaaucccgcagucauucuuaaaagacgacucgauugaaaacaaaguccuaacuauaaaaaaggaaaacgugagaaaaacuaauggcuuacccucagaagcggugauucaaaaaaugggaucauucuggaaaaaguuacuagacgcuggugcaaugacgaauaaaaaauacgauaaccucagaagaaacuuacauggaggacuaaacgaaaaauuaaaagaacgcuuuauagaaagacaauuaguagaaacucggcaaaucaccaaauacguagcgcaauuacuugaccaaagauugaacuacgauggcaauggaguagaauuagaugaaaaaauugcaauagugacgcuaaaagcacaacuagcuucacaguucaggagugaauucaaacuuagaaaaguaagagcauuaaacaacuuacaccaugcacaugacgccuaccuaaaugcaaucguagcaaaccuaauaauggcaaaauacccagaacuagaaccagaauucguauauggaaaauacaggaaagcaaaauucaaagggcucggcaaagcaaccgcgaaaaauacccuauaugcaaauguucuuuacuuucuaaaagagaaugaaguauauccauucugggauaaagcaagagaucuuccaaccauuaaacgauaccucuaucgagcacaaguaaauaaaguaagaaaagcagaaagacagaucgguggauuuucagacgaaaugcuaguuccaaaaucagacucaggcaaguuacuacccagaaaagaaggauuagacccuguaaaauacggaggguacgcuaaagccguugaaucuuaugcaguucucauaacagcagaugaaguuaaaaaagguaaaacaaaaaaagugaaaacgcuaguaaacauuccaauaaucgauuccaaaaaauacgaagcugacccaacagcauaucuagcaucgcgaggguacacuaacgugacaaacaguuuuauccuaccaaaauacucucuacuagaggacccagaagguagaagaagguaccuggcaagcuuuaaagaauuucaaaaagcaaaugaguuaauacuaccucaacaucuugucgaauugcuauacugggucaacgcuaaagacggugaacaaaagcuagaggaucacaaagcagaauucaaagaauuauuugacaaaauuauggaauuugcugacaaauacgucgucgcaccuaaaaacagcgaaaaaauucgacgacuauaugaagaaaaucaagacgcaacuccaauggaauuaggcaaaaacuucguagaacuccuaagauacacagcugauggggcagcaucggauuuuaaauuuuucggagaaaauauuccgagaaaaagguacaacucagcggguagucuacuuaacggaacacuaauuuaccaauccaaaaccggacuauacgaaacacgaauugacuuagguaaacuuuga

SEQ ID NO: 5251 - RNA, 3960 nt, Artificial Sequence
  Cas9 variant
auguuuagucaaagaaacaacccauacugcgaauuauuauucaaaauuauaguaaccaauauagaagagaaaaauuuagaagucauuauggguauaagaaacucagauauauuuuucauuagcaauuuuaugugguaccaaaaauuaauaaugaugaucaaaaauauacuaggacuagacuuagggacaaauaguaucggaugggcacuaauagaaguugacgaaaacaacauaccuauaagaauaauugcuaugggaucuagaauaauaccacuaucgacaagcgacaaagaagaguuccaaaggggguuauccauuacgaaaaaccagaacaggacagucagcagaacacaaaggaaaggauacgacaggaaacaacuacgaagaucggaccuaaagaaaauauuaaagaaauacaacauauucccgagugaagaacuauuaaaauuaccaauguuggaucucuggaaacuacgcucagacuccgcuaacccaaacgaagacauaagugcugaacaauuaggacguaucuuauauaugcucaaucagaaacgaggauacaaaucagcuaggucagaagcaaacagcgacaagaaagauacagauuacguacaagcaguaaaagguagauaugcacaacuuaaagauaggagacaaacaauaggacaauacuuuuaugaagaauugucaacagcauucucagacaaaaauaaccaacaauacuuucgugucaaagaagaaguauacccaagagaagcauauauagaagaauuugauacaauaaucaacgcacaaaaagauaaacauggauuccuuacagacaaaguaauacaccaacucagaaacgaaaucaucuauuuucagcguaaacucaaaagucagaaaggguugguuaguaucugcgaacuagaaggauuugaaaagacaguauaugauaaagagaaaaacaaaaauaaaguaguuuucguaggaccaaaaguagcgccaaaaacuagccccuuguuucaauugugccggaucugggaagucguuaauacaaucagucuaaaaaucaaaaacccagaaggcagcaaauauaaauggggagaaaaaguacccaaccucaaacagaaagaaauucuagcggacuauuuauucaaaaaugaaaauuuaucuuucucaacacuuuuagaaauauuagaacuaaagaaagaagauguauaugucaacaaacaaauucuaaaaggaauaaaagguaacgaggcauaugcagcucuacacaacguacucggagaccaugaauuauuaaacuucgacgucucaauaauuacgagugaccauaccgcuauccuaguagauaagaaaacaggugaaauauuagaagaacgggcaggacuagaacuagacgcaagccuagaaagagaacccuuauaccaauucuggcacacaaucuauaguuugaaagaucuagacgaauguaaaaaugcccuuauaaaacgauuuggauuggacgaggauauagcugaaaaauuaucacacauagacuucaauaaacaagcauucggaucaaaaagcaacaaauccaugagaaaaauacuucccuuucuaauggagggcuacaacuauagcgagucauguucauuagccggauauaaccacuccaauucgcuaacaaaagacgaaagagaaucacaaauaacgcuagaacgacuagaacuacuacccaaaaacaaccuucgacagcccauuguugagaaaauacuuaaucaaaugauaaacguaguuaauacaauuuuagaaaaauacggcaaaccuucagaaauacgagucgaacuugcaagagaacuuaaacaaaguaaagacgaacgaaaugacacagaucuacaaaauucaaggaacaagaaacuaaaugaagaaauuggaaaaaggcucgcagaauuaggacugccagugacgaaaagguacauacaaaaauacaaauuuauauuuccaucccuuagcaaaaaccucaaagacgcucacguaaacaaccaauguauauauugcggcgaaacuuuuaaucuaaccgaagcguuaaauggagacgcauaugacguugaccauauagugccuaaagcccuacuauuugaugacucacaaacaaacaaaguacucguacauagaaaauguaacucuacaaaaacaaaccaaacagccuaugauuacauaacugcuaaaggugaagaagaaguccgcauauauagcgagagaguagacgauugguucaaaaagggaauuauauccuauucuaaaaugcaacggcuaaaaguaucacacaaagaauacuuagaaagaaagaaauuaggaaaagaaaccgaaacugauaagaaauuaugggaaaauuucauagaucgacaacuucgugacacacaauauauuucacguaaaucacgugaaauucuccaaaaagugugcaacaacguaacaacuacugaaggaggaguaacugcgaaacuacgcaaucuauggggaugggacgauauacuaaugaauuuacaaaugcccaaauauaaagaauugggacaaacaaucacaaaagaauggacauccgaacacggaaaacguaagcaucaaaaagaagaaauugaaaacuggacgaagagagaugaccacagacaucacgcaauagaugcccuaguaguagcauguacaaagcaaggauucauacaaaggauaaacacacuaaauucuucagagaccaaagaucucaugauaaaagaaguagaagaggcuaaaaucgaauuuaacgagaaaaccacauuacuagaaaaauaucucaaaacacaaaaaccauuuacgaccagagaggugaugaaagaagcagacaagauccuuauaucuuucaaagcaggcaagaaaguagccacaauaacaaaauucaaagcaacaggcaaaaacaaggaaacaggaguaauagugccccgaggagcucuacaugaacaaucagucuauggaaaaauaaaaguaauagagaaagacaaaccccugaaauaccuauuugaaaauccggauaaaauaguuaacucgcgaauacgugaccucguggaaacacgccuaucagaaaacgaaaauaacagcaagaaagcauuaaguacagucaagaaaaauccaauauucuuuaaugaagagaaaaacgaaauccucgaaaaagcauccuguuacaacgacgccacuguacuaaaauauaagcuacaaaaccuaaaagccaaucaaguggaugauauagucgacgaaagaguaaaauuucuuguaaaagaaagguugacacaauucggcagcaaagaaaaagaggcauucaaagacauacuaugguuuaaccaggagaaacaaaucccaauaaucacaguccgacucuuugcacgacccgaugccaacaaccuccagauaauuaaaaaggauaaaaacggcaaagacaucggauucguacuaacugguaacaaucaccacauagcaauauacgaagacaaagacucaaagcuaguucaacacucaugcgccuucuggcacgcuguagagaggaagaaauauaacauucccgcaguuauuaaaaacagcgcagacguuuggucccuacuacuagauaaagaacucccaguacucuucuuagacaaacuucccgcagaugaauuaaauuuaaaauucucaaugcaacaaaacgaaauguucauacuuggucuaucccaagaaggcuuugaugaagcaaucaaaaacaaugacaaaagccuccuaagcaaacaucuauaccuaguauggucaauuucaaacaaugacuacuauuucaggcaucaucuugaaaccaaaaacacagagcucaaaaauauaccaacagcaaaagauaguaaacgauacuucagauucaaaucggucggcgccuuaguaggcauuaaccccauaaaaguuagacuuaaucacuuaggcgaaauaaccaaaauaggugaauga

SEQ ID NO: 5252 - RNA, 3960 nt, Artificial Sequence
  Cas9 variant
augggauacaacaucggauuagauauagggacuggaucaguaggaugggccgcacuuaccgacgaaggcaaacuugcucgagcaaaaggaaagaaucuaauagguguacgucuauucgacucagcacaaucagcugcgcaaagaagaucguauagaacaacaagacgccguuuaagcagaagaaaauggagguugagacuacucgaaaauaucuuuuccgacgaaauggguaugauagaugaaaauuuuuuugcaagacuaaaauauucauauguucacccaaaagaugaagucaauaacgcacacuauuauggaggauaccuuuuuccaacacaacaggaaacacaugauuuccaugaaaaauuucaaacaauuuaucaucuacgacuaaaacuaaugaucgaagauuguaaauuugaccucagagaaauauacuuagcaaugcaucauauugucaaauaucgaggacacuuccuaaauagccaaagcaaaaugaccauaggcgacuccuacaacccaagagacuuccaacaagcuauucaaaauuaugccgaagcaaaaggauuaauauggagccugaacgacgcacaagagaugacagacguauuaguaggacaagcaggauuuggucuaagcaaaaaagccaaggccgaaagacuacuaucugcauuuuccuuugauacuaaagaagacaagaaagcaauacaagcaauacuugcaggcauaguuggaaacacaacagacuucacaaaaauuuuuaaccgugaacgaucgggagacgaacucaaaaaguggaaacuuaaacuugauagcgaagcauucgaugaacaaucucaggcaauuguagacgaauuagaugaugacgaaauggaauuguuuaacgcuauaagacaggcuuuugauggauucacauuaauggaucuccuaggugaucaaacaaguaucagcgcagcaaugguuaaacgcuaucagcagcaucaugacgacuuaaagaugguuaaagaaauagcaaaaaaacaaggauuaucucaucaagacuuuagcaaaaucuacaccgcauuuuuaaaagacgacaccgacaaaggcaugaaagcauuguuagauaaggcagacuuagcugaugauguccugguugaaauucaacaacgaauagaaucacaugacuucuugccaaaacaaagaacgaaagcgaacucuguuaucccuuaucaacuacaucuagcagaacuagagaagauuauagaaaaucaaggaaaauauuauccauuuuuguuggacacauuuaccaauaaagcaggcgaaacaauaaacaaacuaguugaauuagugaaauucagagugccuuauuacguagggccuaugguaaccgcggcagacguugaaaaagcagguggagacgccacuaaucauugggucaagcguaacgaaggauaugaaaaaaguccuguuacaccguggaauuuugaucaaguauucaaccgagaccaagcagcacaagauuuuauagacagauuaacaggcacagacaccuacuuaauaggcgaacccacccuacuaaaaaauucuuuaaaauaccaacuauuuacaguccuaaacgaauugaauaacguaaaaaucaaugggcacaaaauagaugagaagacaaagcacguguuaauacaagaccucuucaaaagcaaaaaaacuguaucagaaaaagcgaucaaagacuauuaucuaucccaagguaugggugaaauacaaaucguuggucucgcugauaaaacaaaauucaacucaaaccuuucaucauauauagaccuuuccaagacauuugaugcugaauuuauggagaacccagccaaccaagaacuacuugaaaacauaauacaaauacaaacgguauuugaggauguaaaaauugcagaaagagaauuacagaaacuagcuuuaccggacgaacaaguucaacaauuagcaaaaacucacuacaccggauggggcaaucuaucagacaaacuacuaagcaccccuaucauacaagaagguucacaaaaagugaguauauuaaauaagcuacaaaccaccaguaaaaacuucaugucaauaauuacggacaacaaauuugguguucaacaauggauacaagaacaaaacacagcagaaacagcugacucaauucaagacagaauagacgaauugaccacugcucccgcaaacaaacgaggaauuaaacaagcauucaacguccucuucgacauacaaaaggcuaugggcgaagaacccaacagaguauaccuugaauuugcgaaggaaacacaaaauuccgucagaacaaauucacgauauaacagguuaaaagaccuauauaaaucuaaaacucuauccgaugaugugaaagcauuaaaagaagaacuagaaucacaaaaauccagcuuacaaucggaacgaauaggagacagauuauaucuauacuuccuacaacaaggaaaagacauguacacaggacaaccaaucaauauagauaaacucagcacagauuaugauauagaccauaucauaccacaagcauauacaaaagacgacuccaucgauaaucguguuuugguaucacgaccugaaaaugcacgaaaaucagacucggcuacuuacacaacugaaguucaacaaagugccggaggauuauggaaauccuuaaaaaacgccggauucauaagucaaaaaaaauacgauagauuaacuaaagggggugacuacagcaaaggacaaaaaacaggauuuauagcacgucaacuaguagaaacucgacaaauaauaaaaaauguagcaucacuaauugaaagugaauucucacaaacuaaagcugucgcaauaaggucagaaaucacagcugacaugagacggcuagucgccauaaaaaaacacagagaaaucaauagcuuccaccacgcauucgaugcauuacuaaucacugccgcgggccaauacaugcaagcacgauacccagacagggacggagcuaacguauauaacgaguuugauuauuauacaaacacauaccuaaaagaacucagacaguccaguucaagcucacaaguacgaagauuaaaaccauucggauuuguuguaggcaccauggccaaaggaaaugaaaauuggagugaagacgauacacaauaccuaagacacguaaugaacuucaaaaauauucuaacuacacgaaggaacgacaaagacaacggcgcacugaacaaggaaaccauauaugcaguggacccaaaagcgaaacuaauagguaccaauaaaaaacgacaagauguaucacucuauggaggauauauauacccguacagcgccuacaugacacuagucagagcaaauggaaaaaaccuucucguaaaaguaacgauaucagcugcugaaaaaauaaaaucuggccaaaucgagcuaagcgaauacguacagcaaagaccagaaguaaaaaaauucgaaaaaauauuaaucaacaaauuagcaauaggucaauuagucaauaacgacggaaacuuaauauaccuaacuucguacgaauuuuaucauaacgccaaacaauuaugguuaccaacagaggaagcugaucuaauaagucaauuaaauaaagauucaucagaugaagaucuaauaaaaggauucgacauacuaacuucucccgcuauucuuaaaagguuucccuuuuaugaauuagaucuaaaaaagcuaguaaacauaagagauaaauuuauagcaguagaaaauaaauuugauauucucaugguaauauuaaaagcucuacaauuagaugcagcacaacaaaaacccguaaaaaugauugauaaaaaaagcgccgacuggaaagacuacagacagagaggcggaauuaaacuauccgauacaucggagauaauauaucaaucuacaacaggcauuuucgaaaaaagggucaaaauaaguaaccuacuauga

SEQ ID NO: 5253 - RNA, 3963 nt, Artificial Sequence
  Cas9 variant
augaccgaacaacaacgaccguauaacauaggacuagacauaggaacaucaucaauaggcugggcggugacagaccaaaaugauaaauuacuacauauucgaggacacaauggcauaggagucagacuuuucaaagaaggagaaucagccgcagaacgucgaggcuucagaacaacuagaagaagguuaucaagaagaagauggagauuacgauuucuagaccgaaucuuugacgccgaacuagccaaaguggaucccaacuuccucgcuagauuaaagcaauccaauauaucuccacuagacccaaacaaacaaauguucggaaacaucuuauuugacgaugcccaauucgacgaucaaaaauuucaccaacaauacccaacgauauaccaccuacguagcgcacuagcacaaccagaugcaccccaagcggacguacgacugauauaucuagcucuacaucacaugaucaaauuucgcggccauuucuuaaauggugccgcagucgaaaaguuccaugguggacaauuacaucuagaagccgaguuccaagaacuaaaccaaauuuucucaaaccaacagagagaucacgugcaacuccaaacaaguucgcuagacgaagucgcaacaauacucaaagauaaucaacgcacccccagcgaccgacaaagagaacucucugcaagacuguucguaccaguggacaaaacaaucgacaaggaaaacaagaagcuggccacagaacuuuuaaaagccguauuagggcucaaggcaaaauuugacgucauacuaggaguagaagccacugacccacaagcauucaaacuccaauuuucgagugaugauuuugaugauaaaauagcagaacuugcaagugaauuaacagacgaagcaaaugaaauccuuacaguacuacaaagauuguauuuuaguuuaaacuuggcugauauccuuacuaacaggcaaacaaaacagguugccgacagcauauccacagcaaugaucaacagauaugaugaucacaaacaccaucuaaaaaugcuuaaagaauuagaaacucaagucacucaagaacaacgagacggauuaaagaaagcauacgacgaauacaucgauggcgacaaaccaacaaucgauaccuuuuauacuaacgucaagaaaaaccucgacgacucagaacuugcgaaccaaauaaaaucauuaauagauuuacaagcauucaugccaaaacagagaucaaaggaaaacggaaguauaccccaccaacuacaccaacgcgaauuggaccaauuaauugaaguccaaggaaaguauuacccauggcuucuagcagcaaaagauaaauuagacgcccuaauagcauucaggguaccuuacuauguaggacccaugauagauccuaacgaaucagaugacccccaaaacacuaaauucgcauggaugguccgaaaagaagccggagaaauaacgccauggaacuuugaggaaaaaguugacaaaacagguagugcaaccaauuucauaaagaggaugacaacgaccgauacauacuuacuuggagaaccaguauuaccgaaaaauucccuauuauaccagcaauuuacaguuuuaaaugaacuaaacaaauuaaaaguagacggcaaggcacucacaguugaccaaaagaaauacuuauacgaacauguauguaagaaacaaagacgaguaacucuaaagaaacuaucugauugucugauggcaaggggagauuuuccaaugggagcgauauuuacaggaacaaccgaccagaaaaacaugaacaacacauuaaaaacauaucaagacuuucaagaaauauuuggugacgaaaucgauaauccagacagacagguagauuuugagaaaaugaucgaguggagcaccauauucgaagaucgcgaaauauuuaaacuaaaauuagcagaacuaaacugguugaccagugaacagcuagaaagaguaucaaagaaaagauaucaggguuggggaagacuaucgcaaaaauuauuaacacauauagucaacgaaaacggagaaaggauaauagaccaacuauggaauacaaaucaaaauuucauggaaauaaugggacaagauggaguaaaacaagcaauucaagaacacaacggagcuaacgucgcacaaaccgggauaaaugaaacaauagaugagcuauauacuagcccacaaaauaagaaagcgauuaggcaaaucuuauuagucguagacgauauaaagaaagcaguuggcuacgcaccagcaaauauaaugauggaguucgcaagagaagauagagacgaucauagacuuauagcgucaagagcaaggcaacuugagaaaaccuaccaagaaauaaguaaaaauugguuugauaaugaaucaguaacucaagaacuaaaagaucagaucaaaaacaaaacaaaauucacugacagacuauaccucuacuucauacagggagggauagauuuauacaccggccacccauuaaauauagaccaguuaagcagcuaugacauagaucauauauuaccacaaucguuccuauuagauaacagucuaaacaaucgaguacuaacgagucaaagcgaaaaucgugugcauaaagaagacagacuacccggugaaaccguagcaaauaaaaugcgcccaaccuggaaaaugaugagagaacaaggauugaugacgcagcguaaauacaacaauuuaacccuaaaacccgaucaaaucucaaaauucaauaaccgcggccaauuuauaaacagacaacucgucgaaaccagacaaguuauaaaacuagcagccgacauuaugaaccaaaaauaccaagcugaccaaacaaaagucguaacuguaaaagcgaacuuaacacaucacaugcgagaaaaauuuaacuucuacaaaaguaggaauguaaacgauuaucaucaugcguucgaugcauaccuaacaguuuuuguaggaaauuggcuauuaaaagaauauccaaaauugcaaccauauuucguauacggagacuucgcaaaaacggguacaaauaacuugaaaucauucaacuuuuuauaccgcuuugaacgugaucauaaauuaaaugacaaaggcgcgauagacaccgauaaagaucagcaauuaggguacaugaaaagaauauacagauucaagaaaaugcuaguaaccaaacaacucgaaacaaaugaaggcgcgcuauauaaacaaacaauauacaaagcaccagcuaacgagaaaaauacaaagaaaaaccguucacuaauuaacacaaagaaaaauaggcccucagacauauacgggggauauucacaaucaguuaccgcuuauaugaguuuaguauuuuucaaaaauacauuuaaauugauaaaaaugccccucguagcagccaacgccauuaaaaauucacuaaguucauaucaugauacaauacugaaaauucuuggaagcaaugaauuuaaaguuuuaaucccaaaaguaaaaaugaaucaauuaaucaaagaaggagacagucucuacacagucguagggguauacaaacacaaugcucagcaacugauucuauccgacaacucaauggguauaaucacaaaaccuauucgugaaauaugugacagcgaccuagacucaguguucaaugaacucguugacaacauagauaaauaucuaaaccuauacaaaauagaagacaaacucacaaucaaagaaaaauuuuaugcacuuaaaaauaaagaauccaaauucaaauguauuagcgacaucuuagucggcacacacugcaacgcaggaagaaguaacuuaaaaauaaucggacuuucaaguuacuggggaauguucucaggaaauaacgacggauuaaaaauaaaugaaaacagccaacuuauauaccaaucaccuacuggauuauucgaacaccgaguaaaggucucugaucuuuga

SEQ ID NO: 5254 - RNA, 3972 nt, Artificial Sequence
  Cas9 variant
augaaagacuucuacauagguuuagauaugggaaccgacuccgugggaugggcuguugcugacgaagauuacaacuuaugcaaauucaaaggaaaagcuauguggggaguucgacucuuugacgaaucagcaaccgcugcagaacgaagaggauuuagaacggcaagacggagagcccaaaggaaaagacaaagaauauuauggcuccaaauguuauuuaacgaagaaauuuccaagaaagacauagcauucuuucaaagguuaaacgaaagcaaauuguaccuagaagacaaaucuacaaacguuccauacgcaguguuugcagaugaaaguuucacagacguagauuaucacaaacucuauccaacaauuuaccaucuuagaaaagaauuagugcaaagugaugaaccgcaugauguaagauuaguauacuuagcccuacaccaucuuauuaaaaauaggggacacuuuuuauuugaaaacgucggaagcgacuuugaaaaagaaagcucauuugaaguccuauucaaaaacuuacaaaacuauauauuaggagaauacgaacuugcacuagaaugcauaucaccacuacagauagcagacauccuaaaagacaaaaguaaaagaaaaacuacaaaaucaagcgaaauauguaaauuacuaggcauaagcaagaaaggacaaccacgacuaaacgcuauaguccuacugaugugcggccaaagcguaaaacucgcagauuuauacggagacgaaaacuacaacaaagaagagaaaaguucuauaucauuugaaaaaggauaugaagacaacgaagaaacauauagagaauuauuacuugaaagauuugaauuaaucgagaaaauaaaagcccuauacgauugggccaucuuagccgauauacugaaaggcgaaacauauauaucauuugcaaaagucaaaaccuaugacgaacaucgacaugauuuacaacaauuaaaagcauuuguaaaagaacgaugucgaucagauuacaaugaaaucuuucgugaaacauccgacaaacuaaacaauuauaccgccuauugugguaaauucaaagaaaauggaagaaauggcgucauacuacacucagcaaaucaaacggauuucugcaaauaccuaaaaucaaaauucgacaaacuagacaaaucaggguaugaagacauguuugagaaaauugaaaacggaucauuuaugccaaaaauaguaguaaaagacaacgguguaaucccuaugcaagucaacgaaucagaaguaagagcaauucugaaaaaugcuucaggauaccuagacuuucuaaacaaucaagauaaagauggcaucacaguagccgauaaaauucugcaaauauuugaauuuagaaucccauauuacguaggaccauuaaacguacauagcgacaacucaugguuaguacgaaaagauggcaaaauauacccauggaacuucaacaaaauagucgacguagauaaaucagcagaagaguucauaaacaaacucaccgcuaaauguacuuaucucccagacagagacguaauccccaaaaauaguauccuauacucuagauauaugguauuaaacgaauuaaauaaucuaaaacuugacggaaagaaaccugacgucucuuucaaacaagcuguguuuaaugaccuauuuaugcauagaagaaaaguaacacaaaaggcuuuaagagaauacaucaaagcacagaccgguacagaaccggaaauaacaggaauagacggagacuucaaagcaaacaugaggcccgcgauugaacuggcaggauacaacuugucagaacccgacaaagaagaaauaauaaaagccauaaccauauuuggagacgauaagaaacuucuuaaacgacgaauaaaagacaaauauagugaaaugcuaucagaagaugaaaucaagaaaauauguaaacuuaaauacaaagauuggggacgauuaagucgagaguuccuaacagaaauauuugacguagauacggcuacaggagaaugcaaagacaacauaauaaacacauuauggaacacuaacgacaaccuuauggaacuauuaggugccaaauauaacuucacccagucaauagaacaagcaauaucaaaaagcacccauaaagccaguauagagaaaaugguagaggacauguacgugagcccaaaaguuaaaagaaccguauuccagucacuaaaaauuaugaaagaaauuguaaagauaaaaggacacgcacccaaaaagguuuucguggaaaugacaagacaugaugggacuaaaggcgacaacggccgaaccaaaaguagaaagaaacaauuagaagaacuuuacaagaaaugcaaagaagacaguacggaauuaugggacgaauuagagaaaacggacgaugaugaguucaggcaagauaaacuguucuuauacuacacacaaaugggacgaugcauguacaguggagaaagaauagaacucagagaucuauucaacaaaaacuuauaugacauugaucacauuuucccccgaaguaaaguuaaagacgacucaauugauaacaggguauuaguaaagaaacaaauaaacucacacaaagauaacgacuauccucuagauaguaccguaagggagaaaaugagaggacauuggcaauacuuacuacgacauggcuucaucagcaaaaagaaauaugacagacuuacgagggucacaccccuuacagaugacgaacuagcagauuuuauugcacgucaauuagucgaaacaucacaaucaacgaaagccguagcaacgcuauuaaaaacacuguauccuacaaccgaaaucgucuacgucaaagcggaacugguuucuagauuucguacagaauauaaguucauuaaaugucgagaaguaaacgaccuccaccaugcaaaagacgccuacuuaaauaucguaguaggaaacguauacaaugucagauauacucauagcaaagccauauucauaaagggucuccaaaccaagaaauauucacuaaacagaauguucgcauuugacacaccuggagcauggaauaucgaaaaugaaaaauccuugucaauagucaagaaaacaguaaugaagaacaacauccuauauacgagauauagcuauaugaagaaaggaggauuauuuaaaauucaaccccugaagaaaggaaacggacaagcuccucuaaagaaagaccucccauuaagugacauagguaaauacggcggguaugacaaacccacagcuaguuauuucuccuacauaaaauaugaagguaagaaaggcaaggaguguagacaauugguggcuauagacaauuaucuuaagaaauacuacgaggagaacccaauagaauaucuaacgaauagacuagggcucaaaaaucccgcaguauuaauaccgguaaucaaauacaauuccuguauagagauugacggauuucggaugaauauaucaucaaaaaguaacgaaggaaaaacaauagucuacaaaccugccguccagcuuguccuaggcgcagaaaaagaagcauacguuaagaaaauauccaaagugcuaucaaaaccugaagaacagaaaauaacaucauacgacggcgucagcgcagaggaaaacauugaguuauuugaugcacuaacagcaaaaaugaccaacacuauauuuaaaaucaaacuagaagacauaggcaauaaaauaaaauccggacgagauaaauuuguaacacuagacguaaagaaacaaugcuacgucaucaaugaaauuuuaaaaauaaugcauugcaacguagucacaggagaucucagucugauaggagcagcaaagaaagccggaauugucucaacuaacucagcauuaucugagaucaagaaagugucaucaauuauguuaauaaaccaaaguguaaccggacuauucgaaacgaaaaucgauuuacuuaacauauga

SEQ ID NO: 5255 - RNA, 3975 nt, Artificial Sequence
  Cas9 variant
augcgcgcaaaagggaagacacuaauaggaacgucucuauuccgagaaggaaacacugcagccgaaagacggggauacaggacuacucaaagaagacuaaaacgucgcaaaagacgucucaaacuauuggaagcauuuuucgauccauauauauuugaagucgaugagaacuuccuagcgagacuacacgaagcagacauaaguccaaaggacgaaaacaaacgauucuggggcagccuauuauucccuaacgaaaaagaugccaacuucuaccgcaaguauccaacaauauaccaccuacgaaaagcucuaauggaagaagauagaaaauucgacguaagagccaucuuucucgcuauucaccauaucaugaaauauagaggaaacuuucucagcccccugucagucgacucguuuaaacaagaaggacuugaguuaaaagaacaacucgaucgacaacuuaaacgcguugcugaauuauauaaugagcuaaauacggacguaaagaucaauguaagugacguagaaacuauccaagacauaauaauugacaaaaauaaaucaagaagagauaaagcaggagcacuaaagaaacuccuagccguaaguagugacaggaaagaaauaaacaaacuaaacgcaucccuagcaaaagaauuaucuaaugccauccuaggcaugaaagcacaauucgcaaaucuauugcuagccgaugacuuggaaauagauaaaaauaaaaaaaauuucagucuccucgacacuaacgccgaagagaacguaucaggacuacuagaacuuguaaacgaaaaacaagcagaacuauuugacgcuauuaaaacaauacacgaccaaaucauacuaaaugaaaucguaccagacggaaaaucuauaucacaaucaaugguagacaaauacgaggcacauagagaacaacuccagguguuaaaagcacuauacgaaaaaauggacgcgaaacaaauaaaagcaauaaaaaaggcauauucacuauacauagaugguaaagacccaaaagcaaaaaaaguagauaaaagagcacaucaaaauagagcugacuucuauaaagaaguuaaaaaaguucuaguugagcuagacgacagcagagcagaaaaauuacucgguuuaauagagaugggacaauuucuccccaaacagagaacagccaugaacggcguuauacccaaccaauuacaccaaguggaacuagacaaaauaaucgaaaugcagagcaaauacuacccaugguuagcagaaaaaaauccagucaaaucacaccaaaaaagagcuccauacaaacuagaugaacuccuuacauuucgaguucccuauuauguaggaccuaugguaacauccaaaaaacaacagcaaacaagcaacuccaauuucgcauggaugguuagaaaacaagagggcgaaaucacucccuggaacuucgaagaaaaaguagauacaauugcuagcgcaaaugacuuuaucaagcgaaugacagcgaaagauaccuauuuagucggagaagacguccuccccgcuaauagccuauuauaccaaagauacaagguacuuaaugaacuaaauaacaucaaagucaacggaagaagauuaccagucgaguuaaaaagagaagcuuauguugcuuuguucgaaaauggagauucaaaaacaguaucagcaaaauguuuuaaaaacuggcucaauguuaaacuaaaaaaccuuaauagucuaaaguuagaaggauuaaguacuggaacgaaauuugacaauaaucuaucaacauaccaugaucucaaaaaaauauucgguaaagcaguagaugaugcgggacgacaaaaagacuucgaacaaauuauagaaugguuaacaauauucgaagacaaaaaaauccuaagaaucaaacuaaaagagauagaauggcuaaccgaagagaauauaacucaauuaacaagauuaaacuauaauggauggggacggcugucuagaagacuuuuaacaggaauuugugacucaaauggacaacgaauaauggacuggcuaugggauacuacaaacaauuuuaugcaaauacagucacaaccugacuuccaaaaggcaauuguagaauauaauuccgauaaauuggaacaaggagauauagaacaaauacuaggcgaagcguacacuagcccgcaaaacaaaaaagcuauaagaaagguaaucaaagucguacaagacguugaaaaagcuaugggagcaaaaccaacaagcaucucaauagaauuuaccagaucagauggaagaagugaguuaacaaacagucggaugacacaacuacagaaaacucuuaugucacuaucagaagaaaugacugaucaagcacuauuagcagaauucaaagacuuccaagcgucuaaaaaaaaacuaacaaauaaauauuaucuauauuuuacucaacuagggagagacauguacacaggagaaccacuaaauaucgaucaacucucauuauacagugacggagaccauauucuaccacgcaguuucaucaaggacgauaguuuagauaaucgaguacuuacaaaacgggcgguaaauaacgaaaaaagugauaccguuccaguaugugaauacggcgcaaaaaugaaagacuuuuggaaugaccuuuacgauaauggacuaauaaguaagcaaaaacuagcaaaccuacugacggacccggacgaaauaggaccauacaaagcaaacgguuuuauaagaaggcaauuagucgaaacuucacaaguaauaaaacugagugcagaaauucuacaaacacuuuaucaagacacgaaaauuauugaagucagacagaaauauacucaugaauuacgcgaacacuuuaacuuuguuaaaauacgacaacuaaaugacuaccaccaugccuucgaugcguaccuaaccgccuucagcggacgauaccuauaccaaagguauccaaaacugaggggauacuuugucuauggugacuacaacaaauuugaugcaaaaaaagacagaaacuaccuuaaaucauauaacuuccucuaugaucucgaagaaggaaaaacagaucaaaucguugacaauguagaacacaaaguguuuaugaaccggcaagacgcaauaaaucaauuaaaaaaagcauacgaauauaaauacauguuaguaagucaagaaacuuauaccaacucaggcgcaauguuuaaggaaaccaucuaccccgucaauccuaaacaaaaacuaauucaaaaaaaaaacgacaaacccguagauaucuacggagguuauagcaauaauuaugacgccuaucuuucaauuguaagauuagaagacaaaaaaggaaucaaauucagggucgucgguauccccaugcgaaauaaagcagaguuagauaacuuagcaaaagaagaccauaauggauauaugcaacggcuaaaugaaaucguagacgaacaaauaaacagcucaggcaaaaaaaaaacauucagaauuauacuaccaaaaguacacuuuaaacaacuaguugaagacgacucuggcaaauuuaugcuaggauccgcagccuauccuuauaaugccaaacagcuugucuuaucaguuaaaucaauagaaucccuagcuaacaaggaugcaagugacagagaacuuguugcgguauacgaggaaauuuuaaauguagucaacgacaaauucacccuauaugacgcaagacaauuucggaacaagcuuaccaguucaaaagacaaauucgucgaguuaaacacugcugacaaaguaaccgaacuauuagacauccuagauggccuacaugcaaauccaguuguuaaaaaacucaaaauaauaagcggaagccccuucggauucuugcaaagaccuagcggcauaguucuaacagaaaacgccaaacucaucuaccaaagcccuacuggaauauucgaacgaguaguauaucuuagggaccuauga

SEQ ID NO: 5256 - RNA, 3984 nt, Artificial Sequence
  Cas9 variant
auggaaggacaaaugaaaaacaauggaaauaacuuacaacaagggaauuacuaccugggacucgacgucggcacaucaucagucggaugggccguaacagacacagacuacaacguccuaaaauuccgaggaaaaagcauguggggagcacgacucuucgacgaagcaucuacagccgaagaacgucgcacccaucgagguaacagaagaagacuagccagaagaaaauaucgccuacuauuacuagaacaacuauuugaaaaagagauaagaaagaucgacgauaacuuuuuuguaagauuacacgaauccaauuuaugggccgaugacaaaagcaaaccauccaaauuuuuacuauucaaugacacaaauuuuaccgacaaagacuauuuaaaaaaauacccaacgauuuaccauuugagauccgacuuaauacacaauucaacagaacacgauauaaggcuaguauuucucgcauuacaccaccuaauaaaauaucgcggucacuucauauaugacaauagcgcuaauggggacguaaaaaccuuagacgaagcaguaagugauuuugaagaguacuuaaaugaaaacgauauagaauucaacauugaaaacaaaaaagaguuuauaaacguccuauccgacaaacacuuaacaaaaaaagaaaaaaaaauuagucugaaaaaacucuacggagacauaacagacucagaaaauaucaauauuucugucuuaauagaaaugcuauccgggucaucaauuaguuuauccaaccuuuuuaaagauauagaauucgauggaaaacagaaucuuagucucgacucagacauugaagaaacacuaaaugauguaguagauauacuaggcgacaauauagacuuauuaauucacgcgaaagaagucuaugacauugcuguacuaacuucgucgcucggaaaacauaaguaccucugcgacgccaaaguagaacuauucgagaaaaauaaaaaagaccugaugauucucaaaaaauauauuaagaaaaaccaucccgaagacuacaaaaaaauauucaguucaccaacagaaaaaaaaaacuacgccgcauacucacaaacaaacaguaaaaauguuugcucacaagaagaauucugccuauuuaucaaaccauacauccgugacauggucaaaucagaaaaugaagacgaaguacgcauugcaaaagaaguagaagacaaaucguuuuuaacgaaauugaaaggaacaaauaauuccguagucccauaucaaauacacgaaagagaacuaaaucaaauccucaaaaacauagucgccuacuuaccauucaugaaugacgaacaagaagacauuagcgucgucgacaaaauaaaacugauauucaaauucaaaauacccuacuacguaggaccccucaauacaaaaagcaccaggucuuggguuuaccgcucagaugaaaaaauuuacccauggaacuucaguaacgucauagacuuagacaagacggcucacgaauuuaugaaccguuuaauagguagauguacuuacacuaaugauccuguuuuaccaauggauagucuacuauauucaaaguauaacguacuaaacgaaaucaacccaauaaaagugaacggaaaagcaauaccaguagaaguaaaacaagcuauauauacagaccuauucgaaaauagcaaaaaaaaaguaacucgcaaaagcauuuacauauaccuacugaagaacggauacaucgaaaaagaagauaucgugucaggcaucgacauagaaauaaaaucuaaacucaaaagucaccaugauuucacccaaauaguacaagaaaacaaaugcacaccugaagagauagaaagaaucauuaaaggcauauuagucuauuccgacgauaaaagcaugcuacgaagauggcuaaaaaacaauaucaaaggccuuucugaaaacgauguuaaauaccuagcaaaauuaaauuauaaagaauggggacgccuaucaaaaacccuccucacugauaucuauaccaucaauccagaagauggugaagcaugcucaauuuuggacauaauguggaacaccaaugccacacucauggagauacuaagcaaugaaaaauaucaauucaaacaaaacauagaaaacuacaaagcagaaaacuacgacgaaaagcaaaaccuacacgaagaacuagacgacauguacauaucaccggcagcucgcaggucaauauggcaagcacuucgaaucguagacgaaauuguagauauaaagaaaagugcuccuaaaaagauauucaucgagauggcuagagaaaaaaaaagugcaaugaaaaaaaaacgaacugagucucguaaagacacacucuuggaauuauacaaaagcugcaaaagccaagcugacggauucuaugaugaggaacuauucgagaaacuaagcaacgaauccaauucacgccuacggagggaucaacuauaucuuuauuacacccaaaugggaagaagcauguauacaggaaagcgcauagacuucgacaaauugauaaacgauaaaaauacauacgauauugaccacaucuauccacgaucaaagauaaaagaugauucgauaacaaacagaguucucguagaaaaggacauuaacggcgagaaaacugauauauauccgauauccgaagacauccgacaaaaaaugcaaccuuucuggaaaauauuaaaagaaaaaggauuaaucaacgaagaaaaauauaaacgacuaacccgaaacuaugaauuaaccgaugaagaauuaucaucauucguagcaagacaacucgucgaaacacaacagaguacaaaggcccuugcaacacuauuaaaaaaagaauauccaucagccaaaauaguauauucaaaagcugguaacguaagugaauuucgcaaccguaaagacaaggaacuaccaaaauuucgggaaauaaaugaccuacaucacgcgaaggaugcuuaucugaacauuguaguaggaaacguguaugacacaaaauucacagaaaaauuuuuuaacaacauuagaaacgaaaauuacucccugaaaagaguauuugacuucucaguacccggggcuugggaugcuaaaggaagcacauucaauaccauaaaaaaguauauggcaaaaaacaauccgaucauagcuuucgcacccuaugaaguaaaaggagaacucuuugaccaacagauugugccaaaagguaaaggucaguucccaauaaaacaaggaaaagauaucgaaaaauacggcggcuauaauaaauuauccucugcguucuuauuugcgguagaauacaaaggaaaaaaagccagggagcguucuuuagaaacaguauacauaaaagacguugaauuguaccuacaagauccaauaaaauacugcgagaguguuuuaggucucaaagaaccccagauuaucaagccaaaaauccugaugggaaguuuauucucaauaaauaacaaaaaacugguagucacaggacgaucaggaaagcaauacgucugccaucauauauaccaacuaagcauaaacgacgaagauucucaauaccuuaaaaacauagccaaauacuuacaagaagaacccgauggaaacauagaacgacaaaacauauuaaacauuacuucaguaaacaacaucaaacucuucgauguacuuugcacgaaauuuaacagcaauacauaugaaauaaucuuaaacucgcuaaagaacgauguaaaugagggaagagaaaaauuuagugaacuagacauacuagagcaauguaacauuuuacuacagcuccuaaaagcauuuaaauguaauagagaaagcuccaaccuagaaaaacuaaacaacaaaaaacaagccggaguaauuguaauuccccaucuauuuacgaaauguucuguauucaaaguaauacaccaaucgauaacaggauuauucgaaaaagaaauggauuuauuaaaauga

SEQ ID NO: 5257 - RNA, 3984 nt, Artificial Sequence
  Cas9 variant
augaaaaauuacucaauaggccuagacauugguacgggaucaguagggugggucuguauugaugaaaauuaucaaauauuaagauauaacaacagagcugcuuuuggaguacaugaauuugaaacggcacacguagcagaagaacgaaggauaaaaagaggagcaaggcgaagguacaauagaagaaagaaacgaauacaacuacuucaaucccuauucguaccacacaugcaacaaaaagccuucuucgcuccgacgauaacugaacauuacuggaaaaaugauaaccaauuugaaaacagaacccucucagaaguacuaaugagccuaggcaugaacccuaacacuuaucccaccauauuccaccuaagacacgaacuuaucgaaucaaguguaaagaaagacgcucgucucauauaucuagcgcuucauaaucuugugaaauuucgaggccacuucuuacaagaggguuccacuuggaaugccaauaugucagacgccaacuuauccgaacaauuugaacaacuccuacauauauauaccgagauggaagaauuaccccaaguaucauugaccgcacaacaauccaccgauguagaacauauucuucuaaacaaccauauaagcaaagcugaaagagcacgccaauugacagcauuauucgagcguacauaugaaccuuucuuuaaacuaauaguaggauuagacaucgcugcagcgcaacucuucaaacaaucagaacaacaacuuuuauauaaagaaaguaaaacaaaaguaaaccuuacagcugaaacccuacccgaagugcuacaaaccaugcuggaaccagaggucgcuuucauagaagcaguucaaccauuuuaccaacaaaccguauuauucgaccuacuaaaaggucaaagcuacgucgcagcugcaaaaguggaagcauucaaccaauacgaaagagaccuagcucuacuuaaaaguguaaucaacgaagucggaucagaaaaacaauacagagcauucuuuauuacaucaaaacaaaagaaacgacaauuugagcaaaaaccaaacauggaauuacuaugucaucuugauagauuuaaucgcgagaaaaaguacgaagaaacauucuauaaagagguaucgaaacuacugacagcacuuaucaaagaagcaacgggagaaguaaaagaacacauugaacaaauuauccaagcaauggaaucacaaucuuuccuagugaaacaaaaagguauucaaaaugccuccaucccauaucaaaauagccuauacgaagcagaaaugaucuuaagaaaccaacaagccuacuacccuuggauaaccgaugaguucauagaaaagguuaaacaacuuaucgcguucagaauaccauacuacauagguccccuaguucagggcgaugaacaaccauucggauggcuucagagacaggcugauggaaacauaacaccauggaauuucgaugaaaagguaaauaaggcagcaucagcagaaucauucaucacacguaugaccaaaaauugcacauaucuaaaagaagaaaaaguucuuccaaaacaaucacuuauguaugaaaaauucacauuauuaaacgaacugaacuccguacaaauacgaucaucacuagaacaaccccacaagaaacaccgauuaugugaagauaugaaacaguggaucauugaacacguauucaagaaaacaaaaacuguaacccacaaaacacuaauacaagccuuaaagaaaucaccauacaaagacgaacuuuaugaugaaaguacagguaacuggaaagauguuuauggaacgcaaaaagaagauagauuugcaucuucucuauccacauauauuucauuaaaagaaauaguaggcgauauugucgacaacgccuuuauggaagaaauaauauacuggcuaacaguauucaccgauagagacaucauaaccuuaaaaaugaacgauaaauacccuuuuaucacugaacaacaaauacaaaggcucuuaucacuuaauauaucaggauggggacaauuaucacaacgacuacuucaaagcaucccuguagaugacaugaaccgcucaguaauagaauauauggagaaacacgcaguaaacuuuauggaacucuuaucacccagacagucagauuuagcauacaaaaucgaacaaguuaacaaacaacacaguaaaaagauacacaaaauaagauacgaagacauagaacagcuuaccgguucaccagcucuaaaaagagguaucuggagaagcguuaaaaucaucgaagaacucacugcgauauuuggcgaacccaaaaauauaaugauagagguagcacgagaagaucaagcuagccacagaacaaaguccagaaaagaacaaugggaaucuauagguaaaucacucgcuaaggaagaaaaagaauuaaaagcauucuuuaaagaaauggcacaauaccccaaacaacaauuugauagaacgagauuuugguuauaugucacacaacaagggaagugccuauauacuggcaaaacacucagacuggaagaccuaucauccuaugaaaucgaccacaucuuaccaagaaacuuuguaaaggacgacucaauagacaaccucgcccuagucuauccuauggcaaaccaagagaaaaauaaggcagguaauaacaaaaugcccuuagaaaucauagaugcaaaacaacaaccagcaaugauggcccacuggaaaagacucaaucaauuaaaacuaauaucggacuccaaacuacauaaacuuaugaaaccuucuuuuaacgauguagacaaagaaaauuuuauagccagacagcuaguagaaacuagacaaauaaucaaacacguucgcgaccuguuacaagaacgauuugaacacacagacauacacguuguuaaagcaaaaaugguaucacaauuucgcaaauucuccagaauaccaaagauccgggacuauaauaacaaacaucaugcaauggacgcauuauucacgacaguacuaauccaauuuauucuacaaaaauaugguaaaaauuuccuucaauucgauuugcaacauaaagauauaucaaagaaauggucaaaaauugcccaaagcacaaaacacuucuuucuuuuucaacaauuugcugaacaacaaauaaaaucuccaguaacuaaagaauuagucaguggaguucaauauuuugaacacauauuuuaugaacaauccuggcaaacaacuaaaaugacucaaacgauagacucgaacuucuacaaagaaacaauauuuucacccaaacucaaaacagcuaaauauacaagugcgaaagccgaaaaauuuguucacgaugcaaucguaaaguacgcagucuguggaauacaauacacaucuuuaaagaaaaauaaagaacaacaucacguauuguuaacugacaucaaugucauagaacauuaccaauuaaaagaggcuuccuugaaugaauuagcucuacauuuagccaaaagagaaucaaaagacgacguaauagacgcgcaaaugcuagucguaauaccaaaauauaagaaaauuauguuaaauggaagcccguacuacugcauaucaagugacgaacgccauaucgccacucaauucguacugaggaaagacuuacuagaggcuguucuccaugucaaugaugaaacaucuguugacgaacuaagaacacucuucaggucaauagucgaagagaugaugacacaauauaagguauacaauaaagacacaaucagaaauaaaauagaugcguuuauagaaacagaauuaauagacguugaaacuuuucaagucggauuuacugagauaaagaaaaugguagcagcaaacgcacaaagauccgacaaauucggcggaagacuaagacaagucaugaaagucgaagacauuuacauuauagaugaaagcauaaccggacucagauauaggaaaccaagaaaauuaguuaaauga

SEQ ID NO: 5258 - RNA, 3984 nt, Artificial Sequence
  Cas9 variant
augaagaaaaacuacacuauuggauuagauauugggacugcgucuguagguugggcaguccuaacagaggacuacgaauuaauaaaaaggaaaaugaaaaucucuggcaacacacaaaaaaaagcgguuaaaaaaaacuuuugggguguaagauuauucgaacaaggagaaaccgcagagggacgaagauugaaacgaacaacaagaagacgaauagcaagaagacgacaaaggauccaguaucuaaggacgauauucgacgaaggaaugaaccaaguagacgcaaacuucuuugcuagauuagaugagagcuuuucuauaauagaugaaaaagaaaacgaaagacauccaauauuuggcaauguagccgaagaagcagcuuaccacgaacaauuccccacaaucuaccaccuaagagaacauuuagccaauucaucagaacaagccgaucuaagacucguauaucuggccuuagcacauauuauaaaauucagaggacacuuccuaaucgaaggagaauuaaauacagaaaacucgagcguaaguggcacauuugaacaauuuauaaaaguauauaacgaaacguuuaaugucgaaaaagcacuagacuuaacaguagaccuagacggaauagcagaacaaaaaauaaguagaaugaaaagagcagaacuuauccucagccuauucccugaagaaaaaucaaccggugauuuugcucaauucauaaaaaugauuguaggaaaccaaggaaaugugaaaaaaaccuucagucuuaaugaagacgcaaaaauacaauucucuaaagaagaauacgaggaaaaucuagagacccugcuagcagaaaucggagaagauuuccgaucaguguuugacgcggcaaaaucaguauaugaugcaauaagucuagccaacauacucaaaguaaccgaugcaacaacuagagcaaaauuaaguucaaguauggucgugagauucacagaucacaaggaagaucuaaaaacauuaaaacgauucgugagagaaaaucuaccagaugaauaugacgaucuguucaaaaacaaaaagguugcaggcuaugcaggauacauagacgggaaugaaacacaagaagcuuucuacaaauaccuaaaaaaaacacuagcgaaagccacaggcgcagaagguuuccucgcuaaaauggaacaggaagacuuucuaagaaaacaacgaacuuuugacaacggaguaaucccauaccagcuccaccuagaagaacuaaaggccauuauaaaaaaccaaaaaucguauuauaguuuucuggaugaagaaaaaauaucacaauuaaugacauuccguauaccuuacuauguuggaccuuuagcuaaagaaaaaggucaauucgccugguuaacaagaaaggaaaugggaaaaauuacgcccuggaacuuaaaugaaaaagucgacauagaaaaaucggcaacagacuucgucgaacgaaugacaaacaaugauucuuaccuaccuauggaaaaagucuuaccaaaacacucauuauuauacgagaccuuuacugucuacaacgaacuaacuaaaguacguuauauagaugacaacgggagagcccaaaauuuuagcagcaaagaaaaaagacaaaucauaaacgaacuauuuaagcaacaaagaaaaguaaaaaaagaaauguuggaagcauucuuaaaaaaugaauaugggauagaaaacccaaaaguggaagggauugaaaaaagcuuuaacgccuguuuaggaacauaucaugacuugauaaaguugggaauuagacccgaacuauucgaacaaccugaacacgaacaacaauuugaacaaauaguaaaaauccuaacaguauuugaagaucggaaaaugagaagaaagcaacuagaaaaauucaguaacauuuugacagaagaagaacaaaaacaguuagaacgaaaacacuauaaaggauggggcagauuaagugcaaaguugauacacggaauaguugaccaaaaaacacaaaaaacgauacuagacuaucuaauagaugacgaugaccuacccaagaacagaaacagaaauuucaugcaauuaauaaaugacgaaaaccucuccuuuaaagaagaaaucgaaaaaauugccuuugacaaugacaagagcacagaagaaauugugcaagaacuugcggguucaccagccauaaaaaaagguauauuacaaagucuaaaaauaguugaagaaaucauagauauaaugggagaauuaccaacuaacauagucguugaaauggccagagaaaaucaaaccacagcucaagguaacagagccuccaaagcaagaaugaaguaccucgaagaaucaaucaaaaagcuuggaaguuccauacucgaagaugaaccaauaucgaaagaugcuaaccuacuaagaaaugauagacuguuucuuuauuauuuacagaacgguagagauauguauacaggaaaugaacuggauauaaauaaccuuaguucauaugauauagaucacauaguuccacaaucauucguaaaagaugauaguauugauaacagaguacuaacaacuaguaguaugaacagaggaaaaucaaacacggucccagcggagucagucguaaaaaaaaugaggccuacaugggaacguuuacucgcuaguggacuaauaucgaaaaaaaaauucaguuauuuaacuaaagcuacaaauggaggucuuaccgaagaagauaaagcacauuucauacaacgacaacucguggaaacacgacaaaucacgaaaaacguugcacaaauucuccaucaaaaauauaacaacgaacaacuaagcgaaaaaccaguuagaguuauuacgcuaaaaucagcccuggcuucccaauuccgaaaagacuucucuuuauacaaaauacgcgaacuuaacgauuaccaucaugcacaggaugcauaucuaaacggaguaaucgcacaagcacuauuaaaaguauauccgaaacucgaaccagaguucgucuacggggaauaucaaaaaguuucaauuagagcacuuaacaaggcaacugcaaaaaaagaauucuauuccaacaucaugaacuuuuucacuucugaugaaaugguagccaaugaggaaacuggagagguauuauggaauagacaaagagacauaaagacuaucaaaaaggucaugaauuaucaccaaaugaacauuguuaaaaaaguugaaauucaaacuggugcuuuuaccaaagaauccauauuaccgaaagguccaucaaagaaacuuauugcaagaaaaaacaauugggcuccgguaaauuacggaggugucgauagcccuacaguugccuacucaguuaucauuacccacgagaaaggaaaagcagcaaaaguuguucaacaacuagucgguauuaaaauucuggaacgucaagcauucgaacaagacgaaguagcguuuuuagaagaaaaaggauuuauucacccgaagguccaauuaaaauugcccaaauauuccuuauaucaauuugcugacggcagacgcagacucuuagcaucagccgaggaaagccaaaaaggcaaccaaaugguucucccuguacaucucaucgaauuacuauaccacgccaaacacgucucagauagcucuggaaagucacuagaauaccucaacgaacauaggcaugaauucgcagaacuacuagaagccauauuacaguuuacagaacaauacauugacgcagggaaaaaccaaaaaaaaguucgagaccuuuacgaaaaaaaccaagaugccgacaugagagaauuagcauccucguucauacaauuauuacaauuaaacaagcaaggagcaccagcagauuuuaaauuuuuuggagaaacaauaccuagaagacgauauaaaaauacagcugaaauagucgaugccacauucauaaaccaaagcaucacagguuuauaugaaacacaaaaaagguuaguauga

SEQ ID NO: 5259 - RNA, 3984 nt, Artificial Sequence
  Cas9 variant
augaccgaacaacaacaaccauauaacauugggcuagacauaggcacaucaaguauuggaugggccguaacugaucaaaaugacaaguuauuacacaucaggggacacaacggaauaggcguuagacuauuuaaagaaggagaaucagcagcagaaagacgaggguuuagaacaacgaggcgcagacucuccagaagaagauggcgucuaagauuucucgauaggauauuugacgcugaauuagcaaagguugaccccaauuuccuagcacgucucaaacaaucaaauauuuccccacuagaccccaauaaacaaauguucgggaauauacuauucgaugacccacaauucgaugaccaaaaguuccaucaacaauacccuacuauauaccacuuaagaucagcacuggcacaaccagaugcaccccaagcagacgucagauuaauauaccucgcgcuacaccauaugauuaaauucagagggcacuuucuaaacggugcugcaguagaaaaauuucauggcggacaacuccauuuagagucagaguuccaagaacuuaaccaaaucuucucaaaccagcagcgagaccauguucaacuacaaacuucaagucuagaugaaguagcgacaauacuaaaagacaaucaacgcacaccgagugauaggcaacgcgaacuuagugcuagauuauuuguucccguggauaaaacaauagacaaggaaaacaagaaacucgccacagaauuacuaaaagccgugcucggauuaaaagccaaauuugacguaauacuagggguggaagccaccgacccacaagcauucaaacuacaguucucuucagacgauuucgaugacaaaauagcagaacuagcuagcgaacuaaccgacgaagcaaacgaaauccuaacaguacuccaaagguuauacuuuaguuuaaauuuagcggauauacuaaccaacagacaaacaaaacaagucgcugacucgauaucaacagcaaugauaaaccguuaugacgaccacaaacaccacuuaaaaauguugaaagaacuggaagcgcaaguaacgcaagaacaacgcgauggacuaaagaaagccuauaacgaauacauagacggggacaaacccacaauugacacguucuacaccaacguaaagaaaaaucuagaugauagugaauuagcaaaucaaauuaaauccuugaucgaucuucaagccuucaugccaaaacaaagaucaaaagaaaauggaucaauaccacaucaacugcaccaacgagaacucgaucaauuaauagagguccaaggaaaauacuauccuuggcuccuagccgcaaaagacaaacuagaugccuuaauagccuuucguguacccuacuacguaggcccaaugauagacccuaaucaaucagaugacccacagaacacuaaauuugccuggaugguaagaaaagaagcaggagaaaucacgcccuggaacuuugaagaaaagguagacaaaacaagcuccgccacuaacuucauaaaaagaaugaccacuacagacacguauuuauuaggagaaccgguauuaccuaaaaacagcuuauuauaccaacaauuuacugucuuaaacgagcugaacaaacuaaaagucaacggaaaagcacuaacuguagaccaaaagaaauacuuauacgaucauguuuguaagaaacaaagacgaguuacccuaaagaaauugucagauugccuuguagcuaggggugauuucccuaugggcgcaauauucacaggaacaacagaccagaaaaauaugaauaauacacucaaaaccuaccaagacuuccaagaaaucuucggcgacgaaauagauaauccagauagacaaguugauuuugagaaaaugauagaauggaguacaaucuuugaagaucgggaaaucuucaaacuaaaauuagcugaacucaacuggcucacaagugaacaauuagaaaggguaucaaagaaaagauaucaaggauggggucgccucagucaaaaacuguuaacccacaucguaaacgaaaauggagagcgaauaaucgaccaacucuggaauacuaaucaaaacuucauggaaauaaugggacaagauucugucaaacaagcaauacaagaacauaauggcgcaaacguugcccaaacuggaauaaacgaaacaauugaugaauuauacacaucuccacaaaacaagaaagccauaagacaaauacuccuaguaguugaugacaucaagaaagcaguaggauaugcaccagccaauauaaugauggaauuugcaagagaagauagggaugaccacagacuaauagcuaguagagcacgucaacuagagaaaacuuaucaagaaauaaguaaaaauugguuugacaaugaguccguaacucaagaacuaaaagaucaaauuaaaaacaaaacgaaauucacagaccgacuauaucuauacuucauacagggaggaauagaucuuuauacaggucaucccuuaaacauagaccaacuaaguucauaugacauagaccauauuuuaccgcagagcuucuuacuagauaauucucuuaacaauaggguacuaaccucccaagcagaaaacagaguacauaaagaagauagacugcccggagagaccgucgcaaauaaaaugaggcccacuuggaaaaugaugagagaacaaggacuuaugacacaaagaaaauacaauaaucuaacucuaaaaccagaccaaauauccaaauuuaauaauaggggacaauucaucaaccgucaacuuguagaaacaagacaagugauaaaauuggcagccgacauaaugucacaaaaauaccaagcagaucaaacuaaagucguaacaguaaaagcaaacuuaacacaccacaugagagaaaaauuuaauuucuauaaaucuaggaacguaaaugacuaucaucacgcuuuugaugccuaucuaacacuauucgucggaaacugguuauuaaaagaauauccgaaacuacaaccauauuucguauauggugacuucgccaaaacaggaacgaacaacuuaaaaucuuucaauuuccuauauagauuugaacgagaccacaaauuaaacgacaaaggcgcuauugacacugauaaagaccaacaauuaggauauaugaaaaggauuuauagauucaagaaaaugcuagugaccaaacaacuugaaacaaacgaaggagcguuauacggucaaacacuauaucccgcuccuaaaaaugacaagaaaacucgaaauuuaauaaauucaaagaaaaaucgcccaagcgacauauauggcgguuauucuaacgaaaacgggagcuuccuaacauuagugaaacucaagaaaggcucaaaauacgacuauagauugguagcuguaccagucucaaaaauaagugaaauuaaagaaucugaacuagcuacuauagaaaaagcaauagcaccacaauuccuaaaaucaucaggaaaauaccgagacuuccaaguuguacuaucaaaaauccuaauaaaccaaaaaguaaucgacgaugguaugauauucacaauaggaucuaaaucauacaaacauaacgcaaaacaaguagucuuauccgauaacagcauacaaauagugagcacccuuucaagaaucucagacaaagaaaaacuaaucacaguauuugaugaaauaguagacauaacgaguaaauacuuaccaugguacaaaguaaacgacguagagaaaacgaaaaugcuauucaggcaaaugcaagauauugacgaaaugaaaaagauuauagacaauagucuuauaggcuuacacugcaacgcaagcauaacagauuuaggaaaaguaggcuuaaguaaguacuggggaagauucguauuaacagcagguauaaguuuaacaguagacgcccaauuaauauaucagucaccaaccggacuguuugaacauagagucaagguaucggauuuauga

SEQ ID NO: 5260 - RNA, 3990 nt, Artificial Sequence
  Cas9 variant
augaacaaacaaccuuauaacaucggacuggacauuggcaccucauccgugggauggagugccacagaacuagacaacaggcuacuucauauaaaaggacauaacgguauuggaguacgucuuuucaaagaaggcgaaucggcggcugacaggagaggauucagaacaacccgacgaaggcuugcaagacgaaaauggcgacucagacuccuaaaugaaauauuugccacugaaaucgccaaaguugauccuucauucuucgcaagacucaaacaaagcaacguaaguccaaaagaccccaauaaaacaauguucggaaacauacuuuuugacgaugaaaaccuggaugaucaaaaauuucaucaugacuauaagacuaucuaucaccucagacaagcaauaauaaaccauccugagcaaaaauucgacauaagguuaauauaucuagcaaugcaccacauaauaaaauaucgaggucauuuucuaaaccaagcaaauguacaagauuucaagggaggcaaaauagauuuagaaaaaucuuuuaaagccuuaaaugacauauucgaaaaucaagggagagaucuuagauuaguaacugacgaggcaaaucaauacgucaaaguacucuccgauaacgcaaaaacucgaucagaccguaaaaaagaacuaucuaagcuucuguauguaccaauagauaaagacacagacaagaacucuaaaaaagucacaggagaaauacuaaaagcuauucuuggaaauaaagcaaaauucgauguuaucuucggcauagaaguagaaaaccccaaagaauggguauuaacuuucaacagugacgacuuugaugauaaaauagaaggacucuccucacaaaugacagacgaagauucagaaauccuauuaauacuaaaagaauuguauuucgcuuuaaaucuaagugacauucuaaauaacucuguuaccgauaagaaugcaaaaacuuuaucagaagcuaugauaaauagauacgaugaccauaaaaaccaacuagcgaugcuaaaaaaaguaauagacucaucagacaaaaaacacgcaaaagagcuaaaagaagcauauucagccuauaucgauggcgaaaauaacaaaaaaaucagcuucgaagaccucaaaaaaagaauacaaaaaaaucuagucgauucagaguuaagucaaaaaaucaaugaccuacucgaccaugauuauuuccucccaaaacaaagaucuaaggaaaauggagcuaucccucaucaauuacaacaacaagaauuagaccaaauuauagaaucucaaaaacaauauuaucccuuucuagccgaacuaaacccaaaugaaaaacguagcagacaagcaaaauacaaacuagacgaauuaguagcuuuucgaguuucuuauuacgucggcccaaugguagaaguaacugacagcaaccaagaaaacaauggcaaauucgcauggaugauuagaaaagaacaaggagaaauaacuccauggaauuuugacgagaaagucgaucgaacagaaacagcuacaaaauucauuacacgcaugacuacaaccgacacauaucuaaucggugaaccaguacucccgaaaaauagucuccucuaccagaaauuuguaguacugaaugaacuaaacaauuugaaaauaaaccaagaaaccauaacaccuggacaaaaacaauacuuauaugaacaugucaugaaaaaaaacaagcgcguaacuuuaaagaaaauagcagacgcauuagugauaaaaggugauuaccccuacgcacccgaaguuaaagguacgacggaccagaaaaauuuaaauaacggccucaccaccuacauugacuuagccaaaaucuucggaaacgaacuagaugacgucgaccgcgaagccgacuuugaaaaaaucauagaauggucuacaauauucgaagaccaacacauauucgucuuaaaacuacaagaacuaaaauggcuaacagaaaaacaaagaaaucaaguuguuaaacuccguuaccaaggauggggaaaacuaucgaaagaacuacuugccggacuuguagacgacaacggacagaggaucaucgaccuucuauggucugacaaccaaaacuuuaugcaaaucguaaaccaaaaauccuuuaaagaaucuauagcugaucauaauggagcacaucucgaagagaaaaaccugaaagacguaauaaacgaucucuauaccuccccacaaaauaaaaaagccauacgccaaguuauacuaguagucgacgauauuaucaacgcaguaggauacgaaccagcuaacaucaugauggaauucgcacgagaagauucaaaugaccacaggcuaacaaacucacguaguagacaacuugaaaaugucuacaaagauauaacuaauuccugguuugauaacgacuccguaaaagaugagcuagaagacaaaauaaaaaauaaagacaaauuuacagaccgauuauacuuauauuuuacacaaggaggcaaagauuuauauacuggcgaaccgcuaaacauagacgacuuaucgucauacgacauagaucauauauuaccgcaauccuuuauacuagacaauucauuagacaaccgcguccuuacuucacagcgaaauaauagaguaaguaaagaagaucagcuuccgggagaauuauucgggacuaaaaugcacgccuucuggaaaagauugaaagcagcucaccucauuucaaauaaaaaauacuauaaucuaacauuaacaccaaauagcauaucuaaauuuaacaaucaaggcagauuuauaaaucggcagcuaguagaaacacgacaaguaauaaagcuagcagcagaaauacuccacaaccguuacagcgaagaaaaaggaacuaauaucguaacgauuaaagcaaacuuaacacaccacaugcgagaaaaauucaacuuuuacaaaaacagaaauguaaacgauuaccaccacgcauuugacgcauaccucacagcuuuugucgguaauuggcuuuuacaacaauacccaaaauuaaaaccauacuuuguuuauggagacuucgcgaaaacagaaauaaauaauuuaaaaaguuuuaauaugcucuauaaauucgaacaagcacaccaacuuaacgaaaaagacgguaaaaucgccaaagauaccgacgcacuacuaggcuauaugaaaaauguauaucauuuuaaaaaaaugcuuguaaccaaagaacuggaaacuaaucacggcgcccuauuuaaccaaacacucuacccuucaccagcacaugacauaaaaaaacgacaguuaauaaaaccaaaggacaaucggccuaccgauauauacggaggauauacccaugaagaaagaaaauacaugucccuagucaaaguaauugggaagaaagauaacgaauaccguauggcgaacgucccacuccugaaaaucaacaagaacaacgauauuaaagaaauccuaaaaucacaauuuucaaacaagaaguuugaaaucguacuuccuaaaguacuaaaaaaucaacuauucucagaaaacggugcccuguucgugaucggauccaaaggauauaaauacaaugcaaaccaacuaguccucucugaccuugacaugaaacuccucaaugaccugucuaauaacaagaguauagaugaaguaacaauuaaccaacucuucaaaaauaucguagauagcacuaacaaauauaugcccuuauacgaaauaaaaaacuuaaacgaagucguagaaaaauuuaacaaccuagaauuuaaugauaaaaaaaaaacuauaacugacuuccuacuugcuacccacgcaaacccaacgaugagcaacuuaaaaaauauaggacuaccuuacuucggacgauucaucagaaacacagguaucaaguuauccgaaaaugccaacguaaucuaccaauccccaacaggacucuucuccaggaaaaucaaaauauccgacuucuga

SEQ ID NO: 5261 - RNA, 3993 nt, Artificial Sequence
  Cas9 variant
augaaaaacgacuauaccauaggacuagauaucgguacgaacucaguaggauauucuguaguaacagacgauuauaaaguaauauccaaaaaaaugaacguuuucggaaauaccgagaaaaaaagcaucaagaagaacuuuuggggagugcgccuuuuugaaucaggacaaacagcccaagaagcgcgcaugaaaagaacgucacggcgacgaauagcacgucgaaaaaacagaauuuguuaccuacaagaaaucuuccagccagaaaugaaucacuuagauaacaacuucuuuuauagauuaaacgaauccuuccuaguagccgacgacgcgaaauaugacaaacauccuauuuuugguacucuggaugaggagauccauuuccaugaacaauucccaacaaucuaucacuuaaggaaauacuuggcagacggagacgaaaaagcagaucuacgucuagucuacuuagcaauagcacauaucauaaaauuccgcggaaauuucuuaauagaaggagaacuaaauacggaaaacaauagcgucauagaacuauccaaaguauuugugcaauuauauaaucaaacgcucagcgagcuagaggguuuucaauuuauagaugaaucgauugacuuuagcgaagugcuaacucaacaacucucaaaaagcgaacgagcagacaauguacucaaacuauuuccagacgaaaaaggaacaggaauuuuugcgcaauucauaaaauuaauagucgguaaccaaggaaacuuuaaaaaaguauuccaacuugaggaagaccaaaaauuacaacuaucuacagacgacuacgaggaaaauauugaaaacuuguuagccauaauaggagacgaguacggagauauauuuguagccgcacaaaaucuauaucaagcaauauuacucgcaggcaucuuaacaucaaccgaaaaaaccagggcuaaauugagugcaucaaugauacaaagauaugaagaacacgcaaaagaucuaaaguuauuaaaacgcuucguaaaagagcacauaccagacaaauacgcugaaaucuucaacgaugccacaaaaaacggcuacgccgguuacauagaugggaaaaccaaagaagaagaauucuauaaauauuuaaaaacuacucuaguucaaaaaaguggauaccaauacuuuauagaaaaaauagaacaagaaaauuuuuuaagaaaacaacgaauuuacgacaacggugugauaccacaccagguacaugccgaagaacugagagcaauucucaggaaacaagaaaaauacuacuccuucuuaaaagaaaaccacgaaaagauugaacagauauuuaaaguccguaucccguauuauguagguccucuagcaaaacacaaugaacaaucacgcuucgccuggaacauuagaaaaucagacgaacccauuaggccauggaauaugaaugacgucguagacgagaacgcaagugcaguugcauucauagaaaggaugacaauaaaagacauauaccuaaacgaaaacguacugccccgccacaguuuaauauacgaaaaauucaccguuuuuaacgaacuaacaaaaguccucuaugcagacgauaggggaguauuucaaagauuuucugccgaagaaaaggaagauauauucgagaaacuuuuuaaaucagaaaggaaagugacaaaaaaaaagcuagaaaauuauuugcguauagaacuaucuauuucgucaccuagcgucaaagguauagaagaacaauucaaugcuaauuucggcacauaucucgacuuaaaaaaauuugacgagcuccauccauaucuagacgaugaaaaauaucaagauaccuuggaagaaguaaucaaaguacuuaccguuuucgaagauagaucaaugauccaaaaccaacuagaacaacucccuuuaaaccuaagcacaaaaacaaucaaagcauuaucccgacgcaaauauacaggauggggaagacuauccgcgcgccuaaucgaugguauccacgauaaaaauagcgguaaaacaauauuagacuaccucauagaagacgaauccgauucauauaucguaaauaggaacuucaugcaauuaauaaaugacgaucauuuaucauuuaaaaaaauaauagaggacucacaaccuuacaaagaacaacaaagcgccgaagaaauuguuuccgaacuauccggcaguccagccaucaagaaaggaauuuuacagucuuuaaaaauaguugaugaacuaguugcaauaaugggauauaaaccaaaaaauauaguuguagaaauggcucgggaaaaccaaacuacgggaagaggaaaacagaacuccaaaccaagauuaaaaggaaucgaaaauggacuaaaagaguucucggauaguguacuaaaagguuccagcauagauaauaagcaacuacaaaacgaucgacucuauuuauacuacuuacaaaacgguaaagauauguauacaggucaugaacucgauaucgaccaccuaucaacauaugauauagaccauaucauaccucaaucauuucuaacagacaacagcauagauaacagaguacucaccaccucuaaaagcaacagagggaagagcgacaacguaccaucagaagagguuguccgaaaaauggaccgcuuuuggcgaaaacuccuaaacgcaaaauuaauuucagaacgaaaauacacaaauuuaaccaaaaaagaacuuacagaaucagauaaagcaggcuuccuaaaaagacaacucguugaaacaaggcaaauaacaaaacacguagcaacaauacuagauuccaaauucaaugaagauucaaauaaucgagacguucaaauaauaacgcuaaaaagugcauuaguguccgaguuucggaaaacauuuaaccucuauaaagucagagaaauaaaugaucuucaucacgcacacgaugcauaccuaaaugcaguaguagccuuaagcuuacuacgaguauauccucagcucaaaccggaauucguguacggcgaauacggaaaaaacuccauucacgaccagaacaaagcaaccauaaaaaaacaguuuuacuccaauauaacacgguacuucgcauccaaagacuacauuauuaacgaugauggugaaauacuauggaauaaacaagaaaccauagcccaagucaucaaaacacuaggaaugcaccaagucaauguaguaaaaaaaguggaaauacaaaaaggaggauucucaaaagaaaguauacaaccaaaaggagaaagucaaaaacuuauacgccgaaaacaacaauggaacacaaaaaaauauggaggcuucgacucuccaguaguagcauacgcgauacuauugucuuucgacaaagguaaacgaaaagcacguagcuucaaaauaguuggaauaaccauccaggaccgagaaucguucgaaggaaauccuauacucuaccuaucaaaaaaggauuaucacaacccgaaaguagaagcaauucuacccaaauauucccuauucgaauuugaaaauggcagaagacgcaugguagcgagcgcauccgaaacccaaaaaggaaaccaacuuauaauaccaggacacuuaauggagcuacuauaccacucaaagaaaauaaucaaugggaaaaauucagauucaguuucuuauauccaaaauaacaaggagaaauucagagagauauuugaauacaucguugacuuuucaucuaaauacauaucggcagaugcaaauuuaaacaaaauagaaaaaauuuucgaaaacaacuuccauaaagcauccgaacaggagauagcaaaaucauucauuaaucuucucacauucacggcaaugggugcaccagcagauuucgaauucuucggagaaaaaauaccaagaaaacgauauguaucaauauccgaaauaauagacgcuguguucauacaccagagcauaacuggacuauacgaaaccagaguaagacuaaccgaaguauga

SEQ ID NO: 5262 - RNA, 3993 nt, Artificial Sequence
  Cas9 variant
auggaaaaagaauauaccauaggacuagauauagguaccaauucuguaggcugggcgguacucacagacgacuaucgauuagucgcacgaaaaaugucaauccaaggugacuccaaucguaaaaaaauaaaaaaaaacuucuggggagcaagauuauucgaagaagguaaaaccgcacaauuuagacgaauuaaaagaaccaaccgaagacgcaucgccaggagaagacaaagggugcucgcauugcaagauaucuuugcagaagaaauccacaaaaaggaccccaacuuuuuugcacgacuagaagaaggagauagagucgaagccgacaaacgcuucgcuaaauuuccaguauuugccacacuauccgaggaaaaaaacuaucaccgacaauacccaacuauauaccacuuaagacaugacuuagcaaauucuaaagaacaggcggauauuagacuggucuaccuagcaauagcacauugcuuaaaauacaggggacauuuccucuuugaaggagaacuagauacggaaaauaccuccgucacagaaaacuaucagcaauuucuucaagcauaccaacaauuuuuuccugaaccuauaggugacuuagacgacgcagucccaauacuaacagaacgcuuauccaaagcaaaacgagucgaaaaaguacucgcauacuacccaagugaaaaaucaaccggaaacuucgcucaguuucucaagcuaaugguaggaaaucaagccaauuuuaaaaaaacauuugaccucgaagaagaaaugaaacuuaauuucacacgcgacuguuaugaagaggauuugaacgaauuauuagaaaagacgucagacgacuaugccgaacuauucuuaaaagcuaaaggaguauaugacgcaauacuccugucccaaauacugaguaaaagcgacgacgaaaccaaggccaaacucagugcaaacaugaagcuaagauucgaagaacaucaacgagacuuaaaacaacucaaggaauuaguuagaagagauuuaccuaaaaaauacgacgacuucuucaaaaaccguucuaaaaacggauaugcaggauacguaaaaggaaaagcaacacaggaagauuuuuacaaauuucuaagaacagaacucgccggacuugaggaaucacaaagcauaauggagaaaaucgauuuagaaaucuacuugcugaaacaaagaacuuuugcaaauggaguaauaccccaccaaauacaccucguagaaaugagagaaauaauggaccgacaaaagagauucuaucccuuccuaaaaggagcccagggcaagauugaaaaacuccucacuuuuagaauaccauacuacguaggaccucucgcccaagaaggacaaaguccuuucgcguggauuaaaagaaaaucuccaucccaaauaaccccauggaauuucgcagaaguagucgacaaggaaaauucagcaauagaauuuauugaaaggaugaccaaccaagacacauaccuaccuaaagaaaagguuuuaccuaaacaaucauuaaucuaucaaagauucaugauuuuuaacgaacuaacaaaaguuucauacacugacgaaagaggaaaaagccacuacuucucgucggaacaaaaaagaaaaauauuuaaugaacuauucaaacaacauccaagaguuaccgaaaaacagcuuagaaaguuucucgagcuaaacgaacaaaucgauuccaccgaaaucaaaggaauugaaaccagcuucaaugcaaguuauucuacuuaucacgauuuacucaaacucagcgaccaaauggauacacuauuagacgauccagauaugacaacuauguuugaagaaauuauuaaaaucuugaccauuuucgaagauagagaaaugauacgagaacaacugaaaccguacgaaacagucuuagguuuaccugccauaaaaaaacuagccaaaaaacacuauacgggauggggcagguuaucagaaaaaaugauccaagguaugagggaaaaacaaucaagaaaaaccauauuagacuaucugauugacgacgacgacuuuccgugcaaccgcaaucgaaacuucaugcaacuaauaaaugaugaccaccuauccuuuaaagaaaccaucgccaacgaauugauaaugucagacucuaauguccuccuagaucaggucaaagcuauacccggaucaccagcaguaaaaaaaggaauauggcaaagcauaaaaauaguagaagaaaucauagggauaauaggcaaagcaccaaagaauauagucauugaaauggcccgugaaaaucaaagaacuucacgcucaagaccaagauuaaaagccuuagaagaagcucuaaaaaauauugacaguccccuccuaaaagacuacccuacagauaaucaagcacuacaaaaagauagacuauaucuauauuaccuacaaaacgggaaagacauguacacuggagaaccacuagaaauucaccgacuaagcgaguaugacauugaucauaucauaccaagaucguuuauagucgacaauucgcuagacaauaaaguacuugucuccuccaaaguaaaccgaggaaaguuagacaacgcucccgacccguuagucgugaagcgaaugagaucacauugggaaaaacuacaccaagcaaaauugaucucagacaaaaaacuagcuaaccuuaccaaacaaaacuuaacugaagcagauaaagcucgcuucauacaaagacaguuaguagagacaagacaaauaacuaaacauguagcaaaucuacuccaucagcauuuuaacuugccagaagaagugucagcaacagaaaaaaccucaauaauaacauuaaaaaguacacuaacaucacaauuccgacaaauguuugacauuuauaaaguacgcgaaauaaaccaccaccaucacgcucacgaugcuuaccuaaacggagucguagcuaugacauuacucaaaaaauauccgaaacuugcaccagaauucguauauggaaguuacaucaaaggagacauuaaccaaauuaacaaagcuacagcaaaaaaagaauucuacucaaauauaaugaaauuuuuugaaagcgaagagaucauaugcgaugaacaaggggaagugaucuggaacaaaaaacgcgaucuaucuaccauaaaaaaaaccauaggcgcccaccaagucaacauaguaaagaaaguugaaaaacaaaaaggaggauucuacaaagaaacaauaaauucaaaagcuaauccagaaaaacuaauaccuaggaaagcaucacuagacccauuaaaauacggaggauacggaucaccacucgucgccuacacaguuauuuuuauuuuugaaaaaggaaaacaaaaaaaaguaacuaaagguauagaagguauaacuguaauggagcaauuaagguucgaacaagaccccagagaauuccuuaagacgaaaggcuaugaaggcguuaaacaauggcugauacuuccaaaauacauucuauucgaagcccagggaggauacagaaggaugauagcuucucaccaggaaacacaaaaagcaaacucgcucauacuaccugaaaaccuaguaacccuuuuauaucaugcuagacauuacgacgaaauaaaccacaaagucucauucgauuaugugaaugcccacaaagaaggauuuaaugacauauuugacuucaucucggacuucgggguacgauacauauuagcaccucaacauuuagaaaaaaucaaaguagcuuaugaaaaaaacaaagaaguagauuuaaaagaaaugaucgacgcuauacuaagcuuauuaaaauuuacauuauuuggagcaucaguagaauucaaauuuuuugauauaaaaauacuaaaacgguacaaaucauuaacagauaucugggaggcuacaauaauuuaucaaucagucacuggacuauacgaacgaagaguugaaguucgcaaacuaugggacggagagagacuauga

SEQ ID NO: 5263 - RNA, 3996 nt, Artificial Sequence
  Cas9 variant
augaauaaacaacccuacaacauaggacuagauaucgguaccaguagcgucgguuggagcgcgaccgaacuagauaaccguuuguuacacauaaaaggacacaaugggauuggcguacgauuauuuaaagaaggcgagucagcugcugacagacgcggauucagaaccacccguagacgacuugcacgacgaaaauggagacuacgauuauugaaugaaauauucgccacagaaauagccaaaguggacccaucguucuuugcgagauuaaaacaaucaaauguaaguccuaaagauccaaacaaaacuauguucgaaaacauacuauucgaugacgaaaaucuagaugaccaaaaauuucaccacgacuacaagacaauauaucauuuacgacaagcaauuauaaaccauccagaacagaaauucgauauacgcuuaauuuaucuugcaaugcaccacauaaucaaguauaggggacauuucuuaaaucaagcuaaugugcaagacuucaagggagggaaaauagaccuagaaaaaaguuucaaagcacucaacgauauauuugagaaccaagguagggacuuaaggcuaguuacggauaaagcgaaucaauauguuaaagugcuaucagacaacgcgaaaacacguagugacagaaaaaaagaacuauccaaacucuuauacgucccaauagauaaagacacugacaaaaauucgaaaaaaguuaccggcgaaauacugaaggcaauacucggaaacaaagcuaaauucgaugugauauucggaauagaaguagaaaaucccaaagaauggguacugacauuuaacagugacgauuuugacgacaaaauagaaggacuuagcucccaaaugacagacgaagauucagaaauccuucuaauacuaaaggaacuauacuucgcgcuaaauuuaucugauauacuaaauaacaguguaacagacaaaaacgcaaaaacauuaucugaagcuaugauaaacagauacgaugaucacaaaaaccaacucgcaaugcuaaaaaaaguaauagauuccuccgauaaaaaacacgccaaggaacucaaagaagcauacuccgcauacauagacggagaaaacaacaaaaaaauaucauucgaggacuuaaaaaaacgaauccaaaaaaaucuaguagacagcgaauuaucccaaaaaauuaaugaccuauuagaccaugacuauuucuuaccaaaacaaagaucaaaagaaaauggagcaauaccccaccagcugcaacaacaagaacuugaccaaauaauagaaagccaaaaacaauacuaccccuuccucgcugaacuaaacccgaaugaaaagcgcucaagacaagcaaaauauaagcuagaugaguuaguugcauucagagucccauacuacgugggaccgaugguagaaguaacugauucaaaccaagagaacaauggaaaauucgcguggaugauaagaaaagaacaaggcgaaaucacaccauggaacuuugaugaaaaaguagauagaacugaaacugcaacgaaauuuauuaccagaaugacaaccacugauacuuaccuaauaggcgaacccguucuacccaaaaauucauugcuauaucaaaaauucguaguccuuaacgaacucaauaaccuaaaaauaaaccaggaaauaauaacuccaggacaaaaacaauaccuauacgaacacgucaugaaaaaaaacaaaagaguuacauuaaaaaaaaucgccgaugcauugguaauaaaaggugacuauccauacgcaccagaaguaaagggaacaacagaucaaaaaaauuugaacaacggauuaaccacauauauagaccuagcaaaaauauuuggaaacgaauuagacgacgucgaccgggaagcagauuucgagaaaauuauagaauggucuaccaucuucgaagaccaacauauauuugcacuuaaauuacaagaacuaaaauggcucacagaaaaacaaagaaaucaagucguaaaacuccguuaccaagggugggguaaauuaaguaaggaauuauuagcuggauuaguugacgauaacggccaaaggauaaucgaccuacuauggucggauaaccagaacuucaugcaaauaguaaaucaaaaaagcuuuaaggaaaguauagcagaucauaauggugcacaccuggaagaaaaaaaccuaaaagacguaauuaaugauuuauauacgucuccucaaaacaagaaagcaauccgucaagucauucuggucguagaugauauaauaaacgcaguuggcuacgaacccgccaacauuaugauggaauucgcccgugaagauucaaacgaccaccgucuaacaaacagccgaucucgacaacucgaaaacguauacaaagacaucacuaacucaugguuugauaacgacucaguaaaagaugaacuagaggauaaaauaaaaaacaaagacaaauucacugaucgacuguaccucuacuucacccaaggcgguaaagaucuuuacacuggagaaccacuuaacauugaugaccucucauccuaugacauagaccacauacuuccccaaucauuuauauuagauaacucgcuugacaacagaguuuuaacaucgcaaagaaacaaccgcguaucuaaagaagaccaauuaccaggugaacuauucggaacaaaaaugcaugcauucuggaaaagacuaaaagcugcacaucuaauaucaaacaaaaaauauuauaacuugacccuaacaccuaauagcauaagcaaauucaauaaucaagggcgauucaucaaucgacaacucgucgaaacaagacaggucauaaaguuagcagccgaaauacuccauaacagauauagugaagaaaaaggaacaaacauaguaacuauaaaagccaacuuaacccaccauaugagagaaaaauucaauuuuuacaaaaacagaaacgucaaugacuaucaccacgcuuucgacgccuaccuuacagcauucgugggaaacuggcuacuacagcaauacccuaaauuaaaaccauacuucguauauggcgauuuugcgaaaacagaaauuaacaauuuaaaauccuuuaacaugcucuacaaauuugaacaagcccaucaauuaaacgaaaaagacggaaaaauagcaaaggacgcagaugcacuccuaggauauaugaaaaacguauaucauuuuaaaaaaauguuaguaacaaaaaaacuagaaacaaaccacggcgcccuauucaaacaaacacuauacccaagcccagcacacgauauaaaaaaacggcaauuaauaaaaccuaaagacaaccgcccuacagauauuuauggaggauauacacaugaagaacggaaauauaugucauuaguuaaaguaauaggaaaaaaagauaacgaauaccgaauggccaaugucccacuccuaaaaauuaacaaaaauaacgauauaaaagaaauucuaaaaucccaguuuuccaacaagaaauuugaaauaguguuacccaaaguauuaaaaaaccaacuguucagcgaaaacggagccuuauuuguaauaggaucuaaaggauauaaauacaacgccaaccaauuagugcuauccgacuuagacaugaagcuacuaaacgaccugagcaacaacaaaucuaucgaugagguaacuaucaaucaacuauuuaaaaacauuguggacagcacaaauaaauacaugccguuauaugagauaaaaaacuuaaaugaggucguagaaaaauuuaauaaucucgaauuuaacgacaaaaaaaaaacaauaacagauuuccuauuagccacacacgccaacccaacaaugucaaaccuaaaaaauaucggccuccccagcuacuucggacgcuucacaagcgguaacgcaggcauuaaauuaagcgaaaacgcaaacguaauuuaucaaaguccaaccggccuauuuucaagaaaaguuaaaauaagcgacuuuuga

SEQ ID NO: 5264 - RNA, 3999 nt, Artificial Sequence
  Cas9 variant
augaaaaacagagaaaauauaaaauauuauaucggaguugauauaggaacuaauaguguaggcugggcaguuauugacgaaaauggaaaucuacuaaaaaaaggaaaacaucacuuaugggguucucgccuuuucgaccaagcccaaaccgcacaaaacagaagaaauuauagaaguucuagaagaagauauaauaaacgccgacaacgaauuggacuacugcgucuaauuaugucugacaugguacuggaaguagauccaagcuuuuucaucagacuagaaaaaaccacauuucucgauaaagaagacaaaaaagccauccuaaaagacaauuacaaaaugaacuauaaucuuuucugugacgaagacuauaacgauaagaaauacuuuaaagauuaccccacuauuuaucaucuacgaaaaaaacuaugcgaauccgacgaaaaggcugacccccgauuaauauaccuagcccuucaccauauuguaaaguacagaggcaacuuucuguacgaaggacaagaauuacaucuggaaccuucaaacaaggaagaagaccucaaaauauuauuugauauacuagguaagaauaacgacacaguuuacgacaucucagaggaacagauucaguuuauacuuaaaaccgucguagaaaacauaucaaaaaccgcuaaaguagacgagugcaugucacaacuaaagcuaaacucagaagacaaaaaaauaguuaaagaauucaugcgaggguugguaggcaacaaauucaacguaucaaaauuauacaugcaugaggaccuucaauuugaugacgaagaucuuaaacuacaguucuccgacaaauccuaugaagaaaaaauaacagaauacgaaaauguccuagaagaaaaaauggaguucaucgaucuaaugcaaagguuuuacucauggaucgaacuauccaagaucguaggaucagacucccaacacgcaucaaucaguggcgccaugguuaacaucuaugaaagccaccgugaagacuugagaacacuaaaagaagugauguuaaaaauaggaaaaaaagaauaugaugagauguuuaaaccaacuucgaagaaugucguaaacuauuacaacuaugucaacccgguagcaugcaguggagacaaaacggauggauuuuacaaauacguaaaaaaagcaauagaaaaauccgaugauucacgaaaagacgaaauacuccaaaaaauagccaacgaaacguacauguuaaaacaaacaagcaaaaauaaugcguacauuccauaucaaaugcaaaaagacgaacucaucaaaauacuagaccaucaagaaaaauauuacccaguauugaaagaaaacagagacaaaauaaucucaauccuagaauuccgaauccccuacuacuacggaccgcucgacgguaauaaacaauucggauggcuuauuaaaaaaaaagggaaagaaaacgaaagaauccuucccuggaaucaucaagaaauaguggacguacaagaaacugcggcacaauucauaaaaaaauuaacaaacuacugcacauaucucccaauagaaaaaguuaugccacaaaaaucauuaacuuguucuauguacgaaguacuaucagaaguaaauaaaaucagaauagacggaaaacuacuacccauagacacgaaaaaucguuuaauagaagacuuauucuucaaaagaaaaacagucaaagagaaagacuuaauaaauuggcuaaaacaaaaucaacuaaccguaggagagaucacaggauaccaaaaagaaaaagcauuuucgaguucauuagcuccuuggauagacuuuaaagaaauauuugaugaaauaaaugacucuaacuacgaucuaauagagaaaauaaucgaagacaugaccauauuuaaugaaggauccauccucaaggaacgacucaagaaagcauacaaccuagaccaaaauaaagucaagaaaauaaugaaauugaaauacucaggauggucgcgauuaagcaaaaagcucauaaacggaauucgcgcagauaauaaauuuggauccagcguaagcauauuagacgucaugaaagaaagccacauggcacuaauggaaaucauaaacgaucaagacuugggcuucaaacaaauaauagaaaaagaaaauuuuaaaaacgaaaccgguucauuugaauacgaagacaucgaaaauuuagcagguucuccugcgcuuaaaagaggaauauggcaaacccuucaaguaauagaagaaauaaaaaacuauaugggccacgaaccaaaaaauauuuauauugaauucgcaagagaagaacaagaaaaaguuagaacaaccacaagaguaaaaaaauuaaaaucaauauauaacgacauaaaaaaccaauuagacguacacggaaaagaaguguauagcaaucuaaauaagcaagaugaaaaaaguagcauagaaaagagacuauaucuauauuacacacaacucggcaaaugcauguacucaggagaaucacuagauauagacaaauuaucaaacuaugaaauagaucauaucuucccaaggacccucacgagcgacgacagucuagauaaucuaguauugguaaaaaaaaaagaaaaccaaagaaaacucgaugaccucguccugccacucgagauacggaauaaaauggagguauuuuggaaaaaacuauacgacaacggacuaauaacucaaacaaaauacuaccgguuaaugagagacgaauuucguagagaucaaauagacaaauucaucaauagacaauuagucgaaacgcgacaaauaauaaaacauguagcaaauauaauugaaaaccacuacgaggacacuaaaguuuuuacgguaagagcuaaucucucccaugaauuucgagaaaaauauggcauuuacaaaaacagaaacguaaacgauuuccaucacgcacacgacgcauacaucgccugcauaauaggcagauauauacaaauaagauucccgggacuagaagcuaaauacguguacggacaguacaugcaaaaugugaaaaaaacaaaaaacaacauagacaaggaaaaccacggauuuauaauaaacucaaugaaauaugaaugcauugacgaagacacaggugaaguuaucuggaacccagaacgaauacucgauuauauaaaauguuuuaacuacagagacgucuacaucacaaaaaagcuagauacgaacaauagagaauuauuuaauguuacaauuuuaccaaaugauaaaaacucugaaaaagguaaaacaaaagcgacaauccccguaaacaaauuaagaagcaacgucagaaaauauggaggcuuuucaggacuccaguccgacauaguagcaauagaaggaaaaaaaggcaaaaagaucgauaggcgucuaauaaaccuaccgauucugcuacgauacgugucaauugaagaccaaugcaaauauauaauggagaauaauaaauacagugacguaaaaauaauaaaaaagauaaaaaagaaccaacuaauagaaauagaugguauuuguuacuaucuaaaaucggcagacgaacucgauacagcauaccaauugauucucaguagagacgacaacgagaugauauaccgaauagacagagcuauccaaaacaaugauuucuccuauuucgacaacaaaaaagaaaauauagacgagcuguacagacuaauaugucauaaaaugaucgaaaacuauccaaaauacaagaaaaaaguuuacgaguuuauaaaagagcgcgaagaggaguucuucgaauuagauaauagucaaaaauguaucgucauauucgaaaugauaagagucaugaaacgaggcgagcaauacauaaacauaccuuucgaaccuuacaaccuuaagaaugacagaaaaggaagacuaaauugucaaagcauucuguuagauaauacuuacuucuaugacguuucaaucaccggcauauauucuaagaaguauaaauuauga

SEQ ID NO: 5265 - RNA, 3999 nt, Artificial Sequence
  Cas9 variant
augcagaaaaauuauacaauaggacucgacauaggaacaaacucaguaggaugggccguuaugaaggacgauuauacacuaauaagaaaacgaaugaaaguucuaggaaauacugacauaaagaaaauaaagaaaaauuuuuggggcguacgcuuauucgacgaaggcgaaacagcgaaagaaaccagacuaaaaagaggaacacgaagaagauaccaaagaagacguaaccgucucauauacuuacaagacauuuuccaacaaccaaugcuagcaauagaugaaaacuucuuccaucgucuagacgacucauucuuugugccugaugacaaaaguuacgacagacauccaauuuuuggcucauuagaagaagaagucgccuaucauaacaccuauccaaccauauaucaccuacgcaaacauuuagccgacaauccagaaaaagccgaccuaaggcuagucuacacagcucuugcacacauagucaaguaccgaggccacuuucuaaucgaaggggaacucaauacagaaaauacaagcaucucagaaacguucgagcaauucuuagauacuuacucagacauauuuaaagaacaauuagugggcgacauaucaaaagucgaagaaauacucaguagcaaacaauccaggagccguaaacacgagcaaauaauggccuuauucccaaaugaaaauaaauuaggcaacuucgggagauuuaugauguuaauuguuggcaauaccaguaacuucaaaccaguuuucgauuuggaugacgaguauaaacuaaaacuauccgacgaaacuuacgaagaagaccuagauacacuacuggguaugacagacgacguauuucuagacguauuuauggcagccaaaaauguguacgaugcaguagaaaugucagcuauaauuaguacugacacaggaaacaguaaagcgguucuaucuaaccaaaugaucaauuuuuacgacgaacauaaaguugaucuagcucaauuaaaacaauucuucaaaacacacuuaccugauaaauacuacgaaugcuuuucagauccaaguaaaaacgguuacgcaggauauauugauggaaaaacaaaucaagaggacuucuacaaauacaucgaaaaaguaaugaagacgauaaaaucagauaagaaagacuacuuuuuagauaaaauagacagagagguuuuucugaggaaacaacgaaguuuuuauaacagcguaauaccacaccaaauucaucuacaagaaaugcaagcaauacuagacagacaaucccaauauuaucccuucuuagcggaaaaucgugacaaaauagaaucucugguaacauucagaauaccauauuaugucgggccacuaacaguuagcgaccaaucagaauuugcauggauggaaagacaauccgaugaaccaauaaggccauggaacuucgacgaaauaguuaauaaagaaagaagcgcagagaaauucauagaaagaaugaccaacauggacaccuacuuauuggaagaaaaaguauuacccaaaaggucacuccucuaccaaaccuuugaaguauacaaugaacuuaccaagguacguuacacaaaugaacaaggaaaaacugaaaaacuaaacaggcaacaaaaagccgagauuauugagacccuauucaaacagaaaaaccgaguaagggaaaaggacauagcaaauuaccuagaacaauacggcuacguggauggcacugauaucaaaggaguagaagauaaauucaacgcaaguuuaaguacuuacaaugaccuggcaaaaaucgauggggcaaaagcauaccuagaugacccugaauaugcagacguaugggaagauauaauaaaaauauuaacaauuuucgaagauaaagccaugagaaagaaacaacuacaaacauacucagacacccucucgcccgaaauacuaaagaaacuagagcgaaaacauuauacgggauggggaagauuuuccaaaaagcugaucaacggauuaagagacgaaggcagcaauaaaacgauacucgauuacuuaaaaucugaugaaggaucaucaggacccacaaacagaaacuuuaugcaauuaauacgggauaacacucucagcuucaaaaagaaaauagaagacgcacaaacaauagaagacacuacgcauaucuaugacaccguugcagaacuaccaggaaguccugcgauaaagaaaggcauucgacaagcucuaaaaauaguugaagaaauaauagacauaaucggauacgaaccagagaacauaguaguagaaauggcucgagaaucacaaacaaccaagaaaggaaaagaccuaucaaaagaacguuuagaaaaacuaaccgaagcgauaaaagaguucgauggaccuagugaugucaaagugaaagauuuaaagaacgaaaaccuaagaaacgaccgccuauauuuauauuaccuucaaaacggacgagauauguacacaaaugaaccgcuagacauaaauaauuuaucaaaauacgauauagaccacauaauuccucaaucauucacaacagauaacucuauagacaacaaaguccucguuagcaggacuaaaaaucaagggaacaaaucugaugauguaccuucaaucaacauugugcauaaaaugaaaccauucuggcgacaauuacacaaagcuggucugauaucagaucgcaaauucaaaaaucuaacaaaagcagaacacggcggcuugacagaagccgacagagcgcacuuccuuaacagacaauuaguagaaacaagacaaauuacaaaacauguagccaaucuguuagacagucaauacaauacagcagaagaacaaagaaucaauaucgugcuuuuaaaauccucuaugacuucaagauucagaaaagaguucaaacuauacaaaguucgagaaauaaacgauuaucaccacggccaugacgccuaccuuaaugcaguaguagcaacaacaaucaugaaaguauaccccaaucuuaaaccccaauuuguauacgggcaauacaagaaaacauccauguuuaaagaagaaaaagcuacagcccggaaacacuucuacucaaacauaacaaaauucuucaagaaagaaaaaguaguaaacgaagaaacaggugaaauccuaugggauacagaacgccauuuaucaacuauaaaaaggguuuuguccuggaaacaaaugaacauagugaagaaaguagaaaaacaaaaagggcaacucuggaaagaaacaaucuacccuaaaggugacuccuccaaauugauaccaguuaaagaaggaauggacccacaaaaauacggaggauuaagucaaguaucugaagccuuugccguaguaaucacucacgaaaaaggaaagaagaaacaauuaaaaagugacuuaauuucuaucccaauuguagaccaaaaagcauaugaacaacaccccacagcauauuuagaagaagcuggauauaacaacccaacuguacuacaugaauuauucaaauaucaguuauuugaauuagaagauggaucacgacgaaugauagccucagccaaagaauuucaaaaaggcaaccaaauggucuuacccuuggaauuagucgaacugcuuuaccacgcuaacagauacgauaaaguuaaauucccugacagcauagaauacguucaugauaaucuagccaaauuugacgaucuucuggaauauguaauagacuuuucaaacaaauacauuaaugcugauaaaaauguacagaaaauccagaaaauauacaaagaacacggaacagaagaugucgaauuaacaguagaaucauucguaaaccuaaugacauuuaccgcuaugggcgcaccagcuacuuucaaauuuuacggagaaucaauaacaagaucuagauacacuucaaucacggaguuccgaggaaguacacugaucuuucaaucaauaacaggucuauacgaaacccgauauaaacuagaagauaacuga

SEQ ID NO: 5266 - RNA, 3999 nt, Artificial Sequence
  Cas9 variant
augaugaaagaguauaguaucggauuagacauaggcucuaguagcguuggauucguggcaguagaugaucaauaccgaguagugagagcaaaagggaaaaacgucaucggcaccagacuauuugacgagggcaaaacagcagcagaucgaagaggauugcgaacaacgcgucgcagauuauccagaaggaaauggagauugagacuccuacgggggaucuucgaaccgcauauaaacgaaauagaugaauccuucuuuaugcgguuaaaagaauccaauaucucgccgaaagauucaaacaaacacuuuccaggagacauauuauuuaaugauagaucagaucgagaguuuuacgagaauuacccaacaauuuaccaucuacgacaggcacuaaaaacugagaaaagacaauuugauauacgcgaaauauaccuugcaaugcaccacauagugaaauauagggggcacuuuuuggagggcggaacggugacagacuuugaagucggcgaacuugacuuagcgggaaaguuuagcagacucaaugaacuauuugaaaguauaaaucuagaaguucccuucguuuuaagacuagacaaucuagaagacguaaaagcaguucuuauagacucacaacguagugcccaagaucgacaacgaacgcuaacaccagauauuuacguaccauccacagacaaaaucacagagaaaagauuuaaaggaauagcaacggaauuauuaaaagcaaucgucggaaauaaagcuaaauuugacguuuuagcaggauuagaacuugacaaagaagaagcaaaauuaugggcacuuacauucgauucggaaaccuuugacgaagacaucgaacaacuagaaggagauaugacugaagcaacgcaagaccuaauagaaauucuaaaaucauuaagaucauuaauaagauuagcaguaaacaugccagaaggaguaucauuaagcgaaaugaugauacaaagauaugaagaucaugcagaucacuuaaaauugcucagagacauuauacacaauacugaugcugaaaaagcagccggauugcaagcagcuuacgauggauacauugauggaguaaaagguaagaaaacaccaguagacgauuuuuauaaagcuauaaagaaaaaucuggaugauagcgaggcagcacaccaaauccuggcguuaauagauaaaaacgaguucaugcccaaacaaaggucgaaaagcaauggcuggauaccccaucaaauacaacaaaaagaauuagauagaaucauagaaaaccaaaaacaauacuauccauggcuggcagauguaaaccccaaugaaucaagaagaaaaguugcaccuuauaaaauagacgaauugguaacauucaggguaccauacuauguaggccccuuagugaccagugaagaacaaaagaaauauggcucaaaauucgcauggaugguacgaaaagaagaaaaaggugaaauaacuccuuggaacuucgaucagaaagucgaccgugccgcaagcgcuacugaguucauuaacagaaugacaacuauggauacauaccucuuaaaugaagauguauuacccgcgcauucauuaauuuaucaaaaauaugaaguccuaaaugaacuuaacaaagugaaaauaaauggagaugccauaacacccgaauugaaacagaaaauauaccaugauuuauuugaaaaacaaacaacaguaagcaucaaaaacuuacaaacauauuuaguaucagaauccgaagcaagcgaaguaccagaaauaaaaggacuagcagacgaaaagaaauuucuuagcggucugacaacguaucacgaccuaaugaaaauauucgaccguaacguaguaaacgaucccgaacgugcagaagauuucgagaaaaucauaagauggucuacagucuucgaagacaaacacauuuauagagaaaaauuagauucauugagcugguugacaacugaccaaaaagauaggcucgcaguaaaacgguauagaggguggggaagacucagcgaaaaauuacuaauaggauuaagagaugaaggacaccgaucaauaauggacuauuuaugggaaaccacuagcaauuucaugcagauccaggcacaaaacgauuucucggagaaaauugcagcagaaaauaaagaauuuuuagauaauacacaaagugugcaagguauaauaaaugaauuauacacaucgccacaaaacaagaaagccauaagacaaacauuauuaguaguggaagacauuaaaaaggcauuccacggagaagcaccaaaaagaauuuuuguagaauuugcucgagaaaacgaaaguacaccacaaagaucaauacaaagacaaagacaaguagaaaaugcauacgaaaaaguuacccaaaauuuacugguagaugacaaaaucagagcugaauuaaaggacagcauaaaugagaaaagguuauuucaugaucgacucuuccuauacuuuaugcaaggaggcauagacauguauagcgguaagaaaauuaauauagacaaccuaagugcguaugacaucgaccauauacuaccacaaucguucacaguugacaauagucuugacaauagaguccuuacaaaucagaaagacaaccgagaaaaagguaauucucuuccaagcgaauuauauagagguagcaugaaagaaaccugggaaaugaugaggaaucaaggacuacuaucaaaagguaaguuccaccgauuaaugaugacaccaaacaguaugacagccuaugaccaacaaggcuucaucaaccgacagcuaguagaaacaagacaagugauuaaacucgcugucgaaauucuugcauccgaauuugaucaagcagacgagaaaguagaaauagucagugucaaagcgggucucacacaucaaaugcgacaagacuuuagccuaauuaaaaauagagacguaaaugacuaucaccacgcauuugacgcauaucuaacagcauucguagggacauacuuauugaagagauauccaaaacuacgaccauauuuugucuauggugaauuuaaaaaguuuagucaaaagcaagcaaauuuaaccaacuuuaacuuuuuaugggcguuaaaacauaaggaccaaguagcuguagaagauacaggcgagaaaauauggaauaaaccccaggauuuagcguacauaagacaucuuuuugcauuuaagaaaauacuaauuucaagagaaguaucagaaaggcacggagcacuauuugaucaaacacuauacaaagcgucagaugauaaagcaucuggacaaggcucgaagaaacuaauaccugcaaaagauaacagaccaaccgaauuguaugguggauauucuggacaaacauccgcauucauggcaauaguaaagguaaccaaagguaaaaagacaaaauaccuaguaguuggaguaccaacagcagcuauuagucaacuacagggaauggauguaaaaagcucacaguacaccgaaaagauauauaauauacuaaguccaaaguuauuaucuaaaaacgaugauuucgaagugauaguuccaaaaguuagauacagacaacuaauauuagauaacaaccaauuauucacuuuaggaucagacacauauaaauacaacgcgcgccaacuuguccuuucuaacgaaguauuagcagugauaaaucgugauaaauccuuuauagauaagaaacuaucagaagaagcagaaaaccaagcacuaaacgacgccuuugaugaaauagucguagcaauggacaaacacuuugaccuauacgauaaaaacggcuuuagagaaaaaguaaaagcggguaaacaaagguucgaagaacuccccguguccuuauucucagaagacaaagaaaaugaaggaauuacaaaacgcacagucuuaaaaaggauucuacaaggauuacacgcaaacgcaaccacaucugauuuaaaaguacuagacggaaaauucuauaauuga

SEQ ID NO: 5267 - RNA, 4002 nt, Artificial Sequence
  Cas9 variant
augaaaaauuauacaaucggucuagauauagguguagcgucaguugguuggguaugcauagacgaaaacuacaaaauuuugaauuacaacaaucgccacgcuuucggaguacaugaauuugaaucagcagaaucagcagcaggaagacgacuaaaaagagguaugagacgaagauacaauagaagaaagaaacguuuacaauuauugcaaucguuauucgacucguacauaacagacucaggguucuuuaguaaaacagauagccaacauuucuggaaaaauaauaaugaguucgagaaucgaucacuuacggagguucuuagcucgcuccguaucucuucaagaaaauaccccacaauauaucacuuaagaucagauuuaauugaaucaaacaagaaaauggaucuuagauuagucuacuuggcucuacauaacuuagugaaauauagagggcauuuccugcaagaaggaaacuggucagaagcagcgagugccgaaggaauggacgaucaacuacuagaauuaguaaccagauaugcagaacuagagaaucucucaccacuugaccucucagaaucgcaguggaaagccgcagagacucugcucuuaaaucgaaacuuaacaaaaacagaucaaucaaaagaacugacagcgauguucggcaaagaauacgagccauuuugcaagcuaguagccgggcucggggucagcuuacaucaauuguuuccgucaagcgaacaagcgcuagccuacaaagaaacaaaaacuaaaguacaacucagcaaugaaaaugucgaagaaguaauggaacuauuacuggaagaagaauccgcauuacuugaagcuguucaaccauucuaucaacaagugguauuauacgaauuauuaaaaggcgaaaccuacguugcaaaagccaaagucagcgcguucaaacaauaccaaaaagacauggccagucuaaagaaccuacuagauaaaacuuucggagaaaaagucuaccguagcuauuucaucucagauaaaaacucucaacgagaauaccaaaaaucacacaaaguugaaguauuauguaaacuagaucaauuuaauaaagaagcuaaauuugcagaaaccuuuuauaaagaccuaaagaaacuacuagaagauaaaagcaaaacaaguaucggaacaacugaaaaagacgaaaugcugagaauuauaaaagcaauagacaguaaccaauucuugcaaaaacaaaaaggcauacaaaacgcagcaauaccgcaucaaaacucacuauacgaagcagagaaaaucuugagaaaccaacaagcacacuacccguucauaacaaccgaauggauugaaaaagugaaacaaauacuagcuuuucguauucccuauuacaucggcccucuagugaaagauacuacacaaucaccauucuccuggguagaaagaaaaggugacgccccaauaacuccauggaacuucgaugaacaaaucgacaaggcugcaucagcagaggcauuuauaucaagaaugagaaaaaccuguacauaucuuaaaggacaagaaguguuaccaaaaucaucacugacauaugaaagguuugaagucuuaaacgaauuaaacggcauucaacuaagaacuacuggagcugaaucagauuuucgccacagacuaagcuaugaaaugaaauguuggauaauagauaaugucuucaaacaauacaaaacuguaaguacaaaaagauuacugcaagagcugaaaaagagcccauacgcagaugaauuauacgacgaacauacaggagaaauuaaagaaguuuucgggacucaaaaagaaaacgcauuugcaacuagcuugucaggauacauaucaaugaaaucaauucuaggugcaguaguagacgauaacccugcaaugacagaagaacuuauuuacuggaucgcaguauuugaagacagagagauauuacacuuaaaaauacaagaaaaauauccaucaauuaccgauguacaaagacagaaacuagcguuaguaaaacucccaggaugggguagguucucuagauuacucauagaugggcuaccccuggacgaacaagggcaaaguguacuagaccauauggaacaauacagcucaguauucauggaaguacugaaaaauaaaggauucggauuagagaaaaagauacagaaaaugaaccaacaucaaguggacggaacaaagaaaauucguuaugaagacauagaagaacuugcagggagccccgcacuaaaaagaggcauauggcgaucaguaaaaaucguugaagaauuagucucaauuuucggagaaccagcgaacauaguauuagaaguagcgagagaagauggagaaaagaaacgaaccaaaagccguaaagaccaaugggaagaacuuaccaaaacaacacucaaaaaugauccagacuuaaaauccuucauuggagaaaucaagucacaaggugaccaaagguucaaugaacaaagauuuugguuauacgucacucaacaaggaaaaugccuauacacagguaaagcgcuagacauccagaauuuauccauguaugaagucgaccauaucuuaccucaaaacuuuguaaaagaugacucacuggauaaucuagcccuuguaaugccagaagcaaaccaacguaaaaaucaagucggacaaaacaaaaugcccuuagagauaauugaggcuaaccaacaauacgcaaugcgaacacuuugggaaagauuacaugaauuaaaauuaauaucuucaggaaaacuagguagacuaaagaaacccuccuucgacgaagucgauaaagacaaauuuauagcacgacaguuaguagaaacgcgacaaaucauuaaacaugugagagaccugcuagaugaaagguucucuaaauccgacauacaucugguaaaagcagguaucgucaguaaauucagaagauuuagcgaaauacccaaaauuagagauuauaacaauaaacaucaugcgauggaugcacuauuugcagccgcauuaauacaauccauauuaggaaaauauggcaaaaauuuccuagcauuugaucucucaaagaaagaccgccaaaaacaauggagaagcguaaaaggaucgaauaaagaguucuuuuuguucaaaaauuuuggaaaccuacgacuccaaagccccgugacaggagaagaagugucaggaguagaauauaugaaacacguauauuucgaauuaccauggcagaccacaaaaaugacacaaaccggagacggaauguuuuacaaagaaucgauauuuaguccuaagguaaaacaagcgaaauauguaucuccuaaaacagaaaaauucguacacgacgaaguuaaaaaucauagcauauguuuaguagaauuuacauuuaugaagaaagaaaaagaaguucaagaaacaaaauuuauugaccuaaagguaauugagcaucaccaauuuuuaaaagaacccgaaucccaacucgcaaaauuucuugcugaaaaagaaacuaacagcccaauaauacacgcacgcauuauaagaacaauaccaaaauaccagaaaauauggaucgaacauuucccuuacuauuuuauaucaacaagagaguuacauaaugcccgacaauuugaaauaagcuacgaacucauggaaaagguaaaacaauuaucugagagaucuucaguagaagaguuaaaaauaguguucggacuccuaauugaccaaaugaaugauaauuacccuaucuauaccaaaucaaguauucaggaucggguacaaaaauuuguagacacacaacuguacgauuuuaagagcuuugaaauaggauucgaggaauuaaagaaagcaguagcagcaaacgcccaacgaucugacaccuuuggaucaagaauuagcaagaaaccaaaaccugaagaaguugcgauaggguacgaaucaauuacaggauuaaaauacagaaaaccaagaaguguuguagguaccaaacgauga

SEQ ID NO: 5268 - RNA, 4002 nt, Artificial Sequence
  Cas9 variant
augucacaaaauauaguugauuauuguauaggcuuagacuuaggaacuggaaguguuggaugggccguggucgacaugaaccaccgucuuaugaaaagaaacgguaaacaucuauggggauccagauuguuuagcaaugcggaaacagcagcaaacagaagagcaucacgaaguauuagaagacgauauaauaaaagacgugaacgaaucagacuccuccgagcaauuuugcaagacauggucuuagaaaaugaccccacauucuuuauaagacucgaacacacaucguuccuagacgaagaagacaaagcuaacuaccucggcgccgauuauaaagauaacuacaauuuauucaucgacgaggauuucaaugacuauacauauuaccacaaauacccaacaaucuaucaccuccgaaaagcacucugcgaaagcacagaaaaagcagacccacgcuuaauauauuuagcccuacaccauauagugaaauauagaggcaacuuccuauaugaaggucaaaaauuuaauauggacgcaaguaacauugaggacaggcuguccgacguuuucacacaauuugccgacuucaauaacauaccauacgaggacgacgaaaaaaaaaaccuagaaauacuagaaauauuaaaaaaaccauugucaaaaaaagcuaaaguugacgaagucauggcauuaauugccccugaaaaagacuucaaaucggcauacaaagaauuaguaacaggcauagcuggaaauaaaaugaauguaacaaagaugaucuuaugcgaaccaaucaaacaaggagauuccgaaaucaaacuaaaauucuccgacucgaacuaugacgaccaauucucagaagucgagaacgauuuaggagaauacguagaauucauugacucauuacacaacauauauuccugggucgagcuacaaacaauuaugggagcgacacauaccuauaacgccagcaucagcgaagcgauggucucuagauauaauaaacaccaugaagaucuacaacuacuuaaaaaauguauaaaagauaauguaccaaaaaaauacuuugacauguuccgaaacgacucagaaaaacuaaaaggcuauuacaacuacauaaaccacccuagcaaagcccccguugaugaauucuauaaauauguuaaaaaaugcaucgaaaaaguagauacuccagaagcuaaacaaauuuuacacgacaucgaacuagaaaauuucuuauuaaaacagaauucacgaacaaauggaagcgucccguaccaaaugcaauuagacgaaaugauuaaaauaauagauaaucaagccaaauacuacccaguucucaaggaaaaacgagagcaauuacucucaauauuaacauucaaaaucccauacuauuuuggacccuuaaacgaaacaucugaacacgcauggauaaaaagauuagaggggaaagaaaaccaacgaauacuacccuggaauuaucaagacauaguagauguggaugcgacagcagaaggauucauaaaaagaaugagaucuuauugcaccuauuucccggaugaggaagugcugcccaagaauagucuaauaguaucuaaauacgagguuuacaaugaauuaaauaagaucagagucgacgauaagcuacuagaaguagacauaaaaaaugauauauacaacgaacuuuucaugaauaacaaaacagucacagagaaaaaacuaaaaaacugguuaguaaauaaucaauguuguaacaaaaacgccgaaauaaaaggauuccaaaaagaaaaccaauucucaacaagucuuacaccuuggaucgauuucacuaauauauuuggugaaauaaaccaaaguaacuucgaucuaauagaagauauaauauaugaucucacuguauucgaagauaaaaaaauaaugaaacgcagauuaaaaaaaaaauacgcccuacccgacgacaaaaucaaacaaauauuaaaacuaaaauacaaagacuggagcagacuaucuaaaaaauuacuagacggaauaguagcagacaacaaauucggcucaucaguuacaguacucgacguauuagaaaugucccgccugaaucucauggaaauuauaaaugauagggacuuaggcuaugcucagaugauugaagcagcugcaagcuguccagaagacggaaaauuuaccuacaaagagguccaacgacuugcgggaaguccagcacucaaaagaggcauuuggcaaucucugcaaauaguugaagaaauaacgaaagugaugaagugucguccaaaauacauuuacaucgaauucgaacgaucagaagaaacaaaagaaagaacagaaucaaagauaaaaaaauuagaaaacguauauaaagauuuggacgaacagacaaaaguugaauauaaaacaguacuagaagaacuaaaaggcuucgauaauacgaaaaaaauuaguagugacagccuuuuccuauauuuuacacaacuagguaagugcauguacucaggaaaaaagcuggauauagacucuuuagacaaauaccaaauagaccacauagugccacagucacuaguaaaagacgacucuuuugauaauagaguacuaguaguaccaucagaaaaucaacgaaaacucgaugaucuaguagugccaagugauauuagagugaaaaugaacaguuucuggaaauuacuauucgaccaugagcuuauaagcccaaaaaaauucuacagcuugauuaaaacagaauacaccgaaagagaugaagagcgcuuuauaaauaggcagcuaguggaaacaagacaaauaacuaagaacguuacucaaaucauagaagaccauuauuccacuaccaaagucgcagcaauaagagcuaacuuaagucaugaauuuagaguaaaaaaucauauauacaaaaaucgagacauaaacgauuaucaucaugcacacgaugcguacaucguagcacugauaggcggauucaugagagacagauacccgaacaugcaugauucgaaagcaguauauucggaguacaugaaaauguucagaaaaaacaaaaacgacaaaaaacgguggaaagauggauuuguaauaaauagcaugaacuaccccuaugaaguagauggcgaguuaauauggaacccugauauaauuaacgaaaucagaaaaugcuucuacuacaaagacuguuacugcacaacaaagcuugaccaaaaaucgggccaaauguuuaaccuaaccguccuaccaaacgacgcacacagcccuaaaggaaccacagaggccguaauacccgugaacaaaaacagaaaagacgucaauaaauacggugguuucagcggacugcaauauguaauaguagcaauagaaggaaaaaaaaaacgagguaaaaaaaccaaacuuguaaaaaaaauauccgguguaccacuucacuugaaggcggcaucacuagacgaaaaaauuaaauacauagaagaaaaagaaaaccuaacagauguuaaaauuauaaaagauagcauaccaguuaaccaaaugauugaaauggacggaggcgaauaccuccuaacaucacccauagaauucguuaauggccgucaacuaguacuaaaugaaaaacaaugcgcauuaauagccgacauauacaacgcaaucuacaagcaagauugcgacaacuuagacgacguauuaaugauucaauuauacauagaacugauuaauaaaaugaaagcuuuguauccugcauaccaauccauagcagaaaaauucgaaaguaugacagaagauuacguggcaguuucaaaggaagaaaaagcagauauaaucaaacaaaugcuaauuauaaugcacagaggucccagaaacggaaaaauacaauacgcagacuucaacgugggugauagaauuggaaggaaaaacaaaaugagccuggauuuagaaagaguaacuuucguaucacagagcccuacagggaucuacacaaaaaaguauaaacucuga

SEQ ID NO: 5269 - RNA, 4002 nt, Artificial Sequence
  Cas9 variant
augggcaaagaauacuauuuagggcuagauaucggaacagacuccguuggaugggccguaugugauacaaauuacaaaauaccaaaauucaaagguaacgcaauguggggaauaagacucuuugaaaaaaguaauagcgccgaggaacgaagaggauucagaagcagucgaagaagaacccaaagaaaaagagaaaggcucaaauuauuggagaugcuauucgacgaagaaauuucaaaaaucgauccagccuuuuucaucaaacugagagaaagcaaccuuuauuuagaagauaaaucaacgaaaaucccauacuguguauuuucagaugaaaacuauacagacaaagacuuucacagagacuaucccacaauauaucacuugcgaaacgaacuuauaaaaucaaauaaaccucacgacguaagacuaguauacuuagcacuacaccacaucauaaagaauagaggucacuuccuauucgacuacuccuauaaaaacgauaaaucaggagauuucaugccaauuuauaaugacuuaaaaaauuauuucuaugacaauuaugaaauugaacuagauugcagugauguugacgaauuugccaauacacuaaaggauaaaagcaagggaaaaacaaaaaaaaacgcagaaauugcagaguuauucggagucuccaaaaaauaugacaaaguccuuuacagcgcacuaucacuucuaucaggaaguucaguaaagcuuuuugauaucuuugaugaugaggcacuuaaagacguagaaaaaaagucaguaaguuucucaaguggauuugacgauaaugcuaacgacuuucaaaguuacuuaggcgaaagauucgaacuucucgaaaaacuuaaagcaguguacgauugggcaguuuuagcugauauacuggacggaaaagaguacauaucugaggccaaaguagcuauauacgaaaaacauaaaagggaucuaaaaacacucaaaaaauacaucaaaauauacaugccagaaaaaaaagcugaaauauucaauauuaguucaaaagauaacaacuauguggcauacuccaaacacauaaaaaccucaaauggaacaggaguacucauuagcaccugcacgcaagaagaauucugcgcauaccucaaaaaaacacuuggaauaugcaaagacgcaagcuaugaagaaauguucaaagaaaucgaaaacucaaccuuuaugccaaaacaagugacgaaggacaacggaguaguaccaaugcaagucaacgaaaaagagcuaguagcaauauuagauaaugcaaaagaauaccucccauuccucuugaauaaagauaacgacggcaaaacagucuacgauaaaauaaaagcauuguucgaauaucgcaucccuuauuacaucggccccuuaaacacucacaguacaaaaucauggcuaguuagaagcaacgaaaaaaucuauccguggaauauagaggacguuguagauuucgacaaaagcgcagagaaauucauugagaacuuaaccaguaaguguacauauuuaccucaauacgacguaauaccaaaacauucgcuacuauauaacaaauucugugugcuaaacgaacucaacaaccucaaaaucgacggagaaaaaauaucaguccaacuaaaacaagauauuuauaacgacuuauucaaaaaauacuauaaaguuacuaacaaaaaacucugugacuacuuaaaaagcagaaauauagccuucgacgaaaucagcggaauagauaaugacuuuaaaucaaguuuaaaguccuauaaggaccuuguagcauacaaccuuacagacgaacaaaaagaagaaauaguaaaagcaaucaccauauucggggacgauaaaaaacuuuugaaaaaacgacucaaaaacgaauuuggaggcugucuaucagacgacgaaaucaaaaaaauuugcaaguuaaaauauacaggauggucaaagcuuagcagagaauuucuaacugauguaacggcagucuacaaagagacuggagaauuaauaaauauaaucugcgcccuuugggaaacaaauuacaaucugacaucauuacucuacucagaugaauuuuguugcgacgauaaagaaaacaaaacguuuaaugacaaaauaaacgaauuaaacucauuuggaaaugacaaaacgcuaaaccaaauaguugaggaacuauacguaucaccacucguaaaaagaccuauauaccaaagucuacucauuacuaaagaacuagaaaaaauuaugaaaugcccaccuaaaaaaauauucguggagguggccagaggcgccgaagaaaaaaaaagaacugucagcaggcgcaacaaauuacuagaucuauauaagagcugcaaaaacgacuauccccuacuauuugaugaacuacaaaacaauacgaccgacgacgaacuaaagucagacaaacuauaucuauauuucacacaauuugggaaauguauguauacaggagaaaacaucgaacuaggagaucucuucaacaaaaaccuauacgacauagaccacauauacccgcaaucaaaaauaaaggaugacagcuuagauaaucgcguccuugugaagaaaacgacaaacgcaaaaaaggauaacgaauauccacuaaguagccagauaagagaaaaaaugacuccacauuggaaagcacucuuagacaaaggccuuauuaacaagaaaaaauacgagcgacuuguacgaaauuaucccuuaagcgacgaagaacucucacaauuuauaucgagacaacucgucgaaacccgccaaucaaccaaagcaguagccaacauacuagaacaguuauaccccaggccagauacagaaaucgucuacguaaaagccgcccuagcuuccgaauuccgacaucaauaugacauguuaaaaugcagagaagugaacgaccugcaucaugcaaaagacgcauaccuaaauaucguaguagguaacgccuacaacggaaaauucacccauaauaaagcaaacuucauaaaaggccuccaaaacaaugacaaagcauacaccguuaaacucgacagcaugcuuaaacauaacauagauggagccuggauugcagacaauaaugaaucucuaaacauuguaaaaucaaccaugaacaaaaacaacauaagguacacaagauacgcuuucgaaaaaaaagguggacuauuuaaaguaacaauacucaaaaaagguaacggccaagcaucaaucaaaaaaaacgauaaaagaaauucuauugaaaaauaugguggauacaaccaagucucgagcacauacuucucaugcguagaacacgguaaagauaacaaccguaugauaucaauguuuucgguaaaccuauaugacaaaaacaaguacgaagagaacccuauagcguaucuaauagaaaauuauggucuaauaaaccccauaaucaaaguuaaaaaaguaaaaauucaauccugcaucucauuugauaauauguuaugucacuuaggaggaaaagauucggguggaagucaaauaucuuacagaccaggaguacaacugguacuaggauacgacaaugagagauacaucagaaaugucauucgaugugcuggaggugaccugcacuugcaaacaaguaaaaacgaaaaagacauaguuacagcagaaaaaaacaucgagcuauucaacuuauuaauagaaaaaaugaaaaacaauauauauggaguccuuuacagcaaccuaggagacaaacuauacuguucuaaagaaaaauucgaaaaacuagauauaguagaacaaugcaauguaauaaaaaauguacucacaauauuaaaaaacaaugcaucaaagggugaucuaaaaaguauugguaucaaagcuaacggugcuauuagauugaauaacaacauauccgaaauaaaaaaagucaaaucgauaaaacuuauaaaucaaagcguaacaggacuauuugagcaagaaauugaacuuuuaaaucuauga

SEQ ID NO: 5270 - RNA, 4002 nt, Artificial Sequence
  Cas9 variant
augucccaaaauauaguagauuacugcauaggacucgaccuaggaacagguagcgugggaugggcaguagucgacaugaaucaccgacugaugaaaagaaauggaaagcauuuauggggaucgagauuauucucuaaugcagaaacggcagccaccaggagaaguucgcgaagcauaagacgaagauacaauaaacgaagagaacgaaucagauuacuaagagcaauacuacaggauaugguauuagagaaagacccuaccuuuuuuauaagauuagagcacacaagcuucuuagaugaagaagauaaagcaaaauaccuuggcacugauuauaaagacaauuauaacuuauucauagacgaagacuucaaugacuacacguacuaccauaaauacccaaccauauaucaucuaagaaaggcacucugcgaauccaccgaaaaagcagauccucgacucauauaucuagcacugcaucacauaguuaaauacagagguaauuuucucuacgaaggacaaaaauucaacauggaugcaaguaacauagaggauaaauuaucugauguauucacucaauuugcagacuucaacaacauaccauacgaagaugaugaaaaaaagaaucuagaaauacuagaaaucuuaaaaaaaccauuaucaaaaaaggcaaaaguagacgaaguuauggcccuaauaucaccagaaaaagaauuuaaaagugcauauaaagaacuuguaaccggaaucgccggcaacaaaaugaacguuacaaaaaugauacuaugcgaaucaauaaaacagggugauagcgaaauaaaauuaaaauucucagauucaaacuacgacgaucaauucagugaaguagaaaacgauuuaggagaauacguagaauuuaucgacaguuuacacaacaucuacucauggguagaacuacaaacaauaaugggagcuacccacacggauaaugcuucaauaucggaggcuauggucucuagauacaauaaacaucaugaagaccuacaauuauuaaaaaaaugcaucaaagauaauguacccaaaaaauacuucgauauguucagaaacgacagugaaaaaguuaaaggcuauuacaacuacauaaacagacccaauaaagcaccagucgacgaauuuuacaaauuuguaaaaaaaugcauagaaaaaguagacacaccggaagcuaaacaaauucuccacgauaucgaacuugaaaacuucuugcucaaacaaaacagucguacuaauggaucagucccauaccaaaugcaacuagacgagaugaucaaaauaauagacaaucaagcgaaauacuauccugucuuaaaagaaaaaagagaacaacugcuuucaauauuaacuuuccguaucccauauuacuucgggccauuaaacgaaacuucagaacacgcauggauuaaaagauuagaaggaaaggaaaaccaacgcauacuaccauggaacuaccaagacaccguugauguagaugcuacugcagaaggauuuauaaaacgaaugagaaguuacuguacuuacuuuccagacgaggaagucuuacccaaaaauagucuuauuguuucaaaguacgaaguuuacaacgaauuaaacaagauaagagucgaugauaaacuacuugaaguggauguaaaaaacgauauauauaaugaacucuucaugaaaaacaaaacuguaaccgaaaaaaaacuaaaaaacugguuaguaaacaaucaguguugcagaaaagaugcggaaauuaaagguuuccaaaaagaaaaccaauuuucaacgagucuaacgccauggaucgauuuuacaaacauauucgguaagauagaucaaucgaauuuugacuuaauagaaaagaucauauaugauuuaacaguauucgaagacaaaaagauaaugaaaagacgacuaaagaaaaaauacgcucucccagacgauaaaauaaagcaaauauuaaaacuaaaauacaaagauuggaguagacuaaguaaaaaacuauuggacggcauuguagcagauaacagauuuggaaguucagugacaguccuagacguacuagaaaugucacgccugaacuugauggaaaucauuaacgacaaggaacuaggauaugcgcaaaugauagaagaagccaguuccugucccaaagauggaaaauucacauaugaagaaguugccaaacuugccggcucaccagcacuuaagagagguauauggcaaucauuacaaauuguagaagaaauaaccaaaguuaugaaaugucgcccaaaguacauauacaucgaauucgaaagauccgaagaagccaaagaacguacagaaucaaaaaucaaaaaauuagagaacguauauaaagaccuugaugaacaaacaaaaaaagaauauaaaucaguacuagaagaauuaaaaggauuugauaauacaaaaaagaucucaucagacagucuauuuuuauauuuuacgcaauuagggaaauguauguacaguggaaaaaagcuagauauugauagucuagauaaauaccaaauagaccauauagucccccaaagccucguaaaagacgacagcuuugacaacagaguacuuguacucccuucugaaaaccaaagaaaacuugaugaucucguaguaccuuucgauauucgcgacaaaauguaucgauuuuggaagcuacuauucgaucacgaacuaauaucacccaaaaaauucuauucgcuaauaaaaacagaauauacagaaagagacgaagaacgauucauuaauaggcaacuaguugaaacaagacaaauaacaaaaaacguaacacaaaucauagaagaccauuauucaacaacaaaggucgcagcaauaagagcaaaucuaucacacgaauucagaguaaaaaaucacauauacaaaaauagggacauaaaugauuaucaucaugcacacgacgccuacauaguggcacuuaucgguggcuucaugagggaccguuacccaaacaugcaugauucaaaagcagucuauuccgaauauaugaaaauguuccguaaaaauaaaaacgaccaaaaaaaauggaaagaugguuucguaauaaauucaaugaauuauccauacgaaguagauggaaaacuaauauggaacccagaccucauuaacgagauaaagaaauguuucuauuacaaagacugcuacugcacgaccaaacuagaccagaaguccggccaaauguuuaacuuaacuguguuaccgaacgaugcacacagugcuaaaggaaccacagaagcagucaucccuguuaacaaaaaucgaaaagacguaaacaaauacggcggauuuuccggacuucaauacguuaucgccgcaauagaaggcacuaaaaaaaaaggaaaaaaauuagugaaaguuagaaaacuaagcggaaucccuuuauaucuaaaacaagcugauauaaaagaacaaaucgaauacguagagaaagaggaaaaguuaagcgacgucaaaauuauuaaaaacaacauuccacucaaucaauuaaucgaaauagacggacgccaguaccuucucacauccccaacagaaugugugaacgcuaugcaacuaguccuaaaugaagagcaauguaaacugauugccgauauuuacaacgccaucuacaaacaagacuuugauggccuugacaacauguuaaugauccaacuauaccuacaacuaauagauaaauuaaagacccucuacccaaucuauauggggauaguugaaaaauuugaaaaguuaacagaagacuucguaucgauaagcaaagaagaaaaagcgaacguaauuaaacaaauguuaauaauaaugcacaaaggaccccaaaauggcaacauuauauacgacgacuucaacgucggaaaaagaauagguagacucaauggcagaacauucuaccuagacaauauugaauuuauaucacaaucaccaacagguauauacaccaaaaaauacaaacuguga

SEQ ID NO: 5271 - RNA, 4002 nt, Artificial Sequence
  Cas9 variant
auguauaccuauuacuuuaaggaaagugagaugguauaugaugugggucucgauauagguacaggcagcgucggauggguagcucucgacgaaaauggaaaacuagcacgagcaaaaggaaagaacuuaguaggcguaagacuauucgacacagcacaaacugcagcagauagaagaggauucagaacaaccagaagaagauuaaguaggcgcaaauggcgacuaaggcuacuagaugaacuguuuagugccgaaauaaaugaaauagacagcagcuuuuuucaacgucucaaauauucauauguacacccaaaagacgaagagaacaaagcacauuacuaugguggguaucuauuuccaaccgaagaagaaacaaagaaauuccauagaaguuauccaaccauauaucacuuaagacaagaacugauggcucaaccaaacaaacgcuuugacaucagggaaauuuaucuagcaauacaccaccucguaaaauaucgcggacacuuuuuaucuucucaagaaaagauaacaauuggaaguaccuauaacccggaagaccucgcgaaugcuauugaaguauacgcagacgaaaaaggguugucaugggaauuaaauaacccugaacaguuaaccgaaauuauauccggagaagcaggcuaugguuuaaacaaaucaaugaaagcagaugaagcuuuaaaacuauuugaauuugacaauaaccaagauaaaguagcaauaaaaacacuccuugcaggauuaacaggaaaucagaucgauuucgcaaaauuauuuggaaaggacauaucagacaaagaugaagcaaaacuauggaaacuaaaacuagaugaugaagcacuagaagaaaaaagucaaacaauacuaucccaacuuacagacgaagaaauagagcuauuucacgcaguaguacaagcauacgauggauuuguacuaauaggacuacuaaacggagcugauaguguuucugcagcaauggugcaacuauaugaucaacaucgagaagaucguaagcuucuaaaaucacucgcacaaaaagcaggacugaagcacaaacgcuuuuccgaaaucuacgaacaauuagcccuugcaacagacgaagcaacuauaaaaaauggcaucucaacggcgcgagaacuaguugaagaaaguaaucuaaguaaagaagucaaggaagauacucuaagaagacucgacgagaaugaauucuuaccaaaacaaaggacaaaagcaaacagugucauaccucaccaauugcacuuagccgaguuacaaaaaauacuacaaaaucaaggccaauauuacccuuucuuacucgacaccuucgaaaaagaagaugggcaagacaauaaaauagaggaacuacucagguucagaauaccuuauuaugucggaccacugguuacaaagaaagacguggaacacgccgggggugacgcagauaaucauuggguagaaagaaaugaaggcuucgaaaagucgaggguaacacccuggaacuucgacaaagucuucaauagagauaaggcagccagagacuucauugagcggcuaacaggaaacgacacuuauuuaauaggggagaaaacacucccucaaaauucacuaagauaccaguuguuuacaguacuuaacgaauuaaauaacguaaggguuaauggaaaaaaauuugacaguaagaccaaagcagaucuaauaaacgaccucuucaaagcgaggaaaacagucucacuuucagcauuaaaagacuaccuaaaagcacagggaaaaggagacgucaccauaacaggacuagcagacgaaucuaaguucaauagcucacuuagcucguauaaugaccucaaaaaaacauucgaugcugaguacuuagaaaaugaagacaaucaagaaacucuagagaaaaucauagaaauacaaacuguauucgaagacaguaaaauagcuucaagagaauuaaguaagcuaccacuagacgaugaucaaguaaaaaaauuaucucaaacacauuacacaggauggggcagacucagcgaaaaauuauuagacucaaaaauaauagaugaaagaggacaaaaaguaucaauacucgauaaacuaaaauccacgucacaaaacuucauguccauaaucaauaacgauaaauacggaguacaagcauggaucacagagcaaaauacaggaagcuccaaacucacauuugacgaaaaagugaacgagcuaaccaccagcccagccaauaaaagaggcauuaaacaaucauuugcaguauuaaaugauauaaaaaaagcaaugaaagaagaaccaagacgcguauaucucgaauucgcaagagaagaucaaacaagcguaagaucuguaccaagauacaaccaauuaaaagaaaaauaccagucgaaaagcuuaucagaagaagcaaagguucuaaaaaaaacccuagauggaaacaaaaauaaaaugagugaugaucguuauuuucuuuacuuucaacaacaagguaaagacauguauacugguagaccaaucaacuucgaaagauuaucccaagacuaugacauagaucacauaauuccacaggcauucacuaaagacgauagucuugacaauagaguauuaguuucccgcccugaaaacgccagaaaaagugauaguuucgcauauaccgaugaaguccaaaaacaggauggaucauuauggacuucauuauugaaauccggauucaucaacagaaaaaaauacgaaagguuaacaaaagcuggcaaguaccuagauggacaaaaaacggguuucauagcgagacagcuuguggaaacgagacaaaucauaaaaaacguugccucacuuaucgaaggugaauacgaaaauucaaaagcugucgcaauaagaagugaaauaaccgcagacaugagacuacuagucggcauuaaaaaacaucgagaaauaaacucauuccaucaugcauuugaugcgcuucuuauaacagccgcaggacaauacaugcaaaaucgauauccugacagggauucuaccaauguuuacaaugaauuugaccguuauacaaaugauuacuuaaagaaucuaagacaacuaagcagcagagacgaggugcgucgacuaaaaaguuucggcuucguuguaggaacaaugcgaaaagguaaugaggacuggucugaagaaaauacaaguuauuuacgaaaagugaugauguucaaaaauauuuuaaccaccaagaaaacagaaaaagacagggguccacuaaacaaagaaaccauauuuucaccaaagucgggaaaaaaacuuaucccacuuaacuccaagagauccgauacagcccuauacggaggguauucuaacguauauagcgccuauaugacauuagucagagcaaauggcaaaaaucuauuaauaaaaauucccauaucaauagcaaaucagauagaaguagggaacuuaaaaauaaaugauuauauagugaacaauccugcuauuaaaaaauucgaaaaaauucuaaucagcaaacucccguugggucaacuaguaaacgaagacggaaauuuaauauaccucgcauccaacgaauacagacauaacgcuaaacaacuuuggcuaucuacaacugacgcagacaaaauagcaucaauauccgaaaauucaucagacgaagaguuacuagaagcauacgauauucuaacuucggaaaacguaaaaaauagguuccccuuuuuuaagaaggacauugacaaacucagucaaguucgggacgaauucuuagacucagauaaacgcauagcagucauacaaacaauccuaagagguuuacaaauagacgcagcauaucaggcccccguaaaaauaauuucaaaaaaagucuccgauuggcauaaacuacaacaaucaggaggaauaaaacucagcgauaauuccgaaaugauauaccaaucggccacuggcaucuuugaaacgaggguuaaaauuucagaccuacucuga

SEQ ID NO: 5272 - RNA, 4005 nt, Artificial Sequence
  Cas9 variant
augaaaaacccuuauacuauagguuuagauaucgguacuaauuccguuggaugggcaguucuaaccaaccaauaugacuugguaaaaagaaaaaugaaaguagcaggaaauucagacaagaaacaaauaaagaaaaauuucuggggaguaagacuauucgacgacggccaaacugcagucgauagacggaugaaucgcacugcccgaagaaggaucgaaagacgcagaaaucgcauuaguuaucuacaagaaauauucgcagucgagauggcgaacaucgacgcaaauuucuuuugccgauuaaaugauucauucuacguagacucugagaaaagaaauucacgucaucccuucuucgcgacaauagaagaagaaguagccuaccacaaaaacuauagaacaauauaccauuuacgagaagaauuaguaaauucuucagaaaaagcggaucuacgccuaguauaccuagcacuugcacauauaaucaaauauagaggaaacuuucuaauugaaggagcauuggacacuaaaaacaccagugucgacggaguguacgaacaauucauacaaaccuacaaccaaguauucaugucaaauauugaagaagguaccuuagcuaaaguagaagaaaauauugagguagcuaacauauuagcaggaaaauucaccagaagggaaaaauuugaaagaauccuucaacuuuauccaggugaaaaaucaaccggaauguucgcgcaauucaucagucuuauaguaggcucaaaaggaaauuuccaaaaaguuuucgaccuaauagagaaaacggauauagaaugugcgaaagauucauacgaagaagaccucgaggcuuuacuugcgauuauuggcgaugaauacgcagaacuauuuguagcagcgaaaaauacauacaacgcaguuguacuaaguucaaucauaaccgucaccgcaacagaaacaaaugccaaacuuucagccuccaugauugaacgauucgaugcccacgaaaaagaccuaggugaauugaaagcauucauuaaauuacacuuaccaaaacaauaccaagaaaucuuuaauaaugcagccauagauggauaugcggguuacauagauggcaaaacaaaacaaguagacuucuacaaauaucuaaaaaccauccuugagaacauagaaggagccgauuacuucauagcaaaaauagaagaggaaaauuuucugcgaaaacaaagaaccuucgauaacggcgcuauaccucaccaauugcaccuugaagaacuagaagccaucauacaccaacaagcuaaauacuauccauuucuaagggaagacuaugagaaaauaaagagcuuaguuacauucaggauacccuacuuuguaggaccgcuagccaaaggucaaucugaauuugcauggcugacaaggaaagccgauggagaaaucagaccauggaacauagaagaaaaaguagacuucggaaaaucagcgguagacuucauagagaaaaugacuaacaaagacacauaucuuccaaaagaaaauguacucccaaaacacucuuuaugcuaucaaaaauauauggucuauaacgaauuaacaaaaguaagauauauagacgaucaagguaaaacaaauuacuucuccggccaagaaaaacaacaaauuuucaacgacuuauuuaaacagaaaagaaaagucaaaaagaaagaucuugaacuauuccuuagaaauaucaaucacauugaaucaccaaccauugaaggcuuggaggacucauucaacgcaucauaugcaacuuaccacgaccuacuuaaagucggaaugaaacaagaaauucuagacaacccucuaaacacagaaaugcuagaagacaucguaaaaauccuaacuguuuuugaagacaagccgaugaucaaggaacaacuacaacaauuuucggauguacuagaugguggaguacuuaaaaagcuagagcgacgccauuauacaggaugggguagguuguccgcaaaacuacuuguaggaauaagagaaaaacaaagccaucuaacaauauuagauuacuuaaugaaugacgacgggcuaaacagaaaucugaugcaacuaauaaaugacagcaauuuaucauucaaaucaauuauagaaaaagaacaagucagcacaacagacaaagaccuucaaucuauuguugcagaucuagcaggcagcccggccaucaagaaagguauccuucagucuuuaaaaauaguagacgaauugguaucgauaaugggauacccaccacaaacuaucguaguugaaauggccagagaaaaucagaccacugguaaaggcaaaaauaauucaaaaccccgauauaaaucauuggaaaaagccauuaaagaauuuggaucaaaaauauuaaaagaacacccaacagacaaccaagaacucaaaaauaauaggcuauaccucuacuacuuacaaaauggcaaagacauguauacaggacaagaauuggacauacauaacuuaaguaacuacgauauagaccacauuguuccacaaucauuuauaacugacaacucaauugauaaucugguucuuacaagcucugcaggaaaccgugagaaaggaggagauguaccaccacucgagauaguuagaaaacgaaaagucuucugggaaaaauuauaucaaggaaaucuaauguccaaaaggaaauucgacuauuuaacuaaagccgaacgugguggucucacggacgcagacaaagcaagauucauccacagacagcuaguagaaacccgccaaaucacuaaaaacguagcaaauauacuacaucaaagauucaacaaugaaacagacaaccauggcaauacaauggaacaaguaagaauagucacauuaaaauccgcuuuaguaagucaauuuagaaaacaauuucaauuauauaaaguaagagaaguaaaugacuaccaucaugcacacgaugcauaccuaaauggagugguggcuaauacacuuuuaaaagucuacccacaacuagaaccagaguucgucuauggcgaauaccaucaauucgacugguucaaagcaaacaaagcaacagccaagaaacaauucuauacaaauauaaugcuauucuuuggacaaaaagaacgaauaaucgacgaaaauggagaaauauuaugggauaagaaauauuuagaaacgauuaagaaaguacuagauuaucgacaaaugaacauuguaaagaaaaccgaaauccaaaaaggagaauuuucuaaagcaacaauaaaaccaaaagguaacagcaguaaacuuauacccagaaaagaaaauugggauccaaugaaauauggcggucuagacucaccuaacauggcuuacgccguaauaauagaacaugccaaagggaaaaagaaacuaauuuuugagaagaaaauaauuagaaucaccaucauggaaagaaaaauguuugaaaaagacgaagaagcauuuuuagaagaaaaaggauaucgacauccuaaaguacuaacuaaauugccaaaauauaccuuauacgaaugcgaaaaaggacgccgaagaaugcuagcaagcgccaaugaagcacagaaaggcaaccaacugguccuaucaaaucauuuaguaagucuccucuaucaugcuaaaaauugugaagccucagacggaaaaucucuaaaauacauagaggcacauagagagacauuuagcgaguuauuagcccaaguaucagaauuugccaccagauauacuuuagccgacgccaaccugagcaaaauaaauaaccuuuuugagcaaaauaaagaaggugauauacaagcaaucgcccagagcuucguagaucuaauggcauucaacgcuaugggagcacccgccucuuucaaauucuuugaagccaccauagacagaaaaagauacacaaauuuaaaagaauuacuuucaucaacgaucauauaucaaucaauaacagguuuauacgaaucaagaaaaagauuagacgauuga

SEQ ID NO: 5273 - RNA, 4005 nt, Artificial Sequence
  Cas9 variant
augaaaaaaccauacaccauaggucuagauauaggaacaaacucuguuggaugggcugcucuaacugaccaauaugaucuaguaaaaagaaagaugaaaguugccgguaacucagaaaaaaagcaaauuaaaaagaacuuauggggcgucaggcugguagacgaaggaaaaacugcagcacaucgacgcguuaauagaacaacaagaagaagaauugaaagacgacgaaacagaauuucauaucuacaagaaauuuuuacggcagaaauguucgagguagaugcaaacuuuuuuuacagacucgaagauucguuuuacauagagucagaaaaacgacaaaguagacacccauuuuucgcuacaauagaagaagaagucgcauaucacgaaaauuacagaacaaucuaccauuuaagagaaaaacuaguaaauucaucggacaaggcagaccuaagauugguauacuuagcucucgcacauaucaucaaauacagggggaauuuccuaaucgaagguaaacuagacacaaaaaauacuagcguagacgagguuuuuaagcaauucauaaaaacauauaaccaaguauuugccagcgauauugaagaaggaaguuuaacaaggauagaggaaaacaaugagguagcaaaaaucuuuucugaaaaacucaccaaaagggaaaaacucgauaaaauuuugaacuuauaucccaaugaaaaaagcacugacuuauuugcccaauuuauaagccuaaucauaggaucuaagggcaauuucaaaaaauuuuucaaccucacagaaaaaaccgacauugaaugugcgaaagauaguuacgaagaagacuuagaaguuuuacuagcccgagugggagacgaauacgcagaaauauuuguggcagcgaaaaaugcguacaaugcuguaguauuaucuaguaucauuacaguauccaacaccgaaaccaaagcaaaacuaucagcuucuaugauagagagauucgauaaacaugacaaagaccuuaaacguaugaaggcauucuuuaaagucagacuaccagaaaauuucaaugaaguauuuaaugauguagaaaaagauggcuaugcgggguacauagaaggcaaaacaaaacaagaagcauucuacaaauacaugaaaaaaaugcuugagcacgucgaaggggcggauuacuuuaucaaccaaaucgaagaagaaaauuuuuuacggaaacaacgaacauucgauaacggagcaaucccacaucaacuacaucucgaggaacuugaagcuauacuacaccaacaagcgaaauauuaccccuucuuaaaagucgacuacgaaaaaaucaagagccuagucacuuuuagaauaccuuacuucguaggacccuuagccaauggacagagugaauucucgugguuaacacgcaaagcagacggagaaauaagaccuuggaacauugaagaaaaagucgauuucggaaaaagugcaaucgacuuuauugaaaaaaugacaaacaaagauaccuaccucccaaaagaaaacguauuaccaaaacacagcaugugcuaucagaaauacaugguauauaaugaauuaacaaaaauaagauacacagaugaccaaggcaaaacucacuacuuuagcgggcaagaaaaacagcaaauauucaaugacuuauucaaacaaaaaaggaaaguuaaaaaaaaggacuuagaauuauuccucuauaacaugaaucauguagaaucaccaacaguagaaggaguagaggaugcauucaauuccucuuuuaccacauaccacgaccuacagaaaguaggagucccucaagaaauauuagaugauccacucaacacugaaauguuagaagaaauaauuaaaauacuaaccguauucgaagacaaaagaaugaucaaugaaagauuacaagaauucagcaaugucuuagacgaagcgguacuuaaaaaacuagagagaagacacuauacuggcuggggaagacuaagugcuaaauuacuaaucggaauacgcgacaaagaaucccaccugacuauacuugauuaucuaaugaacgacgauaaacacaacaggaaccuuaugcagcuuauaaacgacaguaaccuuuccuuuaagucaaucauagaaaaagaacaagucucaacagcagauaaagauauccagucaauagucgcggacuuagcagggagcccagcaauaaaaaaaggaauccuccaaagccucaaaauagucgacgaauuaguaggaaucauggguuauccgccacaaacgaucguuguagaaauggcaagggaaaaucaaaccaccggaaaagggaaaaacaauucaaaaccaagauuuaccucauuagaaaaagcuauaaaagaacuaggaagccaaauucucaaagaacacccaacagauaaccaaggauuaaaaaaugacagacuauaccuuuacuaucuacaaaauggaaaagacauguauacaggucaagaauuagauauacacaaucuaaguaauuaugauauugaucacguaguaccucaaagcuuuauaacagauaacuccaucgacaauagaguacuagcuucauccgcugcaaauagggaaaaaggagacaacguucccucgcuagagguaguaagaaaaagaaaagucuauugggaaaaacuguaucaagcaaaacucaugagcaaaagaaaauuugauuaucuaacgaaagcagaacgaggaggccugacugaagcagauaaagcaagauucauucauagacaacuagucgaaacacgucaaaucaccaaaaauguugcaaacauuuuacaucaaagauuuaauugcaaaaaagaugaguccggaaacgucaucgaacaaguuagaaucguaacacuuaaagcagcauuaguaucgcaauucagaaagcaauuccaauuauacaaaguacgagaagugaacgacuaccaucacgcacacgacgccuaccuuaacuguguugucgcuaauacauuacuaaaaguuuacccacaacucgaacccgaauucguguauggagauuaucaccaguucgauugguucaaagccaacaaagccacagcuaaaaaacaauuuuauaccaauauaaugcuauuuuucgcaaaaaaagaucguauaauagaugaaaacggcgaaauccucugggacaaaaaauaccucgacacaauaaaaaagguauuaaauuauaggcaaaugaacauaguaaaaaagacagaaauacaaaaaggugaauucucaaaugccacagcaaacccaaagggaaauaguagcaagcuuauccccagaaaagcugauugggauccaauuaaauauggcgguuucgacgguucaaauauggcuuacgccaucguuauugaacaugaaaaaagaaaaaaaaaaacgguaauaaaaaaagaacuaauccagauaaauauaauggagaggacagcguucgaaaaggaucaaaaagaauuccucgaagguaaaggauaccguaauccaaaaguuaucacaaagauaccuaaauacaccuuauacgaaugugaaaacggaagaagaagaaugcuaggaucagccaaugaagcacaaaaaggaaaccaaaugguccugccgaaccaccuuaugaccuuacuauaucacgcgaaaaacugugaagcaucggacgguaaauccuuagcauauauagagucucaucgagaaauguuugcagaauuauuagacucaauaucugaauucgcgucucguuacacucuugcugaugcaaaucuagagaaaauaaacacaaucuucgaacaaaacaaaaguggagacgucaaagucauagcacaaagcuuuguuaaucuacucgaauuuaaugcgaugggagccccagcaucguucaaauauuucgagaccaacaucgaacguaaaagguacaacaauuuaaaggaacuauuaaaugccacaauaaucuaccaaucgaucacaggacuauaugaggcaagaaaaaggcuugaugauuga

SEQ ID NO: 5274 - RNA, 4005 nt, Artificial Sequence
  Cas9 variant
augaaaaacccauacacaauagguuuagauauaggaacaaacagcguaggaugggcaguauuaaccgaccaauacgaucuuguaaaacguaaaaugaaaguagcuggaaacagcgauaagaaacaaaucaagaaaaacuucuggggagucaggcuauucgaugauggacaaacagcaguagacaggcggaugaauaggacugcucgacgacgcauagaaagacguaggaacagaauaaguuaucuacaagaaauauuugcagucgaaauggcaaauauagacgcaaauuucuucugucgccucaacgacucauuuuauguagauagugagaaaagaaauaguagacaccccuuuuucgccacaaucgaagaagaagucgcauaucauaaaaacuacagaacaauuuaccaucuacgagaagaguuagugaacagcagugaaaaagcagauuuaagguuaguguauuuagcacuagcacacauuauuaaauacagaggaaauuuucucaucgaaggagcacuagauacgaaaaauacuucaguagacgaaguauacaaacaauucauucaaacauacaaucaaguauucaugaguaacauagaagaaggagcucuggcaaaaguagaagaaaacacggaagucgcaaguauauuggcaggaaaauucacuagaagggaaaaauuugaaagaauacucagacucuacccuggcgaaaaaucaaccgguauguucgcgcaauuuauuucccucauaguagggaacaaaggaaacuuccaaaaaguuuucaaccugguagagaaaacagacauagaaugugcaaaagauucauacgaagaagacuuagaagcacuauuagcaauaauaggugacgaauaugcggaauuguucguagcugccaaaaacacauacaacgcagucguauuaucaucaauaauaacaguaacagcaacugaaacaaacgcgaaacuauccgccuccaugauagaacgauuugacgcacaugagaaagaacuaggagaauuaaaagccuuuauuaaauuacaucugccaaaacaauaucaagaaauauuuaauaaugcagaaauagauggauacgcagguuauaucgacggaaaaacaaaacaaguugauuuuuacaaauaucuaaaaaccacacuagaaaauguagaaggagcugauuacuucaucacuaaaauugaagaagaaaauuucuuaaggaaacaaagaacauuugacaacggcguuauaccccaccaacuacacuuagaagaauuagaagcaaucuuacaccaacaagcuaaauacuacccauuuuuacgugaaggcuaugacaaaaucaaaucacugguaacauuuagaauaccguacuuuguaggaccauuagcuaacggacaaucagaguucgcuuggcucacaagaaaagaugauggagaaauaaggccuuggaacauagaagaaaaaguugauuucggaaaaucagcaguagacuucaucgagaaaaugaccaauaaagacacauaccuaccgaaagaaaauguucuaccaaaacacucauuaugcuaccaaaaauacaugguuuauaaugaacuaacaaaaauccgauacauugacgaccaggguaaaacuaacuacuucagcggacgugaaaaacaacaaauauuuaacgaucuuuuuaaacagaaaaggaaagucaagaagaaagacuuagaacuauucuugcgaaauauaaaccauauagaaucgcccacuauagaaggcuuagaagacaguuucaaugcaagcuacgccacuuaucaugacuuacuuaaaguaggacuaaaacaagaaauacuagacaacccuuuaaacaccgaaaucuuagaagacauuguaaaaauacuaacuguauucgaagauaaacgaaugaucaaagaacaguuagaacaauucucagauguacuagauggagucgucuugaagaaacuagaacgccgccauuacacggguuggggaagauuauccgcaaaauuguugguugggauucgugacaaacaaucgcaccucacuauacuagauuauuuaaugaaugacgacggauuaaaccgaaacuuaaugcaauuaauaaacgacucaaaccucagcuucaaaucaauaauugaaaaagaacaaguaucaacaacugauaaagaucugcaaagcauaguagcugacuuagcaggaucgccugcuaucaagaaaggcauucuacaaucacucaaaauuguugaugagcuagucaguaucaugggauauccaccccaaacaauagugguugaaauggcgagagaaaaucaaacaacuggaaaaggcaaaaacaauagcaaaccaagguauaaaagccuagaaaaagcaauaaaagauuuuggaucgcaaauuuuaaaagaacaccccaccgauaaccaagaacucaaaaacaauagacuauauuuauauuacuuacaaaauggaaaagacauauacacaggacaagaauuggacauacacaaucucuccaauuaugacauugaucacauaguaccacagagcuucauaacugauaauuccauagauaaucucguucuaacaucaucagcuggaaacagagaaaaaggaggagacguaccaccauuagaaauaguuaggaaaagaaaaguauuuugggaaaaauuguaucaaggcaauuuaaugaguaaacgaaaauuugacuaucuaacgaaagccgaaagagggggccuaacugaagccgacaaagcaagauuuauucaucgucagcuagucgaaacaaggcagauuaccaaaaauguugcaaauauauuacaccaacgauuuaauaaagaaacggacaaucacgggaauacaauggaacagguaaggauaguaacuuuaaaaagcgcccuaguaucacaauuucgaaaacaguuucaacuuuacaaagucagagaagugaacgacuaucaccacgcacaugacgcuuaucugaauggcgugguagcgaauacacuacuuaaaguauacccacaauuagaaccggaauuuguuuauggcgaauaccaccaauuugacugguucaaagcaaauaaagcaacugccaagaaacaauucuacacaaauauuauguuauucuuugcacaaaaagaaaggaucauagacgaaaacggcgaaauuuuaugggacaagaaauaucuagaaaccaucaaaaagguacuagacuacagacaaaucaacauaguaaagaaaacagaaauucaaaaaggcgaauuuaguaaagcuaccauaaaaccaaaaggaaacaguucgaaacucauaccacgcaaagaaaauugggacccaguuaaauacggaggccuagauagcccaaauauggcauaugccguaauaaucgaacacgcuaaagguaaaaagaaaauaguaaucgagaagaaacuaauucaaaucaauaucauggaacgaaaaauguucgaaaaagacgaagaggcuuuccuagaagaaaaagguuaccaccaaccuaaaguauuaacaaaauuaccaaaauacacacuauaugaaugcgaaaaaggcagaagaagaaugcuaucaucagcgaaugaagcccagaaaggaaaucaauuaguuuuaagcaaucauuuaguuagccuacuauaucacgccaaaaacugcgaagcaagugauggaaaaagucuaaaauauauugaagcacaucgagaaacauucagugaacuuuuagcacaaguaucagaauuugcaacaaaauauacucucgccgacgccaauuugucuaaaauaaacaaccucuucgaacaaaauaaagaaggagacauaaaagcgauugcgcaaucauuuguagaccucauggcauuuaacgcaaugggagcaccagcaaguuuuaaguucuuugaagcaacaauagacagaaaaagguauacaaaucuaaaagaacuauuaagcaguacaauuauauaccaaaguaucaccggucucuacgaaaguagaaaaaggcuugacgacuga

SEQ ID NO: 5275 - RNA, 4005 nt, Artificial Sequence
  Cas9 variant
augggucguaaaccauacauacuaucauuagauaucgguacaggaucgguaggauacgcuugcauggacaaaggauuuaauguacuaaaauaucaugacaaagacgcacuagguguauaucucuucgauggugcauuaacugcacaagaacgacgacaauuccgaacaagccgucgaaggaaaaaccgacgcauaaaacgacuaggcuuacuacaagaacucuuagcucccuuaguacaaaacccaaacuucuaccaauuccaacggcaauuugccuggaaaaacgacaauauggacuucaaaaacaaauccuuaucugaaguccucucauuuuuaggcuacgaaagcaagaaauacccaaccauauaccaccuacaagaagcucuacuacuaaaagacgaaaaauuugacccagaacuuauauauauggccuuauaucaucuaguuaaauaccgagggcacuucuuauucgaccacuuaaaaaucgaaaaucuaaccaauaacgacaauaugcacgacuucguagagcuaaucgagaccuacgaaaacuuaaauaauaucaaacuaaacuuagacuacgagaaaacuaaaguaaucuaugaaauacucaaagauaacgaaaugaccaaaaacgaccgagcaaaacgcguuaaaaauaugcagaaaaagcuagaacaauuuucaauaauguuacuuggacuaaaauucaacgaaggcaaauuauuuaaucacgccgacaacgcagaagaauuaaaaggagcaaaucaaucccacacauuugccgacaauuacgaagaaaaucugacaccauuccuuacggucgaacagucugaguucauagaacgagcaaacaaaauuuaucuaucauuaacacuacaagacauacugaaaggaaagaaaucaauggcuauguccaaaguugcugcauaugacaaauuucguaacgaacucaaacaaguuaaagauauaguuuacaaagcugauuccacacgaacccaauucaagaaaauauuuguaucaagcaaaaagagccucaaacaauacgacgcgacacccaaugaccaaacuuucagcucacuaugccuauucgaccaauaucuaaucagacccaagaaacaauacucauuacucaucaaagaacucaagaaaauaauuccacaagauucagaacucuacuuugaagcagaaaaugauacacuccuuaaaguuuuaaacacaaccgauaaugcauccauaccaaugcaaauuaaccuauacgaagcagaaacaauacuucgcaaucaacaaaaauaucacgcagaaauaacagaugaaaugauagaaaaaguacugucacuaauucaauuccgaauaccauacuauguaggcccacuuguaaaugaucacacagcaaguaaauucggcuggauggagaggaaaucuaacgaauccaucaaaccauggaauuuugacgaaguaguagaucgcucaaaaucugcaacacaauucauaagaagaaugaccaacaaaugcucauaccuaaucaaugaagacguacuacccaaaaacucacuacuauaccaggaaauggaaguccuaaaugaacuaaaugccacccaaauacgauuacaaaccgaccccaaaaacagaaaauauaggaugaugccacaaaucaaauuauuugccguagagcauauuuuuaagaaauauaaaacagucucacacuccaaauucuuagaaaucaugcuaaacucuaaucaucgugagaauuuuaugaaccauggugaaaaauuaucaauuuucggaacacaagaugacaagaaauucgccuccaaacucaguucuuaccaagacaugaccaaaauauuuggcgauaucgaaggaaaacgagcacaaaucgaagaaauaauucaauggauuaccauuuucgaagacaagaaaauauuaguacaaaaacuaaaagaaugcuacccugaacuaacgucuaaacaaaucaaccaauuaaagaaauuaaauuacucaggcuggggacgucucucagagaaacuacuuacacacgcauaccaaggacacuccauaauagaacuccuaagacacucggacgaaaauuucauggaaauacuaacgaaugauguguacggauuucaaaauuucauuaaagaagaaaaccaaguucaaucaaacaaaauccaacaccaagacaucgcaaaucuaacuacaucacccgcgcuaaagaaaggaaucuggucaacaaucaaacugguacgggagcuaacaucaauuuuuggugagccagagaaaaucauaauggaauuugccacugaagaucaacaaaaagggaaagagcaaaaaucgagaaaacagcuaugggacgacaacaucaagaaaaacaaauuaaaauccgucgacgaauacaaauacauaauagauguagcaaauaaacuuaacaacgaacaacuacagcaagaaaaauuauggcuuuaucuuagucaaaauggcaaauguauguauucaggacagucaauagaucucgaugcacuacuaucuccgaaugcuacaaaacacuacgaaguggaccauauauucccacgaucauucauaaaagacgauaguauagacaauaaaguacucgucaucaagaaaaugaaucaaacaaaaggagaccaaguaccucuccaguucauccaacaaccuuaugaaagaauugccuacuggaaaucucucaacaaagcaggauugauuagcgacucaaaacuacacaaacuaaugaaacccgaauuuacagcaauggauaaagaagguuucauacaacgccaauuaguagaaacacgacaaaucuccguucacguaagagacuuccucaaagaagaauauccaaacacuaaaguaauacccaugaaagcaaaaaugguuucagaguucagaaagaaauucgacauacccaaaauaagacaaaugaacgacgcacaccacgccauugacgcauaccuuaacggaguaguuuaccacggagcacagcuagcauaucccaauguugaccuguucgacuucaauuuuaaaugggagaagguaagggagaaauggaaagcacuaggagaguucaacacaaaacagaaaaguagagaacucuucuuuuucaagaaacuagagaaaauggaaguaucacaaggagaacgccugaucucaaaaauaaaacuagauaugaaucacuuuaaaaucaauuauuccagaaaacuagccaacauaccacaacaauuuuacaaucaaaccgcagugucacccaaaacagcagagcuaaaauacgaaucgaacaaauccaacgaaguaguauacaaaggccucacuccauaccaaacauauguuguagcaauaaaaagcgucaacaagaaaggaaaagagaaaauggaauaccagaugauagaucauuauguauucgauuuuuacaaauuccaaaacggaaaugaaaaggaacucgcucuauauuuggcacaaagagaaaauaaagaugaaguacucgaugcccaaauuguauacucauuaaauaaaggagaccucuuauacauuaauaaccaucccuguuauuucguauccagaaaagaagucauaaaugcaaagcaguucgaguuaaccguugaacaacaacuaucccuauacaacgucaugaauaauaaagaaacuaacgucgaaaaacuccugauagaauaugacuucauugcugaaaaagucauuaaugaauaccaccacuauuuaaacucaaaacuaaaagagaaaagaguacguacauucuuuagcgaaaguaaucaaacacacgaagauuucaucaaagcacuugacgaauuauucaaaguaguuaccgcaucagccacaagaucggauaaaauuggaucaaggaaaaauucaaugacccacagagcauuucuaggaaaaggaaaagauguaaaaaucgccuacacuucgauaucaggauuaaaaacaacaaaaccuaaaagccucuuuaaauuagcagaaucacguaaugagcuauga

SEQ ID NO: 5276 - RNA, 4005 nt, Artificial Sequence
  Cas9 variant
augaaaaaccccuacacaauaggacuggauauaggaacaaauucaguaggcugggcuguacuaacagaccaguaugaucuagucaagcgcaaaaugaaaguagcaggaaacagcgacaagaaacaaauaaagaaaaauuucuggggugucagauuauuugacgaaggggaaacugcagcugauagaagaaugaauagaacugccagaagaagaauagaaagaagaagaaaucgcaucaguuauuuacaagagauauuugcauuagaaauggcaaacaucgacgcaaauuucuuuugucgccugaaugauagcuuuuauguugacagcgagaaaagaaacuccagacauccauuuuucgcaacaauagaagaagaagucgcauaucacaaaaauuauagaaccauauaucacuuacgggaagaacugguaaauaguagcgaaaaagcagacuuaagauuaguauaucuugcguuagcacacaucaucaaauacagaggcaacuuccuaauagaaggagcauuggauacuaaaaacacaaguguagauggaguauacaaacaauucauacaaacauauaaccaagucuuuauauccaacauugaagagggcacauuagcaaagauggaagaaaacacaacagucgcagauauacuagcaggaaaauucacacggaaagaaaaacuugagagaauacuacagcuauauccuggagaaaaaucaacagggauguuugcacaauucauaucucuuaucguaggaucgaagggcaacuuucaaaaaguauucgaucuuguugagaaaacugacauugaaugugcaaaagacaguuacgaagaagaccucgaagcacuacuggcaauaauuggagacgaguacgcagaauuauuuguugcugcgaagaauacuuacaaugcuguaguccuuuccagcaucaucacaguaacagacacagaaaccaacgcaaaauugucagcaagcaugauagaacgauuugacgcucacgaaaaagaccuaagagaacuuaaagcguucauaaaacuacaccuaccuaagcaauaugaagagauauucaguaaugucgcaauugauggcuacgcuggcuauauagaugguaaaacaaaacaaguagacuuuuacaaauaccucaaaacuuuacuggaaaacauagaaggagccgauuacuucauagcuaaaaucgaggaagagaauuuccuaagaaaacaaagaaccuuugacaacggugcuauuccacaucaauuacaucucgaggaauuagaagcgauuuuacaucaacaagcuaaguacuauccauucuuuaaagaagcauacgacaaaauaaaaaguuuaguuacauuuaggaucccauacuuuguugguccacuagccaauggacaauccgauuucgccuggcuaacaagaaaagcugauggcgaaauaagaccuuggaauauugaagaaaagguagacuucggaaaaucagccguagauuuuaucgagaaaaugaccaauaaagacacauaucuaccaaaagaaaacguucucccaaaacacuccuuauacuaucaaaaauauaugguuuacaaugaacuuacaaaaguacgcuacauugacgaucaaggcaaaacaaacuacuucagcggacaagaaaaacagcaaaucuuuaacgauuacuucaaaaagaaaagaaaaguuagcaaaaaggauuuagaacaauuccuccguaacaugucccauauagaaagcccaacuauugaaggucuagaagauaguuuuaauucuucuuacgccacauaucaugacuuguuaaaaguaggcauaaaacaagaaguacuagaaaauccacuaaacacagaaauguuagaagauauuguaaaaaucuuaacaguguuugaagacaaaagaaugaucaaggaacaauuacaacaguucagugacguauuagauggagcaguacucaagaaacuugagcgacgccacuauacaggcuggggccgacuaucagcaaaacuucuaguagggauaagagacaaacaaucacaccuaacaauauuggauuacuugaugaaugaugauggauugaacagaaaccucaugcaacuaauaaacgauaguaaucuauccuucaaaagcauaaucgaaaaagagcaaguaaguacaacagauaaagacuuacaaagcauaguagccgaucuagcgggaucaccagcuauaaagaaaggcauccuacaaagccuaaaaauaguagaugaauuaguaucaauaaugggauauccaccgcaaacaauuguaguggaaauggcuagagaaaaccaaaccacaguaaaaggcaaaaauaacagccgaccuagauauaagagcuuagagaaagcaauaaaagaguucggcucucagauacuaaaagaacacccuacagauaaucaagaacuaagaaauaauagguuguaccuauauuauuuacaaaauggaaaagauauguauacgggacaagaauuggacauccauaaucugaguaacuaugacauagaccauauuguuccccaaaguuucauuacagacaacaguauagacaaucuagucuuaacaucuucugcuggaaauagagaaaaaggagaugacguaccucccuuagaaauagucaggaaacgaaaagucuucugggaaaaacuauuccaaggcaacuuaaugucaaaacggaaauucgauuacuugacuaaagcagaacgaggaggacuaacugaagcagauaaagccacauucauucauagacaauuaguggaaacaagacaaauaacuaaaaauguugcuaacaucuuacaucaaagauuuaacaaugaaacagacaaucacggcaacaacauggaacaaguacggauaguaaugcuaaaaucagcccuggucucccaauucaggaaacaauuucaacucuauaaaguaagggagguuaacgacuaccaccacgcccacgaugccuacuugaauggagugguagcuaauaccuuacucaaaguauacccacaauuagagcccgaguucgucuauggugaauaccaccaauucgacugguucaaagcaaauaaagcaacagcaaagaaacaauuuuacacaaacauaaugcuauucuucgcgcaaaaagaaagaaucauagaugaaaauggugaaauacuuugggauaagaaauaccuagaaacaauuaagaaaguauuagauuaccgacaaaugaacauagucaagaaaaccgaaauacaaaaaggagaguucucaaaagcaacuauaaaaccuaaagguaauucaucaaaauuaauaccaagaaaagaaaauugggacccaaugaaauauggaggacuagacucacccaacauggccuacgccgucauaauugaacacgcaaaagguaaaaagaaaguaguguuugaaaagaaaauaauaagaauaacaauaauggaacgcaaagcauucgaaaaagaugagaaaaguuuucuagaaaaacaaggauauagacaaccuaaaguucuaaccaaauuaccgaaauacacuuuguaugaaugugaaaaugggagaagaagaaugcuagcaucugccaaugaagcacaaaaaggaaaccagcaaguuuuaaaaggccaacuaauaaccuuacuacaccaugcgaaaaacugugaagccucagacgguaaaucccucgauuauaucgaaucuaauagagaaauguuuggugaacuuuuggcgcacgucucagaauuugcuaagcgauacacacuagcagaugcuaaccuuucuaaaauuaaccaauuauucgagcagaacaaggacaacgacaucaaaguaauagcacaaucauuuguaaacuuaauggcauucaaugcuaugggugcaccagcaaguuucaaguucuuugaagcaacaauagagcgcaaacgauacacaaaccuuaaagaauuacuaucggcaaccauaauauaccaauccauaaccggacuauaugaagcaagaaaaagacuugacgguuga

SEQ ID NO: 5277 - RNA, 4005 nt, Artificial Sequence
  Cas9 variant
augaaaaacccuuauacuauuggccuagacauaggcacgaacagcguaggaugggcaguucuaacuaaccaauaugaccuaguaaaaagaaaaaugaaaguagcaggaaacucugacaagaaacaaaucaagaaaaauuucuggggaguaagacuuuuugaugacggucaaacagcagucgacagacgaaugaaucgaacugcuagacgccgcauagaacgaagaagaaaucgaauuucauaucuacaggaaauuuucgcaguagaaauggcaaauauagacgcaaacuucuuuugcagguuaaaugacucuuucuacguagauagugaaaaacgaaauuccagacauccauucuuugcuacaauugaagaagaaguagcguaucaugacaacuacagaacaauauaccauuuaagagaagaauuaguuaacaguagcgaaaaagcagaucuacgccuggucuauuuagcuuuagcacacauaauaaaauaccgcggaaauuucuuaauagaaggcgcgcuugacacuaaaaacacauccguggacgagguauauaaacaauucauacagacauauaaccaaguauucaugagcaauauugaggaaggugcauuagcuaaaguagaagaaaaccucgaaguagcaucaauacuagcagguaaauuuacgcgaagggaaaaauucgaacggauucuacgacuauauccgggagaaaaaucaacagguauguucgcucaauucauuucucuaauaguaggaaacaaagguaacuuucaaaaagucuuuaaucugguagagaaaacagacauagaaugcgcaaaggauagcuaugaagaagacuuagaagcucuacuugcaauuauaggcgaugaguacgcagaauuauuuguggcagccaaaaacacauacaaugcaguaguauuaaguagcaucauaacaguuacggccacagaaacaaaugcaaaauuaagcgccucuaugauagaacgguuugaugcacaugaaaaagaccuaggagaacuaaaggcuuucauuaaacuccacuugcccaaacaauaccaagaaauauuuaauaaugcugcaauagacggauacgcaggauacaucgauggaaaaacaaaacaagucgauuuuuacaaauaucuaaaaacaacguuagaaaacguagaaggagcagauuauuuuauaacaaaaauagaagaagaaaacuucuuaagaaaacaaagaaccuucgacaacggaguaauaccacaccaacuccauuuagaagaacuugaagcaauauuacaucaacaggcaaaauauuaccccuucuuaagagaagacuacgagaaaauaaaauccuuagucacauuuagaauaccauauuuuguagggccacuagcaaaaggacaaucagaauuugccuggcuaacccgaaaagcugacggagaaauuagaccauggaacauagaagaaaaaguagacuucggaaaaucagccguagacuucauagagaaaaugaccaacaaagauaccuaucuacccaaagaaaacguacuaccaaaacauagucuguguuaucaaaaauacaugguguacaacgaauuaacuaaagugagauacauugaugaccaagguaaaacaaauuacuuuagcggucaagagaagcagcaaauauucaaugaucucuuuaagcaaaaacgaaagguaaagaagaaagauuuagaacuuuucuugagaaauauuaaucacauagaaagcccaacuauugaaggacuagaagauagcuuuaacgcuucauacgccacuuaucacgaccuacugaaaguagguaugaaacaagagagccuagauagcccucuaaaugccgaaaugcuagaagauaucgucaaaaucuuaaccguauucgaagauaaaagaaugauaaaagaacagcuacaacaauucagcgacguacuggacggcgucgugcuaaagaaauuagaaagaagacacuacacaggcuggggucggcuaagugccaaauugcuagugggcauucgagacaaacaaagucauuuaacuauauuggauuaccucaugaaugacgauggacuaaaucgaaaucucaugcaacucauaaacgauuccaaucuaucauucaaaucaauaaucgaaaaagaacaaguuaguacgacugauaaagaccuacagucaauuguagcagaccucgcugggagucccgccauaaagaaagguauauuacaaaguuuaaaaauaguagacgaacugguaaguauaaugggauacccaccucaaaccauuguuguagaaauggcccgagaaaaccaaaccacaguaaaagguaaaaacaauucaagaccacgauauaaaucacuagaaaaagcgauaaaagaguucggaagucaaauacucaaagaacauccuacugacaaucaggaacuaaagaauaaucgccuauauuuauauuacuuacaaaacgguaaagauauauacacaggacaagaauuagacauacacaacuugagcaacuaugacaucgaccauauuguuccacaaaguuuuauuacagacaacucaauugacaaccuuguacuaacaaguagcgcuggaaauagggaaaaaggaggcgacguaccaccuuuggaaauaguacgaaaacgaaaaguguuuugggaaaaauuguaucaaggcaaccuaaugagcaaaagaaaauucgacuauuuaaccaaagcagagcgagguggauuaacagacgccgauaaagcgagguucauacaccgacaauugguagaaacccgacagaucacuaaaaacguagcaaacauacuacaucaaagauuuaacaaugaaacagauaauuacggcaauaccauggaacaaguacgaauaguaacccugaaauccgcauuaguaagucaauuucgaaaacaauuucaauuauacaaaguaagagaaguaaacgauuaccaccacgcucacgaugcauaccuuaauggaguuguagccaacacuuuacugaaaguauauccacaacuagaaccagaauuuguauacggagaauaccaccaauuugauugguucaaagcaaacaaagcuacagcuaagaaacaauuuuacacuaauauaauguuauuuuucgcccaaaaagagagaauaauagacgagaauggugaaauacuaugggauaagaaauauuuagaaaccauaaagaaagugcuagauuacagacaaaugaacauugucaagaaaacggaaauucaaaaaggcgaguucucaaaagcuacuauaaaaccaaaagguaauucuucaaaacuaauaccaagaaaagaaaauugggacccaaugaaauauggaggauuagacagcccaaacauggcauaugcuguaauuauagaacaugcaaaaggcaaaaagaaaauagucauagaaaagaaauuaauucaaauaaacauuauggagcguaaaauguucgaaaaagaugaagaggccuuucuugaagaaaaaggauaccgacauccaaaaguuuuaacaaaacuaccaaaauacacguuauacgaaugcgaaaaaggcagaagacgaaugcucgcauccgcaaaugaagcucagaaagggaaccaauuaguacucucuaaccaccugguaagucuacucuaucaugcgaaaaauugcgaagccuccgacggaaaaucacuaaaguauauagaagcacaucgagaagcguucucagaacuacucgcacaaguuagcgaauuugcaacucgauacacacuagcagaugcaaacuuaagcaaaauuaauaacuuauucgaacaaaacaaagaaggcgacauaaaggcgauagcccaaucauuuguugaucuaauggucuucaaugcaaugggcgcuccagcguccuuuaaauuuuucgaggcaaccauagauaggaaaagauacacaaaucuaaaagaauuacuaucaucgaccauaauuuaccaaucgaucacuggacuauaugagucaagaaaaaggcucgacgacuga

SEQ ID NO: 5278 - RNA, 4005 nt, Artificial Sequence
  Cas9 variant
augaaaaauccauacacaauaggauuagauauagguacaaauagcguaggaugggcuguacuaacggaccaauaugaccugguaaaacggaaaaugaaaguagcaggaaacagugacaagaagcaaauaaaaaaaaacuuuugggggguacguuuauuugaugaaggcgagacagcggcugauagacgaaugaaccguacugcaagacgacgcauugaacgacgacgaaauagaauaucauacuuacaagaaauauuugcacuagagauggcaaacaucgaugcaaacuuuuucugucgauugaacgacaguuuuuauguugacucagaaaagagaaacucuagacauccauuuuuugccacaauagaagaggaaguagccuaccacaaaaacuacagaacaaucuaccauuuacgagaggagcuaguaaacucgagugaaaaagcagaccuccguuuaguguacuuagcucucgcacauauaauaaaauauagagguaauuucuuaauagagggagcacuagauacuaaaaacacaagcguugacggaguauauaaacaauucauucagaccuacaaccaaguauucauaucaaauauagaagagggaacauuagcaaagauggaagagaacacuacaguagcuaacauacucgccgggaaauucacgagaaaagagaaauuggaaagaauacuacaauuguaccccggagaaaaauccacaggcauguucgcacaguuuaucucacuaauagucgguucaaaagggaauuuucaaaaaguauucgaucuuguagaaaaaacagauauugaaugcgcuaaagacaguuaugaagaagaucuagaagcacuacuagcaauaauaggcgaugaguaugcugaauuauucguagccgcaaaaaauacuuacaaugcgguaguacuaaguucaauaauaacaguaacagauacagaaacuaaugcgaaacuuucagcaucaaugaucgaaagauucgacgcccacgaaaaagaccuaagugaauuaaaagccuucauaaaauuacacuuaccaaaacaauacgaagaaauauuuucgaacguagcaauagacggauaugcuggcuacauagacggaaaaaccaaacaaguagacuucuacaaauauuuaaaaacauuacuagaaaacauagaaggagcggauuacuuuauagcaaaaauugaagaagaaaauuuucucaggaaacaacguacauucgacaacggugcaaucccccaucaguuacacuuggaagaacuagaagcaauacuccaucaacaagcgaaguacuacccauuccugaaagaagcuuaugauaaaauaaaaucacuaguaacauucagaaucccauauuuuguagggccucucgcaaacgggcaaucugacuuugcauggcuuaccagaaaagcggauggagagauacgcccauggaacauagaagaaaaaguagauuucggaaaaagcgcugucgacuucauugaaaagaugacgaacaaagacaccuaccuuccuaaggaaaauguguuacccaaacacaguuuauauuaucaaaaauauaugguauauaacgaacuaacgaaaguuagauauauagaugaccaagguaaaaccaacuauuuuucaggacaagaaaaacaacaaaucuuuaaugacuauuucaagcaaaaacguaaaguaucaaaaaaagacuuagaacaauucuuaagaaacaugucgcauauagaaagcccaacaaucgaagggcuagaagauucauuuaauucuucauaugcgacauaucaugauuuauuaaaagucggaaucaaacaagaaguacuugaaaacccccuuaacauggaaauguuagaagauauagucaagauacuaacagucuucgaggacaaaagaaugauuaaagaacaauuacaacaauuuuccggaguccuagacggcgcaguauuaaaaaaacuagaaagacgacacuacacaggauggggaagguuaucagccaaacuauuaguaggaauacgggauaaacaaucccaucuaacuauacuagauuauuuaaugaacgaugauggauugaacagaaaccuaaugcaauuaaucaacgacagcaacuugagcuuuaaaucaauaauagaaaaagagcaaguuagcaccacagacaaagaccuacagagcauaguagcagacuuagccggaagcccagcaauaaaaaaaggcauacuucaaagucuaaaaauaguagacgaacuaguaaguauaaugggguaccccccacagacgauagucguggaaauggcaagagaaaaccaaacaaccguuaaaggaaaaaauaacucaagaccaagauauaaaagccuugaaaaagcgauaaaagaauuuggaucccaaauccuaaaagagcacccaacagauaaccaggaacuccgaaauaauagauuauaccuauacuaucuacagaauggcaaggacauguauacaggucaggaauuagauauacauaaccugaguaacuacgacauagaccauaucgucccgcaaucauuuauaacagacaacuccauagauaaccucguauuaacaaguucagccgguaaucgagaaaaaggagaugacguaccaccacuagaaauaguccgaaaacgaaaaguuuucugggaaaaacuuuuucaggggaaucuuaugucaaaacgaaaauucgauuaccugaccaaagcagaacgaggcgggcuaacagaagcagacaaagcgacguucauacauagacaacuugucgagacccgacagauaacaaaaaacguggcaaauauauuacaccagagguuuaacaacgaaacugacaaccacggaaauaacauggagcaaguaagaauaguaaugcuuaaaagcgcauuggugucgcaauucagaaaacaauuucaauuauauaaaguaagagagguaaacgacuaucaccaugcacacgacgcuuauuuaaauggaguuguggcaaauacuuuacucaaagucuacccacaacuugaaccagaauuugucuacggagaauaccaucaauucgacugguucaaagcaaacaaagcgacggccaagaaacaauucuacacaaauaucaugcucuuuuuugcccaaaaagaaagaauaaucgaugaaaauggagaaauucucugggauaagaaauacuuagaaacuaucaaaaaaguauuagacuauagacaaaugaauauaguuaaaaaaaccgaaauucaaaaaggggaauucucaaaagcaacaauuaaaccgaaagguaacucaucaaaacuuauaccaaggaaagagaauugggauccaaugaaauauggaggacuagacucuccaaauauggcauacgcggucauaauagaacaugccaaggguaaaaaaaaaauaguuuuugaaaaaaagauaauaagaauuacaauaauggaacgaaaagcauucgaaaaggaugaaaaaucauuccuugaaaaacaaggauauagacaaccaaaaguacuaaccaaacuaccaaaauauacacuauaugaaugcgaaaauggucgacgaagaaugcuagcaucagccaacgaagcccaaaagggaaaucaacaaguauuaaagggacaacuuauaacacugcuacaucacgcaaaaaacugugaagccucggacggaaaaucgcucgauuauauagaaaguaauagagaaauguuuggugagcuucuagcccacguaucagaauuugcuaaacgauauacucuagcagaugcaaaucucucaaaaaucaaucagcucuucgaacagaauaaagauaaugacaucaaaguuauagcucaaucuuuuguaaacuuaauggcguuuaaugcaaugggggcaccagcaagcuucaaauuuuucgaggcaaccaucgagagaaaacgauauacgaacuuaaaagaacuauugcgagcuacuaucauauaucagagcauaacuggacucuaugaagcacgaaaaagacuagauggauga

SEQ ID NO: 5279 - RNA, 4005 nt, Artificial Sequence
  Cas9 variant
augaaaaauccuuauaccauaggacuagacauagggacuaauuccguagguugggcaguauugacugaucaguacgacuuaguaaagcgcaaaaugaagguugcaggcaauagcgauaagaaacaaauuaagaaaaacuuuuggggaguccgccuauucgacgaaggugagacagcagcagacaggcguaugaauagaacagcaagacgccgcauugaaagaagaaggaauaggaucucauaccuacaagaaauuuucgcccuugaaauggcuaauauagacgcgaauuucuuuugcagauugaaugacagcuuuuauguagauucugagaaaagaaauuccagacacccauuuuucgcaaccauugaagaagaaguagcauaccauaaaaacuauaggacuaucuaucaccuuagagaagaauuaguuaacaguagugagaaagccgaccuaagauuagucuaucuagcacuagcacauauuauaaaauacagaggaaacuuuuugauagaaggagcauuagauaccaaaaauaccaguguggacgguguauauaaacaauuuauccaaacuuauaaucaaguuuucauaucaaauauagaggaagggacucuagcaaaaauggaagaaaauacuacuguagcagacauacuagcaggaaaauucacuagaaaagaaaaauuagaaagaauacuucaauuauacccgggggaaaaaucaacaggaauguuugcgcaauucauaagucuaauaguaggaaguaaaggaaauuuucagaaaguuuuugaucuaguagagaaaacugacauagaaugcgcuaaagacucauaugaggaggaccuagaagcucucuuagccauaauaggagacgaauacgcagaauuauucguagcagcuaaaaacacauacaaugcaguaguccuuuccuccauaauaacaguaacagacaccgaaacaaaugcaaaacuuucugcaaguaugauagaaagauucgacgcacaugagaaagaucuuagugaauuaaaagcguuuauaaaauuacaucuaccgaaacaauacgaagaaauauucucuaauguagccauagacggauaugcaggauauaucgacggaaaaacaaaacaaguagacuuuuauaaauaccuuaaaaccuugcuagaaaacauagaaggagcagacuacuucauagcaaaaauagaagaggaaaacuucuuacgaaaacaacggacauucgacaacggagcaauaccccaccaacuccauuuagaggaacuugaagcuauacuacaccaacaagcuaaauacuaccccuuucuuaaagaagcauacgacaaaauaaagagcuugguaacguucaggauuccuuauuucguaggaccgcuugcaaacggccaaucagauuuugcauggcuaaccagaaaagcagacggagaaauaagaccuuggaacauagaagaaaaaguagacuuugguaaaucugcaguagacuuuauagagaaaaugaccaauaaagacacauaucugcccaaggaaaauguauuacccaagcauucauuguacuaucaaaaguauauggucuacaacgaauugacaaaaguacgcuacauagaugaucaaggaaaaacaaacuacuuuuccgggcaagaaaaacaacaaauauuuaacgacuacuucaaacagaaaagaaaaguaucaaagaaagaccuugaacaauuccucagaaacaugagucacauagaaucacccacgauagaaggacuagaagauaguuuuaacucuucauaugcaacauaucaugaucuucucaaagucggcauaaaacaagaaguucuagaaaacccacuaaacacagaaaugcuagaagacauaguuaaaauacuaacuguuuucgaagacaaaagaaugauaaaagaacaacuacaacaguuuucagacgucuuggacggugcuguccucaagaaauuggaacgccggcacuacacaggauggggacgauugucagcaaaacuauuaguagguaucagagauaaacaaucacauuuaacuauucuagauuaccuaaugaacgaugauggccuaaaccgcaacuuaaugcaacuuauuaaugauucaaaccuaucauucaaaagcauaauagaaaaagaacaaguaucaacuacagacaaagaucuacaaaguauaguagcagaucuagcagggagcccagcaaucaagaaaggaaucuuacaaucuuuaaaaauaguagaugaacuuguaucaauuaugggauaucccccgcaaacuauugugguagaaauggcgcgcgaaaaccaaacaacuguaaaagguaaaaacaacucucgaccuagauacaagagcuuagaaaaagcaaucaaagaguucggcagccaaauacuuaaagaacacccuacagacaaccaggaauuacgcaacaaccgccuauaccucuauuacuuacaaaauggaaaagacauguauacaggccaggaacucgauauucauaaucuaucaaauuacgacaucgaucacaucguaccccaaaguuuuaucacugacaauucaauagacaaccuuguccuaacaaguagcgcuggaaacagagaaaaaggagaugauguuccaccuuuagaaauaguaaggaaacgaaaagucuucugggaaaaauuauuccagggaaauuuaaugaguaagagaaaguucgacuauuuaacaaaagcugaacgaggcggauuaacagaagcagacaaagcuaccuuuauccaccgacagcuagucgagacucgucaaauaaccaaaaacgucgcaaacauacuccaucaacgauucaacaacgagacggauaaucaugguaacaacauggaacaaguaagaauagugaugcuaaaaucugcucuaguuucgcaauuccgaaaacaauuccaauuguauaaaguuagagaaguaaacgacuaccaucacgcucaugaugcauaccuuaacggaguugucgcaaacacccuacugaaaguauauccacaauuggaaccggaguuuguuuacggagaauaucaucaauucgauugguuuaaagcaaauaaagcuacagcuaaaaagcaauucuauacaaacauaaugcuuuucuucgcacagaaagaaagaauaauagaugagaauggcgaaauauuaugggacaagaaauacuuagaaacuauaaagaaagucuuagauuacagacaaaugaacaucguaaagaaaacagagauccagaaaggugaauuuagcaaagcaacaauuaaaccaaaaggcaacucaaguaaauugauaccaagaaaagaaaacugggauccgaugaaauauggcggacucgauucuccaaacauggcauacgcagucauaauagaacacgccaaaggcaaaaagaaagugguauuugagaagaaaauaauaagaauaacgaucauggagagaaaagcauuugaaaaagaugaaaagagcuuccuagagaaacaaggauacagacaaccaaaaguucuuacaaaacucccaaaauacacacuauaugaaugcgaaaacggacgacgacgaaugcuggcaucagcaaaugaagcacaaaaaggaaaucaacaaguuuuaaaaggccaacuaauaacacuccuacaccacgccaaaaauugugaagcaucagacgggaaaucauuagacuacauagaaaguaaccgcgaaauguucggagaacugcuagcacaugucucagaauuugcaaaaagauacacacucgccgacgcaaacuuaaguaagauaaaccaauuguuugagcaaaauaaagacaacgauauaaaaguaauugcacaaaguuucgucaaccuaauggcauuuaacgccaugggagcaccggccucauucaaauuuuucgaagcuaccauugaaagaaaaagauacacaaaucuuaaagaacuauuaagugcaacgauuauauaucaaagcauuacuggcuuauaugaagcaagaaaaagacucgauggauga

SEQ ID NO: 5280 - RNA, 4005 nt, Artificial Sequence
  Cas9 variant
augaaaaacccauacacuaucggacuagacauagguaccaauuccguuggaugggcaguauuaaccaaccaauaugacuuggucaaaagaaaaaugaaaguagcugguaauucggacaagaaacaaauaaagaaaaacuuuuggggaguucgccuguuugaugauggucaaacggcagucgaccguagaaugaacagaacagcgagaagaagaaucgaaagaagaaggaacagaauauccuaucuacaggaaaucuuugcuguagaaauggccaacauugacgcgaacuucuuuugcaggcuuaacgacucauucuauguugauucagagaaaagaaauagccgacacccguucuuugcaaccauagaagaagaaguagcauaccaugacaacuaucgaacaauauaccauuuacgcgaagaacucguaaacagcucugaaaaagcagaccuaaggcucgucuacuuggcacuagcgcauaucauaaaauacaggggcaacuuuuugauugaaggggcucuggacacgaaaaauacaagugucgacgaaguauauaaacaauuuauacaaacauacaaccaagucuucaugucaaacauagaagaaggggcccuagcuaaaguugaagaaaacuuagaaguggcaagcauucuagcagguaaauuuacacgacgagaaaaauuugaaaggauucuuagacuauacccaggagaaaaaucuacuggaauguucgcacaauuuauaagucucauuguaggaaacaaaggaaauuuucaaaaaguguuuaaccucguagagaaaacagacauagaaugcgcaaaagauuccuacgaagaagauuuagaagccuuauuggcaauaaucggcgacgaauaugccgaauuauucguagccgcgaaaaauacauacaacgcaguaguccucucgagcauaaucacaguaacggcuaccgaaacaaaugcaaaauuaucagccucuaugauagaaagauucgacgcacacgaaaaagaccuaggggaacuuaaggcuuucaucaaacuccaucuaccaaaacaauaucaagaaauauucaauaacgcugcgauagacggauacgcaggauauauagacggcaaaacaaaacaaguggauuuuuauaaauauuuaaaaacaacacuagaaaacguagaaggagcggauuacuuuauuacgaaaaucgaagaagaaaacuucuuaagaaaacaaagaaccuuugacaacggaguuaucccacaucaguuacaucuagaagaauuagaagcaauauuacaucaacaagcaaaauauuaucccuuccuucgcgaagacuaugaaaagauuaaaucauuaguaacguuuagaauacccuauuucguaggaccuuuagcuaaaggccaaucugaguucgcaugguugaccaggaaagccgauggcgaaauaagaccguggaauauagaagaaaaaguagacuucggaaaauccgccguugacuucauugagaaaaugacaaauaaagauacauauuuaccaaaagaaaacguauuaccaaaacacucuuuauguuaccaaaaauacaugguauacaaugaacuaacaaaagugcguuauauagacgaccaaggcaaaacaaauuauuuuagugggcaagaaaagcaacaaauauucaacgauuuauuuaaacaaaaacgaaaaguuaaaaagaaagauuuagagcuauuccuaagaaauauuaaccacauagaauccccaaccauugaaggacucgaagacucauucaaugcgucauacgcuacauaccacgaccuacuuaaaguagguaugaaacaagaaucacuagauagcccacucaaugccgaaauguuagaagauauaguaaaaauuuuaacaguauucgaagacaaaagaaugauaaaagaacagcuccaacaauuuagugauguccuagacggcguaguguugaaaaagcuagaacgaagacauuauacaggguggggccgacuaucugcaaagcuauuaguaggcauaagggauaaacagucacauuuaaccauacuagacuaccucaugaacgaugacggauuaaaccgaaacuugaugcaacucauaaaugauucaaaccuaaguuuuaaaaguaucaucgaaaaggaacaggucaguacaaccgacaaagauuuacaaucuauuguagcggaucuagcaggaagcccugccauuaaaaagggaauauuacagagcuuaaaaauagucgaugaauuaguuucaauaaugggcuauccuccccaaacaaucguaguugaaauggcacgagaaaaucagaccacaguaaaaggcaaaaauaacucaagacccagauacaaaagccuagaaaaggcaauaaaagaguucggaucacagauccuaaaagaacauccaacugauaaucaggaacuuaaaaacaaccgguuauaccuuuauuacuuacaaaauggaaaagacauauauacaggacaagaauuagauauacacaaucucuccaacuacgacaucgaccacauaguuccucaaucauucauaacagauaauucgaucgacaaucuagugcuaacaucaucagcaggaaaucgugaaaaaggcggggaugucccaccacuugaaauaguacggaagagaaaggucuucugggagaaacuguaccaaggaaacuuaaugaguaaaagaaaauuugacuacuuaacaaaagcagaaagagguggacuaacugacgcagacaaagcccgauuuauacaucgacaacuuguagaaacacgacaaauaaccaaaaaugucacaaauauacuacaccaaagauuuaauaacgaaacagauaauuacggcaacacuauggagcaagugagaauugugacccuaaaaagcgccuuaguaagccaauuucggaaacaauuucaacucuacaaaguucgagaagugaacgauuaccaucaugcccaugacgccuaucuaaaugguguaguugcuaauacauuauugaaaguauacccgcaacuagaaccagaauuuguuuauggagaauaucaccaauuugauugguuuaaagcuaacaaagcaaccgcaaagaaacaauuuuacacaaauauaauguuauucuucgcacaaaaagagagaauaauugacgaaaauggcgaaauuuugugggauaagaaauaccuagaaacuauuaagaaaguauuagacuacagacaaaugaacauaguuaagaaaacugaaauacaaaaaggagaguucaguaaagcaacaauuaaaccgaaaggaaacaguagcaaacuaauaccaagaaaagaaaacugggaucccaugaaauacgggggauuggacucaccaaacauggcuuaugccgucauaauagaacacgcaaaaggcaaaaagaaaauaguuauagaaaagaaauuaauccaaauaaacauaauggaaaggaaaauguucgaaaaagacgaagaagcauuucuugaagaaaaaggcuacagacauccuaaaguauuaaccaaauuaccaaaauacacauuguacgaaugugaaaaaggacgcagacgcaugcuagcauccgcaaacgaagcacaaaaaggaaaucaacucguacuaucaaaccaucuagugaguuuacucuaccacgcgaaaaacugcgaagccucugacgguaaaucucuuaaauacauagaagcccaccgggaagcauuuuccgaauuauuagcacaaguaagugaguucgcaacaagauauacccuagcagaugcuaaccuaucaaaaauuaacaaccuuuucgaacaaaacaaagaaggugacauaaaagccauugcacagucuuuugucgaucuaaugguguucaacgcuaugggagcuccagccucguucaaauucuuugaagcgacuauugaucgaaaaagguauacaaaccuaaaagaacuacuaucaaguacaauaauauaucaauccaucacaggccuuuaugaaucaaggaaaaggcuagaugauuga

SEQ ID NO: 5281 - RNA, 4005 nt, Artificial Sequence
  Cas9 variant
augaaaaaggaauauacaauuggauuagauauaggaacaaacaguguggggugggcaguccuuaccgaaaacuaugacuuaguaaaaaaaaagaugaaaguauacggcaacacggaaaccaaauaccuuaaaaaaaauuuauggggaguacgucuauucgaugaaggagaaacggcagcagaucgccgucuuaaacgaacaacaagaaggagauacagucgaaggcgaaaccgaauaugcagacuacaagacuuauuuacugaagaaaugaaucaaguggaugcaaacuuuuuccaucggcugcaagaaaguuuuuuagucccagacgaaaaggaauucgaacgacacgccaucuuugguaaaauggaagaagaaguaucuuauuaucgugaauuucccaccauuuaccaccuucgaaaacacuuagcagacacuucagaacaagcagauuuaagauuagucuacuuagccuuagcucauauuguuaaauauaggggccauuuccuuauagaaggagaacuaaauacggaaaauucuucugugucagaaacauuucgaacauuuauucagguauauaaccagaucuucagagaaaacgaagucccacuagcagucccagacaauauagaagaguuauucucagaaaaaguuagucgcgcaagaaaaguugaggcaauacuaucagucuacagugaagaaaaaaguacgggaacgcucgcacaauucuugaaauuaaugguaggaaaucaaggaagauucaagaaaacauuugacuuagaggaggauggcaucauacaaauacccaaagaggaauaugaagaagaacuagaaacuuugcucgcuaucauuggugacgaauacgcagaaaucuucucagcuacgaaauccguuuacgaugccguagcuuuauccggaauucugucagugaccgauggagauaccaaagccaaacuaucagcuucaaugguagaacgauacgaagcucaccagaaagaucuaguacaauucaaacaauucauaagaaaagaacucccugaaauguaugcccccauauucagagauaacucaguaaguggauacgcaggauauguagaaaauagcaaaguaguuacacaagcagaauuuuacaaauacauaaagaaagcaauagaaaaggucccaggugcagaauacuuuuuagaaaaaauugaacaagaaaccuuuuuagauaaacaacguacauuuaacaauggcgugauaccacaucaaauccauuuagaagaacuagaagcaauuauucaaaagcaagccacuuauuacccauuccucgcagacaacaaagaagagaugaaacaacucguaaccuuuaggauacccuacuauguaggaccccuugcagaugggaauucuccguuugcuuggcuagaaagaauuagcuccgaaccaauacgcccaggaaaucuagcagaagucguugauauuaaaaaauccgcuacaaaauuuauugaaagaaugacuaacuucgacacguaucucccaacagaaaaaguuuuacccaaacacucaaugauuuacgaaaaauauaugguauacaaugaauuaacaaagguaucauacguagaugaacggggaaugaaccaacgcuuuucgggagaagaaaaaaagcaaauaguagaagaguuauuuaaacaaucuagaaaaguaacaaaaaaacuauuagaaaaauuccugucaaaugaguucggacuagucgaugucgcuauaaaaggcauugagacaucuuucaaugcaggauacggaacauaccacgacuuucuaaagauagguaucaccagagaacaacuugauaaagaggaaaauagugaaacacuagaggaaaucguuaaaauuuuaacuguuuucgaagaccgaaaaaugauacgagaacaacuuaaaaaauacacguaucucuucgaugaggaaguacuaaaaaaacuagagcgacgacacuauacgggaugggguagacuaagcgcaaaauuacuaauuggaaucaaagaaaaacgaacccauaaaacaauccuagacuaucugauagaagacgacggcggcaaacaaccaaucaaccguaaucucaugcaauuaauaaacgacucugauuuaucauuuaaaagugaaauagcugaagcacaaucugacaugaauacagaagaccuucacgaaguaguacaaaacuuagccgguucuccagcuauaaaaaaaggcauacuucaaagucuaaagauagucgacgaauuaguggauaucaugggaucacuuccuaaaaacauaguaguagaaauggcaagagaaaaccaaacuacaagccgaggacguaccaacucaaaucccagaaugaaagcacuagaagaggcaaugagaaacuuaagaagcaaucuacuaaaagaauacccgacggauaaccaagcucuacaaaaugaucgauuauaccuauacuacuuacaaaacggaaaagacauguauacuggucuagaccuaucucuacacaauuuaucaaguuacgauauagaucacaucguaccacaaaguuucacaacggacaacucacucgacaaucgcguucuuguuucauccaaagaaaaucgcggaaaaaaagacgaugucccaaguaaagaagugguacaaaaaaauauaacucuuugggaaacacuaaaaaauucgaaccuaaucucacagaaaaaguaugacaaucugaccaaaggacuaaggggaggauuaacugaagacgacagagcucauuuuauaaaaagacaacuaguagaaacaagacaaaucacuaagcacguagcaagaauauuggaucaacgauuuaacagucaaaaagacgaagaaggaaaaacaaucagagcaguccgagucguaaccuuaaaaagcucacuuacaagucaauuccguaaacaauuugcaauacauaaagucagagaaauaaaugacuaucaucauggucaugacgcguaccucaacgguguaguagcuaacagucuacuacgaguauacccgcaacuccaaccagaauucguuuacggagauuacccaaaguuuaaugccuacaaagcaaauaaggccacagcaaaaaaacaauuauauaccaauaucaugaaauucuuugcagaggacgcaguaauaauagaugaaaacggagagaucuuaugggauaaaaagaauauugcaacaguaaaaaaaguaauguccuacccucagaugaauaucguaaaaaaacccgaaauccaaacaggaucuuuuagcaaggaaacaauuaaaccuaagggagauucugacaaacucauaucaagaaaaaccaacuggucgccuaaacuauacggaggauuugauucaccccaaguagcauacucaguaauaauaacauacgaaaaagguaaaaaaaaaguacgugcgaaagcaauaguaggcauuacaaucauggaacaaucauuauucaagaaagauccaguaucauuauuagaagaaaagggauacgcaaacccugaaguauuaauucaccugccaaaauacaccuuauaugagcucgaaaacggacgucguagacuacuagccagcgcgaacgaagcacaaaaaggcaaucaacuaguccuaccagcgucucugguaacacuacuguaccacgcgaaacaaguagacgaagacaguggaaagucagaagaauacguacgagaacaccgugcagaauucgccgaaauacuaaacuauguccaagcauuuagcgaaaccaaaauacuagccaacaaaaaucuccaaaccauccuaaaacuuuaugaagagaacaaggaagcugacaucaaagaaauugccgagaguuuuguuaaccuuaugaaauuuucagcauacggagcaccaauggauuucaaauucuuuggaaaaacgauuccgagauccagauacacuucgguaggcgaacucuuaucugcuacaauaaucaaucaaaguauaacaggucuuuacgaaacgagacguaaacuaguagauuga

SEQ ID NO: 5282 - RNA, 4005 nt, Artificial Sequence
  Cas9 variant
augcguaaaccauacaccauaggacuagacaucggaacaaacagcguaggcugggcaguuuugacagaucaguacaacuugguaaaaagaaaaaugaaaguugcagguucagccgaaaagaaacaaaucaaaaaaaacuucuggggaguaagacucuuugaugaaggagaaguggcagcaggacgacgaaugaauaggaccacaagacggagaaucgaaaggcgacgaaaccgaaucgccuaccuacaagaaauauuugccgcagaaauggccgaaguagacgcaaacuuuuuuuacagauuagaagauuccuucuauauagaaucagaaaaacgacauucaagacacccauucuuugcaacgauagaagaagaaguagccuaccacgaagaauacaaaacaauuuaucaccuacgagaaaaauuaguaaauucgagcgacaaagcggacuuaagauuaguauacuuggcguuggcacacauaauaaaauauagaggaaauuuucuaauagagggaaugcuagacaccaaaaacacaaguguagaugaaguauucaaacaguuuauacaaacauauaaccaaauauucgcuagugacauagaggaaggaucauuaaccagacuugaagaaaacaaagaaguagccgaaauacuaucugagaaauuaacgagaagagagaaacuugauaagauacuaaaacuguacaccggugaaaaaucaacaggaauguuugcaagguucauuaauuuaauaauuggcucuaaaggagacuuuaaaaaaguuuucgauuuagacgaaaaagcagagauugaaugcgcuaaagauacauacgaagaagauuuagaagcauuacucgcaaagauaggagacgaauaugcugaaauuuuugucgcugcaaaaucaacauauaacgcaguaguacuuucaaacaucauaaccguuacagacacugaaacaaaagcaaaauuaagcgcauccaugauagaacguuucgacaaacacgcuaaagaucuuaagagauuaaaagcguucuuuaagaugcaacuacccgaaaaauuuaaugaaguguuuaacgacauugaaaaagacggcuaugccggauacauagacggaaaaacgacgcaagaaaaauucuauaaauacaugaaaaaaauguuagcaaacauagacggagcugacuauuucauugaccaaauagaagaggaaaauuucuuacgaaaacaaagaacauuugauaacggcacuauaccacaccaacuacaucuggaagaauuagaagcuauccuacaccaacaagccaaauacuauccguuucuaagaaaagauuacgaaaaaauaagaucacucguaacauucagaauaccauacuucauagguccauuagcaaauggacaaagcgacuuugcaugguugacaagaaaagcagacggagaaaucagaccauggaauauagaagaaaaaguagacuuuggaaaaucagcaaucgacuuuauagaaaaaaugacaaauaaagacacauaucuaccaaaagaaaacguguuaccaaaacauucacuaugcuaucaaaaguauaugguuuauaacgaauuaacuaaaaucagguauaucgaugaccaaggaaaaacacaccauuucucagggcaagaaaaacaacaaauuuuuaauggguuauuuaaacaacaacguaaaguaaaaaaaaaggauuuagagcgauucuuguauacaaucaaucauaucgaaaguccuacgauagaaggcgucgaagacgcguuuaacuccucauucgcuaccuaucacgaccuacaaaaggguggagugacccaagaaauauuagacaauccccuaaacgcugauaugcuggaagaaauagucaaaauauuaaccguauucgaagacaaacgcaugauuaaagaacaauuacaaucuuucucugacguucuugacggaacuauccugaaaaaacuagagcggcgucauuauaccggcuggggacgcuuaagcgcuaaacuccuaacaggcauaagagacaagcauagccaucuaacaaucuuagacuaucuaaugaacgacgauggcuuaaauagaaauuuaaugcaacucauaaaugauucuaacuuauccuuuaaaucuaucaucgaaaaagagcaaguaucuaccgcagacaaaggcauucaaaguauagucgcugaacuagcuggauccccagcaauaaaaaaaggaauacuucaaucccuaaaaauaguugaugaauuaguaggaauaaugggcuauccaccacaaacuauaguaguagagauggcccgagaaaaccaaacuacagggaaaggcaagaauaauagcaagccacgauuuaucucauuagaaaaagcaauaaaagaauuuggcucacaaauccuuaaagaacaccccaccgacaaucaaugcuuaaaaaaugauagauuguacuuauacuaucuacaaaaugguaaagacauguacacagggaaagagcuagauauccacaacuugucaaauuaugacaucgaccauauaauaccacaaagcuucauaacugauaacuccauagacaacagaguucuuguuucaucaacagcaaauagagaaaaaggagauaaugugccgcuacuagaagugguaagaaaaagaaaagccuucugggaaaaauuauaucaagccaaacuaauguccaaacggaaauucgacuaccuaacaaaggcagaacgcggggguuuaaccgaagcagacaaagcaaauuuuauucaaaggcaacuaguggaaacuagacaaauaacuaaaaacguugccaauauacuauaccaaagauucaauugcaaacaagacgaaaacggaaacgaagucgaacaaguuaggauugucacccuaaaaucaacacugguaucacaauuuagaaaacaguuccaacuauauaaaguaagagaaguaaacgacuaucaucaugcacacgaugcauaccuuaaugggguuguagcaaauacacucuuaaagguuuauccacaacuagaaccagaauucguauacggcgauuaucaucaauucgacugguucaaagcaaauaaagcuacugcaaaaaaacaauuuuacacgaauaucaugagauucuucgccaaagagaaucaaauaaucgauaaaaauggagagauacuaugggacaacagauaucuagauacaauuaaaaagguauuaucauacagacaaaugaauaucguaaaaaaaacggaaauucaaaaaggagaauuuuccaaugcaacuguaaaucccaaaggcaacucaagcaaacuaauaagcagaaaagcugacuggaacccaauaaaauaugggggauuugacggaucuaacauggcauacuccauaguuauagaauaugagaaacgaaaaaaaaaaacaguaauaaaaaaagaacucauccaaauaaacauuauggaaaggguugcuuuugaaaaagaccaaaaagcguuucuagaagaaaaaggauauuauucgccaaaaguucuaacaaaaauucccaaauacacucucuaugaaugugaaaacgggcgacgaaggauguuagguagugcuaaugaagcucagaaagguaaucagauggugcuaccaaaucaucugaugacacuuuuauaucacgcaaaaaauugcgaagcaaaugauggagaaucacuagccuacauugaaaugcaucgugaaauguuugcagaacuuuuggcauauauuucagaauucgcaaaacgauauacauuagccaaugacagauuggaaaaaauaaauauguuuuuugaacaaaacaaaaagggcgauauuaaagucauugcuaaaucauucgauaaacuuaaaguauucaacgcauuuggcgcaccucgcgacuuugaauuuuuugaaacaacgaucaaacgaaaaagauauuauaacaucaaagaacuucuaaaugccacgaucaucuaccaaagcauaacaggacuguaugaagcuagaaaaagacuagaagauuga

SEQ ID NO: 5283 - RNA, 4008 nt, Artificial Sequence
  Cas9 variant
augaaaaacuauacgauaggcuuagauauaggaacaaacagcgugggcugggcuguaauaaaagaugaucuaacacugguaaggaagaaaaucaaaauaucagguaacacagauaagaaagaaguaaagaaaaauuuauggggcagcuuccuauucgaacaaggagauacggcacaagauacgagagucaaacgaaucgcaagaagaagauaugaaagacgacgauuccgaauaagagaacugcagaaaaucuuugauaaaucaaugggugaaguggacaguaacuuuuuccauagauuagacgaaucauucuugguggaagaagauaaagaauauucuaaauacccaaucuucucuaaugaaaaagaagacaaaaauuauuaugauaaauacccgacgaucuaccacuuaagaaaagauuuagccgauucaaaucaaaaagcggaucuccgacuaauauaccuggcauuagcacauaugauaaaauaucgcggacacuucuuaauugaaggcgacuuaaaaauggacggaaucuccauuagugagagcuuucaagaguucauagacaguuauaacgaaguuugcgccuuagaagaugaaaaucuagaaauaaucuacaaugaugaacuauuaacacaaaucgaaaacauauuuaaacaagacaucagucgaucaaagaaacuagaucaagcuauagcgcuuuuucaaggaguaaaaaggcaaagccuauuugguauauuucuaacacuuaucgucggaaacaaagcaaacuuccagaaaauuuucaaucuagaagacgauauaaaacuugaucuaaaagaagaagauuaugacgaaaacuuagaggaacuacuaucaaacauagaugaaggauaccgagaugucuucuuacaagcuaaaaacguauacaaugcaauagaauuaagcaaaauacuaaaaacugacggaaaagaaacaaaagcaccguuaucagcacaaauggucgaacuauacaaccaacaccgcgaagauuuaaagaaauauaaagauuauauuaaggcuuaccuacccgaaaaauacggagaaacauuuaaagaugccacuaaaaauggauaugcagguuacauagaugguaaaacaucacaagaagauuuuuacaaauucguaaaagcacaacuaaaaggugaagaaaacggagaauacuuccuagaagcuaucgaaaaugaaaauuuucuacgcaaacaaagaucauuuuacaacggaguuauaccauaucaaauacaucuacaagaacuaacagcugucuuagaccaacaagaaaaacauuauuccuuucuuaaagaaaacagagacaaaaucaucucauuauugacauucagaaucccauacuacgucgguccucuugcaaaaggcgaaucaagauucgccuggcuagaaagaucaaauuccgaagaaaagauaaaaccauggaacuucgacaaaaucguagacauagauaaaucagcagaacucuucauagaaaaucuuacaucucgagauacauaucuuccggaugaacccguacuuccaaaacgcagucucauauaucaaaaauucacgauuuuuaacgaacuaacuaaaauaucauacauugacgaaagaggaauacuucaaaacuuuagcaguagagaaaagauagcaauuuuuaacgaccuauucaaaaacaaaagcaaaguaacuaaaaaccaauuaguuaaauacauugaaaauaaagaacagauaauagccccagaaaucaaaggaauagaagauucauucaauaguaacuauucaacauacauagacuuaucaaaaauaccagauaugaagaaacuuuuggaaaaagaugaagacgaaauccucgaagaaauaauaaaaauacuaaccauauucgaagauagaaaaaugcgaaaaagacaacucaugaaauuuaaagacaaacuuucugagaaagcaauaaaucaacucucgaagaaacacuauacaggcuggggacaauuauccgagaaauuaauuaauggaauaagggacgaacaaucaaauaaaacgauauuagauuaccugauagaagauaacggcugcccuaaaaauaugaaucgaaacuuuaugcaacuaauuaaugaugacacccuaucauucaaagagaaaaucagaaaagcacaagacauaaaucagguaaacgauaucaaagaaauaguaaaagaccucccaggaucaccagccaucaagaaaggaauauaccaaucaauccgaauaguggaugaaauaauuagaaaaaugaaagaucgccccaaaaauaucgucaucgaaauggcacgagaaaaccaaacuacacaggaaggcaaaaauaaaaguaaagcaagauuaaagaaaauacaagaaggauuagaaaaucuagauucugugcacguagagaaacaagcccuagacgaagaaaugcuuaaaucaccaaaauacuacuuauacugucuacaaaauggaaaagacauauacacaggaaaagaccuagacauaggacaacuacaaacauaugauauagaccauauaauuccacguagcuucauuacagacaacucauucgauaacuuaguacuaacuucaaguacaguuaacagaggaaaacuugauaacguuccgagcccugauaucgucaggcaacaaaaaggauucuggaaacaacuacucagagccggacuuaugucacaacggaaauucaauaaccuaacaaaaggcaaacuaaccgacagagacagacaacaguucaucaauagacaacuuguagaaacuagacaaaucacaaaacauguagcuaacuuacuaagccaucaucuuaaugaaaagaaagaagucggagaaauuaacaucguccuauuaaaaucugcacuaacgagucaguuucgaaagaaauucgauuuuuauaaagugagagaagugaaugacuaccaucacgcucacgacgcauaucuaaacggaguuauagcauuaaaauuauuagaacuauauccauauauggccaaagaccucauauacggaaaauacagcuaccauaggaaaauagaaggagacaaagcaacacaagccaaauauaaaaugucgaauauaaucgagcgauuuucccaagaccucuuggccaauccagacggcgaaauagcaugggagaaagacaaggauuuaaauacaaucagaaagguacuaagcagcaaacaaaucaauauuauaaagaaagcagaagaaggcaaaggaaggcuauucaaagaaacaauaaacucaagaccaucaaagaaaacugagaaaaggauaccaauuaaaaacaaucucgauccaaacauauacggcggauauauagaagagaaaauggcauauuacauagcaauaaauuaccucgaaaacggaaaaacuaagaaagccauaguaggcauauccauuaaagacaagaaagacuucgaagggcaaacgaccgaauaucucgggaaaauuggauucaacaaagccagcaucauaaacucauucaaaaauuauacacuuuucgaacuagaaaaugggucucgcagaaugaucguuggcgcuagcaaagaaaacgacucgaaaggagaauuacaaaaagggaaucaaauguaccuuccucaaaaucuauuggaauuuguuuaccaucuaaaacacuacaacgaagacgaaacaucacacaaauucauuguugaacacaaagccuauuucgacgaacucuuaaacuauauaguugaguucgcaaacaaauacuuagaacuagaaaacucaauugagaaaaucaaagaccucuaucacggaaaagguccagacguggaagaaaaagaacucguugaaucauuuauaaaccuacuagcuauuacaaaaugcggacccgcugcggacauaacauuucuuggagagaaaaucucacgaaaaagauaucgauccacaaacugucuauggggcagcgagguaauauuucaaagccccacagggcuauacgaaacuagguuaagacucgaguga

SEQ ID NO: 5284 - RNA, 4011 nt, Artificial Sequence
  Cas9 variant
auggacgacaacuaccagcuuaugcaugcuaaaggcaaauacggauauggcacacgcauauauuccgaaggucaaacagcggccgauagaaggggauuccgaacaacacgaagaagacuaaaccguagaaaauggcgcuuaagauuacuucaggacuuuuucgaaccauauauccuaccacaagacgaagcauucuuuauaagacaaaaacaauccaaucuaguaccacaagauacuaagaaacaauaucccgaaagcguacucuuugaugauacgucagauaaagauuuuuauacagaauaucccacaauauaucaucuaagacaggcuuugaugacagaaaaccgccaauuugacaucagagaagucuacuuagcaauucaucauauaguaaaauauagaggacauuuccuuaauaaugccccaguuaaaacauuuaaaaguggaaaccucgaccuagccauaaaauucaacgaacucaacgaagaguucaaaaguguuuacccugauuuagaacuacaauucaaucuugaccaaauugacgaaauaaagaaaauacuacuagacucaacaaaaucacgguucgaccgucaaggagaagcuguaaaauuaauauacacaguuagcgaaguaaaaacaauugaaaaacugcaaaauaaaauaguuaaacaguuccucagugguauacuaggacuaaacacacgauucgauguccuaacuaacacagaaucggaugacucuauguggaaauuuagccuggacagugaaagcagugaugaugcucucgacgaaauaauagcacaauuagacgauccagccauacacguuguagaauuaguaaaugaaauccacagcaguauuacauuagcagguauagucccagaaggacaaggauuaucagaauccauggucgaaaaauaugaagcacacaaagcucaccuucaauuacuaaaagcaguagaaaaacucguagacaagaaagcagccgacaaauuggaagucgcuuacgaccaauauauaaacggcaaagacucaaaacaguucauaaaagaagacuucuacaaagcgguccagagugaaauaaaaggugucgcaggcgacgaagucgcagaaauaaaccaauuaauagagcuagaucaguuuaugccaaaacagagaacgaaagaaaauggagcaaucccacaucaacuacaccaacaugaacuugauguaaucauagaaaaucaauccaaauauuacgacuggcugggagaaaaagucggcaaugaauauaaacuugauaaacucguaaguuuuagaguaccuuauuauguaggcccccuaguagacacagcaucaaaagaaaagaaagacgaaacuagauuugcauggaugguccguaaaaauccagagucgacagaagcgauaaccccuuggaacuuugaagauauaguagacaaaaaugcaucagccgaaaacuuuaucaaacgaaugacaacaaaagauaaauacuuauuaaacgaagauguauuaccaaaaugcucucuucuaacacaagauuucgaaguauacaacgaauuaaacaacauacgagugaauggugagaaauuuacggcagaacaaaaacaauuaauacacgacgaauuguucacaaaacaugcaagcguaucaauaaaacagcugaaagacuuuuuaguaagcgaacuaauguacguucgagauaacuuaaaaguagagggauuagcagaugaaaagaaacuaauguccucacucucaacucaguucgacuaucagaaaauaauaccugaccaaauuaaugauguuaaauaucgagaagauauagaacaaaucauugaauggucaacuauauuugaagaugccgcaauuuuuaaaacaaaauuaaaagaaaucgauuggcuaacagacgaacaacguaauaaacucgcgaacaaacguuauagaggauggggaaguuuaucaaaaagacuguuagccuguuuaguagacgagaauggacaaagaaucaucgacauuuuaagggacagcagugacaacuuuaugaugaucguaaacagacccgaguucaaacaagcuauauucgaugaaaacgcaaacuuaaccgaaacaaauucaaagaaagauauguucgaaaugauagacaacuucuacacuucaccucaaaauaagaaagcaauccgucaaguccuacucguaguucaagacauacaaaacgcuaugggaggaguagcaccacagaaaaucuuuaucgaguuugcacgagaagacgaaguaaauggaagaaggacaaauucaagauauagucaaauaagagaaauguauucuaaaguuaccgaugauguaauaaacaaaacaguaagaggagaacuugaagcaaacaaaggaucauuaaauaaagaaaaacucuuccucuacuuucuacaaggaggaauugaucuauacagcggcaaaacuaucaauauagauaauaucucaucauacgauguagaccauguccuaccacaauccuuuauaaaagaugacucaauuaacaacaaagugcucguaaacgcaaaagguaaccgagucaaaaacgacaauguaccaauggaguuauuuggagcgaaaauguauccaacguggaaacgcaugguagacacugggauaaugucgaaagcuaaauuuaaaaacuuaacgcuaaacccggauaacguugacaaauucaaagccgaaggauucaucaaccgccaacuuguagagaccagacaaauaauaaagcuagucgcccagauauuaaacgauaaauuaggcgaugauacaaaaauaguaucuguaaaagcaaacuuaacccacgacaugaggguauucuuugauuuccccaaaaaccgaaacguaaacaacuaccaucacgccuucgacgcguacuuaucagcauuuguaggaacauauuuauacaaaagauacccuaaauuacaaccauauuuuguauauggcgaauuuaagaaaauggauaaacuuaaaaacaugacguccuucgacuuccuccgugacuuaaaacacacagacaaagugguagauaaagacacaggggagauaauagcugauaaacuagccguuauaacaaacaugaauaaaauauaugauuucaagaaagucuuagugacccacgaaguacacgaaaacucaggggccauguacgaccaaacccuauacccugcaaaacucgauaaaucacucggucgcaaaggagcuaaacaacuuaucccgaagaaagaugauaugcccacugcacuauauggagguuacaccggcucaaaagaugccuuuaugucgauaguaagacuuaaaaagaaagaugaaguuuacuauaaaguaauaggaauaccaguucgcauagcagacucuguacaacacggaaaagaggucgacguggaagcacuaacccaguuuauagaaacaaaauucaccaaagaaaaucuaaauaagaaaaccggggaaauaacacgaaaaguagaaugguuugaacuuguccuucccaaaguccuauucggccaagccguauucgauggagggcaaccauuuaugcuugguagcagcacuuacccccauaaucuacgagaacucguuuuaacaaaagauucaguaaagaaaauagcugggaaagaaucgaacaaaaguuaucuagacgcuuacgacgaaauaauggaggcaaugaacaaauacuucccacucuaugauacaaacaaauuccgugaaaaaguaauagagggaagaucaaaauucauagauuugccugauaaagacgaguacgaaaacaauaaacuuguacaaguaggcaaaucaaccauaaucgacagaauguuuauaggucuacaugccaaugcugcacgaaccgaucuuaaaaauauagguauaacaaccccauucggcuucaugcaacaagccucuggaauaaaauuaacaaaagauacaguaguuuuauuucaaucaaguaccggcuuguuugaacggaaaguagcauuaaaagauuuauga

SEQ ID NO: 5285 - RNA, 4011 nt, Artificial Sequence
  Cas9 variant
augacaaaagacuacacaauuggacuugauaucggaacaaacucaguaggaugggcaguccuaacagacgacuaccaauuaaugaaaagaaaaaugucagugcauggaaauacagagaaaaagaaaauuaagaaaaauuucuggggagcaaggcuauucgacgaaggacaaacagccgaauuucgaagaaccaaacgcacuaaccgacgacgccuagcuaggagaaaauaccguuuauccaaacuacaagaccucuucgcggaagaauuauguaaacaagaugacugcuucuuuguaagacuugaagaauccuuucuaguuccagaggaaaaacaauacaaaccagcuaguaucuuucccacauuagaggaggaaaaagaauacuaccaaaaauaccccacgauauaucauuugagacaaaagcuaguagacagcacagaaaaagaagaucuucgacuugucuaccuagcauuagcccaucuccucaaauaccgaggccacuuucuguucgaagguuaccuugacacagaaaacacaucaauagaagaaucuuuuaggguauuccucgaacaauaugggaaacaauccgaucaaccacucauaguacaccaaccaguccuaacaauuuuaacagauaaacuaaguaaaacgaagaaaguugaagaaauccuaaaauauuauccgacagagaaaauaaacucuuucuuugcacaauguuuaaaauuaauaguagggaaucaagcaaauuucaaacgaauauucgaccuugaagcagaaguaaaacuacaauuuuccaaagaaacauacgaagaagaccuugaaagucuauuagagaaaauaggcgaugaauacuuagacauauucuugcaagcuaaaaagguccaugacgcaauacuccuuagcgaaaucaucaguucaacuguaaaacauacucaagcaaaacucucaagcgguaugguagaacgauaugaaagacauaaagccgaccuugccaaauucaaacaauuuguaaaagaaaauguaccgcaaaaagcuacagucuucuuuaaagacacaaccaaaaauggcuacgcuggguacaucaaaggcaaaacuacacaagaagaguucuacaaauucgucaagaaagaacucagcgguguagucggaucagaaccauucuuagagaaaauagaucaagaaacauuccugcucaaacaaagaacauacacaaauggaguaauuccacaucaagugcauuuaaucgaacuuaaagccauaauagaccaacaaaaacaacauuacccauuucuagaagaagcgggacccaaaauaaucgcgcuuuucaaauuucgaauaccauacuaugugggacccuuagccaaagaacaagaagcgagcucauucgccuggauagaaagaaaaaccgcugagaaaauacauccauggaacuucucggaagucguugacaucgagaaaagugcaaugagauucauacaacguaugacaaaacaagacacuuaucugccaacagaaaaaguacuccccaaaaauucauuacuauaccaaaaauacaugaucuucaaugaacuuacaaaaguaaguuacaaagacgaaagaggaguaaaacaauauuucucuggcgaugagaaacaacaaauauuuaaacaacucuuucaaaaagaaagagguaaaauaacagucaagaaacuacaaaacuuucuguauacacacuaucacaucgaaaacgcccacauauuugguauagaaaaagcauucaacgccucauacucaacauaccacgauuuuaugaaauuagccaaaacgaaccaaaaaucaaugcaagaguggcuagaacaacccgaaauggaacccauuuucgaagauauaguaaaaauccuaaccauuuucgaagacagacaaaugauuaaacaccaacucuccaaauaucaagaaguauucggcgaaaaauuacucaaagaguucgcccgaaaacacuauacugguuggggacgauuuagugcaaaauuaauacacggcauucgugaucgaaaaacaaauaaaacuauucucgacuauuuaauaaaugaugacgauguaccagcaaauagaaaccgaaaccuaaugcaacuaauaaacgaugaacacuuaucauuuaaagaagaaauagcaaaagccacugucuucucaaaacacaagagcuuaguagacguaauccaagaucuaccaggcuccccagcaauuaagaaaggaauauggcaaaguuuaaaaauuguagaagaauuaauugccauaaucgguuacaaacccaaaaacaucgucauagaaauggcaagggaaaaucagaaaacgcacagaacaaaaccacgauugaaagccuuagaaaauggcuuaaaacaaauaggcucaacacuacuaaaagaacaacccacagacaauaaagcucuccagaaagaacgcuuauaccuauacuaucuacaaaauggacgugauauauauacaggagaaccauuggauauagaaaaucuucaucaauaugagguagaccauauaaucccuagaucauuuauaguggacaauaguaucgauaauaaggugcuaguagcgaguaagcaaaaucaaaagaaacgugacgacguacccaauaaacagauagucaacgaacaaagaauauucuggaaccaacugaaagaagcuaaauuaauuagucccaagaaauaugcguaccuuacuaaaauagaacuaacacccgaagauaaagcccgauuuauucaaagacaacugguugaaacaagacaaauaacaaaacaugucgcuaacauacuacaucaaucauuucaccaggaagaagaaggcacagauugugacggaguacaaauaauaacuuuaaaagcaacucuaaccucacaguucagacaaacauuuggucuuuacaagguaagggaaauaaauccacaccaucacgcacaugacgcauaucuaaacgguuuuauagcaaacguauuacuuaaacgauauccaaaauuagcaccagaauuuguauacgggaaauauguuaaauacagccuggcucgcgaaaauaaagcaaccgcgaaaaaggaguucuacucaaacauacugaaauuccuagaaucugacgaaccauuuugugacgaaaacggugaaauauauugggaaaaauccuaucaucuuccgcggauaaagaaaguacuguccucucaccaaguuaauguaguaaagaaaguagaacaacaaaaaggaggcuucuacaaagaaacaguaaauucaaaagaaaaaccagauaaauugaucgaacgaaagaauaacugggacgucaccaaauacggaggguuugguucaccaguaauugcauaugcaaucgcauucgucuaugccaaaggaaaaacacagaagaaaacacgagcaauugaaggcaucacaauaauggaacaagcagcauucgaaaaagauccaacaacauuccucaaagauaaaggauucccacaaguaacugaguucauaaaauuacccaaauauacgcuauucgaauuugauaauggcagacgacgauuuuuagccagucacaaagaaucacaaaaaggaaauccauucauacuaucagaucaauuagucacccuacucuaucaugcgcaacauuacgacaaaauuaccuaccaagaauccuucgauuacgucaauacacaccuaagcgacuuuagugcaauacuaaccgaagucuuagcuuucgcagaaaaauauacacucgcagacaaaaacaucgaacggauucaagaacucuacgaagaaaacaaauacggagaaauaucgaugauagcacagagcuuccuacaacuccuucaauuuaaugcaauaggagcuccagcagacuuuaaauuuuucggaguaacaauaccaagaaaaagauacacaucuuuaaccgaaauaugggacgcaacaauaauauaccaaagcgucacaggauuguaugaaacacgaauaagaaugggugaccuaugggccggagagcaauga

SEQ ID NO: 5286 - RNA, 4011 nt, Artificial Sequence
  Cas9 variant
augaccaaagacuacacaauagggcuagauaucggaacaaauagcguuggaugggcagugcuaacagacgauuaccaacuuaugaaaagaaaaaugagcguccauggaaauaccgaaaaaaagaaaauuaagaaaaacuuuuggggugcaagauuauucgacgagggacaaacagcagaauucagaagaacaaaaagaaccaacagacgccgccuugcacgacgaaaauauaggcuaucaaagcuacaagaccuauucgcagaagaauuauguaaacaagacgacugcuuuuuuguuagacuggaagaaagcuuccuuguaccagaggaaaaacaauauaaaccugcgaguaucuuucccacuuuagaagaagaaaaagaauacuaucagaaauacccuacaaucuaucaucuaagacaaaaacuagucgacucuaccgagaaagaagaccuucgacuaguauaucuagcacuugcacacuuauuaaaauaccgaggacauuuuuuauuugaaggcgacuuagauacagagaauacgucaaucgaagaaucuuuuagaguuuuuuuagaacaauauucaaaacaaucugaccaaccgcuaauugugcaccaacccguccuaacaauauuaacagacaaacuauccaaaacuaagaagguagaagaaauauuaaaauauuacccgacagaaaagauaaacucauucuuugcgcaaugcuuaaagcuaauaguaggaaaccaggcaaacuuuaaacguauauucgaccuugaagcagaaguuaaauuacaauucucuaaagaaacauaugaagaagauuuagaaucacuucuggaaaaaauaggagacgaauaccuagacauauuuuuacaagccaaaaagguacacgacgccauauuacuaucagaaauaauaucuucuacaguaaaacacaccaaagcuaaauuauccucuggcaugguagagcgauacgaaagacacaaagccgaccuagccaaauucaaacaauuugucaaggaaaauguaccucaaaaggcuaccguguucuucaaagauacgacgaagaacggcuacgcaggguacauuaagggaaaaacgacacaagaggaauucuauaaauucgucaagaaagagcuauccgggguuguagguagcgaacccuuccuagaaaaaaucgaucaagaaaccuuccugcuaaaacaacgaacauauacaaacggugucauaccacaccagguucacuuaauugaacuuaaagcaaucauagaccagcaaaaacaacacuacccauuucuagaagaggcagguccuaaaauuauugcacuauucaaauuucgaauuccauauuauguugggccucuagccaaagaacaggaggcaucauccuuugccuggauagaaaggaagaccgcugaaaaaaucaauccauggaacuuuucagaaguagucgauauugaaaaauccgcaaugcgcuucauucaacgaaugacaaaacaagauacauaucucccaacagaaaagguguuaccaaagaacagucuucuauaccaaaaauauaugauuuucaacgaacuaacaaaaguaucuuauaaagacgaaaggggcgucaagcaguacuucucaggagacgaaaaacaacagauuuucaaacaguuauuucagaaagaaagaggaaaaauaaccgucaaaaaauuacaaaacuuuuuauacacacauuaccacauagaaaacgcacaaauauuugguaucgagaaagcauucaacgcaaguuauaguaccuaucacgacuucaugaaacuagccaaaacgaaccaaaaagcuaugcaagaguggcuugaacaaccagagauggaaccaaucuucgaagacauaguaaaaauccuaacuauauuugaagaucgacaaaugauuaaacaucagcuuuccaaguaccaagaagucuucggcgaaaaacuucuaaaagaauucgcacgcaaacacuacacaggcuggggaagauucuccgcaaaacuuauucacgggauuagagacagaaagacaaacaaaacaauauuggauuaucuaaucaacgacgacgauguaccagccaauagaaaccggaaucucaugcaauuaauaaacgacgaacaucuaucuuucaaagaagaaauagcaaaagcaaccguauucaguaaacauaaaucacuagucgacguaauccaagaccuaccaggcaguccugcaaucaaaaaaggaaucuggcaaucacuaaaaauagucgaagaacuaaucgccaucauagguuauaaaccaaaaaauauagucauagagauggcaagagaaaaccaaaaaacacaucgcacaagcccccguuuaaaagcauuagaaaacggauuaaaacaaauuggaagcacucuacuaaaagaacaacccacagauaauaaagcccuucaaaaagaaagacuauaccuauauuaccuucaaaacggccgugauauguauacaggagaacccuuagagauagaaaaucuacaccaauacgaaguugaucauaucauuccaagaucauucauaguagauaauucuauugacaacaaagugcucguagcuagcaaacaaaaucaaaaaaaacgugacgacguaccaaaaaagcaaauuguuaacgagcaacgaauauucuggaaucaauugaaggaagccaaacucauuucaccuaaaaaauacgccuaccuaaccaaaauagaauuaacacccgaagacaaagcacgauuuauacaacgacaacugguagaaaccaggcaaaucaccaaacauguagcuaacauauuacaccaaaguuuuaaccaagaagaagaaggcacagacugcgacggaguacaaauaauaacacuuaaggcuaccuuaacaucucaauuucgccaaacuuuuggauuauauaaagucagagaaaucaacccccaccaucacgcgcaugacgcauaccuaaacggauucaucgccaacguucuacuaaaacgauacccaaagcuagcaccagaauucgucuaugguaaauacguuaaauauuccuuagcaagagaaaauaaagcgacagcaaaaaaggaauuuuauuccaacauauuaaaauuccuagaauccgacgaaccauuuugcgaugaaaauggagaaaucuauugggaaaagucacaccacuuaccaaggauaaaaaaagucuuaucgagucaccaaguaaacguagugaagaaaguagaacaacaaaaagguggauucuacaaagagaccgucaauucaaaagaaaaaccagacaaacuuauagagagaaaaaauaauugggacguaaccaaauacggaggauucggaucucccguaauagcguacgcaauagcauucguauaugcaaaaggaaaaacucaaaaaaaaacgcgagcuaucgaaggaauaacaauaauggaacaagcagcauucgagaaagauccaacaacauuccuaaaagaaaaaggauucccacaagugaccgaauucauuaaacucccaaaauauacauuauuugaauuugacaauggcagacgaagauuccuggccucucauaaggaaucacaaaaaggaaaccccuucauauuaagugaccaauuaguaacacuacuguaucacgcccaacauuaugauaaaaucacauaccaagaaagcuuugacuacguuaacacacaccuuagcgacuuuagcgccauacugacagaaguacuagcauuugcagaaaaauauacccucgcagauaaaaacauagagcguauacaggaacucuacgaagaaaacaaauacggggaaacaaguaugauagcacaaucauuccuccaauuacuucaauucaaugcaauaggagccccugcagacuuuaaauucuucggaguaacaaucccuagaaaaagauacacgucccuaaccgagauaugggacgcuacuauuauauaccaauccguaacaggccucuacgaaacucgaauaagaaugggagauuugugggccggcgaacaguga

SEQ ID NO: 5287 - RNA, 4014 nt, Artificial Sequence
  Cas9 variant
augaaaaacaugaagaaaccuuauaccauuggauuagauauaggcacuaacagugucgguugggcagugcugacagaccaauacgaucugguaaaacgaaaaaugaaaauugcaggagauuccgagaaaaagcaaaucaaaaagaauuucuggggaguaagacucuuugaugaagggcaaacggcagcagacaggagaauggcgagaacagcccggcgaagaauagaaagaagaagaaauagaauuaguuaccuucaaggaaucuuugcagaagaaaugucaaagacugacgcgaacuuuuucugcagauuaagcgauucauucuauguagauaaugagaaaagaaauuccagacauccauucuucgcaacaauagaagaagaaguugaauaucacaaaaauuacccaaccauauaucaucuaagagaagaacucguaaauaguuccgaaaaagcggaucugcgacuugucuacuuagcguuggcacacauaaucaaauacagagguaauuuccuaauugaaggggcauuagacacacaaaauacaaguguagauggaaucuauaaacaauuuauucaaacauauaaucaaguauuugcaaguggaauugaagacggaucauuaaagaaauuagaagacaauaaagaugucgccaaaauauugguggaaaaagugacuagaaaggagaaauuagaaagaauauuaaaacuauacccgggagaaaaaucagcggggauguucgcucaguuuauaucauuaaucguuggauccaaaggaaauuuccaaaaaccuuucgacuuaauagagaaaagcgacauagaaugcgcgaaagacagcuacgaagaagaccucgaaagucuccuagcccuaaucggagaugaauaugcagaacuauuuguugcugcuaagaacgcauauucugcagucgucuugagcucaauaauaaccguagcagaaacagaaacaaaugcaaaacuuucugcuagcaugauagaacguuuugauacccacgaagaagaccuuggagaauuaaaagcauuuauuaaacuacauuuaccaaaacacuaugaagaaauauucagcaacacagaaaaacauggcuacgcgggauacauagacgguaagacaaaacaagcagacuucuacaaauacaugaaaaugacacuugaaaacaucgaaggagcugacuacuuuauagcaaaaauugaaaaagaaaacuuucuaagaaaacaacgaaccuucgacaacggagcaaucccacaucaauuacaucucgaggaacuugaagcaauucuccaccaacaagcaaaauacuaccccuucuuaaaagaaaacuaugacaaaauuaaaucccuagugacauuuagaauaccauacuucguaggcccgcucgcaaaugggcagucagaguuugccuggcuaacacgcaaggcugauggggaaaucagaccauggaacauagaagagaaaguugacuucggaaaaucagcaguagauuucauagagaaaaugacuaacaaggauacuuaucuaccgaaggaaaauguuuuacccaaacauagcuuaugcuaccaaaaauaccuaguauacaacgaauuaaccaaaguaagauacaucaacgaucagggaaaaacauccuauuucucuggucaagaaaaagaacagaucuuuaaugacuuguuuaagcagaaaagaaaagucaaaaagaaagacuuagaauuauuuuuacgaaacaugucccauguggaaaguccaaccauagaagguuuagaagauucauucaauucaaguuauucuacguaccaugaccuacuaaaagucgguauaaaacaagagauucuugacaaucccguaaacaccgagaugcuggaaaacauagucaaaauacuaacuguauuugaagauaaacgaaugaucaaagaacaguugcaacaauucucagacguccucgauggagucguccucaagaaacuagaaagaagacacuauacaggauggggacgucuuagcgcaaaauuauuaaugggaauaagagauaaacaaucacaucuuaccauacuagauuaccuaaugaaugaugacggauuaaaccgaaacuuaaugcaauuaauaaaugacaguaacuuaaguuucaagucaaucauugaaaaagaacaagucacaaccgccgauaaagauauacagagcauagucgcagaucuagccggaagcccugccauaaagaaagggauucuacaaaguuuaaaaauagucgaugaacuugucuccguaaugggauauccaccacaaaccauaguuguagaaauggcccgcgaaaaucaaacaacaggaaaaggcaaaaauaauagccggccuagauacaaaucacuagaaaaagccaucaaagaauuugguagucaaauacuaaaagagcaccccaccgacaaucaagaauuaagaaauaacaggcuuuaucucuacuauuuacaaaauggaaaagacauguacacaggacaagauuuagacauucacaaccuaucuaacuacgauauagaccacaucguuccgcaaaguuuuauaacagauaacagcauugauaaccuaguacuaacgucaucagccggaaaucgcgaaaaaggagaugacguaccaccccuugaaaucguaagaaagagaaaaguauuuugggaaaaacuauaucaaggaaacuuaaugaguaaaagaaaauuugacuaucuaaccaaggcugaaagaggcggauuaaccgaagcagacaaagccagauucauccauagacaauugguagagacacgucaaauaaccaaaaauguagcaaacauacuucaucaacgauuuaauuaugagaaagaugaucacggaaauacaaugaagcaggucagaauuguaacccuaaaaagugcacucguaucacaauuccgcaaacaauuucaacuguacaaagucagagaugucaaugacuaccaucacgcacacgaugcauaucuaaacggcguaguugcaaauacucuauuaaaaguauacccacaacuugaaccagaguucguauauggggauuaccaucaauucgauugguucaaagcaaacaaagcaaccgcaaagaaacaguucuauacaaauauuaugcuuuucuuugcacaaaaagaucgaaucauagacgagaacggagaaauacuaugggacaagaaauaccuggauacaguuaagaaaguuauguccuauagacaaaugaacaucgugaagaaaacugaaauacaaaaaggugaguuuucaaaagcaacgauaaaaccaaaagguaacucguccaaauuaauaagcagaaaaacaaauugggacccaaugaaauauggaggacucgauucgccaaacauggcauaugcagucgucauagaauacgcaaaagguaaaaacaaacuuguuuuugaaaagaaaauaauaagagugacaauaauggaaaggaaagccuuugaaaaagaugaaaaagccuuccuagaagaacaagguuauagacaaccuaaagugcuagcaaaauuaccgaaauacacauuauacgaaugcgaagaaggaagaagacgcaugcucgccuccgcaaacgaagcacaaaaagguaaucaacaaguuuuaccaaaccauuuaguaacacuauuacaucauguagcaaauugugaagucucagacggcaagucauuagauuacauagaaagcaaccgagaaauguucgcagaauugcuagcacacguuucugaguucgcaaaaagauauacguuagcagaagcuaaucucaacaaaauaaaccaauuauucgaacaaaacaaagaaggggacauuaaagcaaucgcacaauccuuuguagacuuaauggcauucaaugcaaugggagcaccggcaucauuuaaauuuuucgaaaccacaauagaaagaaaaagguauaacaaccucaaagaacuucuuaauucaacuauuauauaccaaagcauaacaggucuuuacgagucuaggaaaagauuagacgauuga

SEQ ID NO: 5288 - RNA, 4014 nt, Artificial Sequence
  Cas9 variant
augaaaaaauucgaaaacuauuacuuaggccuugauauugguacaagcucaaucgggugggcgguaacgaacucucaguacgauauuuuaaaauucaacggcaaauacauguggggaacacgauuguucccagaagcaaauaccgcucaagagagaagaauacaucguucaagucgaagaagacucaaaagacggaaagagagaauccaaauacuucaaaugcuuuuugauaaagagaucgccaagauugauagcggauuuuuucaacgacuuaaggacucaaaguauuacaaggaagauaaaacugaaaaacaaaccaauuccauuuuucaugacaaagauuauucagauaaagaauaccaucaagacuuucccacaauauaucaucucagaaaauuccucuuagaaggaaauaaaccaaaagauauaagauucguguaccuagcgcuacaccacauuuugacacauagaggacacuuuuuauuuccugacauggaagugaguaacgucacagaauucucaaauauuuuuagugaacuaaaacaguauuuauaugacgaaauggaccucgauuuugaauggaaaaauggaaaauuaaaugaaguugaaaacauauuaaaagaccgaaacuuagcuaaaagcgaaaaagaaaaaaaguuaugcggaauaauagaguuagaaggaaaaauagacaaucaaagaaaggccaugauuggaaugaugugcgggugcaaaaaaaaauucucagaccuguuccaaaacgaaaacuaccgcgaacucgaaauauccucuuucucauucgcagauagcucauacgaagaaaaacgagacgaacuugaaggaauacucgccgaaaacauccuuugucuagacuaccuaaagacaauauacgacuggggaaaacuaucagacauucuacaaggcgaagagucaaucuccgucgcaaaagugaaaucauacgaggaacaucaacucgaccuaaaauauuuaaaaaauaucuuaaaauuguacagucauaaagaaaaggaaaacguauuccggaaaaaagaaggaaaauauccaaaauacauaagugggaaacucucacaagaagaauuuaacaaaaguauaaaaaaaauacuagaggaaauuaaaagcgugaagcaagaagacaggaaaguauuugacacguuguuaaaaagagccucaaacaaucuguuaugccccaaacagguaaucaaagaaaauggggucauacccuaccaaauucacaaauuugaauuagaaaaaauucuccgcaauauggccgauuucuucccaaugcuaaaagaaaaaaaggacggaaaaacacuaucggaaaaaauaauaagcguuuucacauucaggaucccauacuacguaggacccuuaaaucagaacucugacagagccugguuaguaaaaaacaaagaugaaaagauuuacccauggaauuucgaagaaauaguaaaccuagaagagucugccgagaaauucauucaaaacuuaacuaauaaauguacauaccuaguucuggaagacguacuaccaaaaucaucaauuuuauauaguaaauuuaugguacuaaaugaacucaacaaccuaaaaauagacggagaagccauuagugucgaucugaaacaaaaaauuuaccuuaacuuauuccaaaaauauaaaaaaguuacucucaaaaaacuaaaaggauaucuaaagucagaaaacauauuaauagauacgaguacucaaauaacgggcaucgacggugauuucaaaaguucccuggggucguaucuagacuuuuacaacauauuaggagacaaaguaaaaacugauuucggcaaaaaacuaauugaaaauugcauuuuauggauaacuuuauauacaggagaaaaaaaacuucuaaaaaacaaaauaauagcaaauuauaaaggagaacuuagugaagaagaaauaaagaaaauaguaaaucucaaguacaaagauuggggaagacucagcuacgcauuucuagaagagauccaaucagcgucacuagaaacuggagaacuacgaaacaucauacaaaugaugugggagacgaacaauaacuugauggaauuauuaucaagcaacuaccaauuucuaucugaaauagaaaagaggaacagcguaguagccaucggcaaggaauucaacuaugaaacgauauuaggcgauucauacgccucaccaucaguaaagagaaugauauggcaaucauuaagcguugucgaugaaaucaaaaaaauaaugaaaaaagcaccaaagaaaauauuuauagaaauggcacgccaagaagacaugaaaaaggaaagaaaagaguccagaaaaagcaccuucuuaacacuauacaaaucaauuaaagaagaaggaagggacuggaucaaggaaaucgaaaauuggucagauagcgaauuuagaagcaaaaaacucuacuuauauuacacgcaaaugggaaaauguauguauacuggcgaaaaaauaagccuagaccaauuauuuaauaaaaauauauacgauauagaucacauuuacccacgauccaaaaccaaagacgauucaaucgaaaacauugucuuaguaaaaagaaacauaaacgcaaaaaaaaccgaugaauacccacucgaaagaaacauacaacaaaaacaacaugauuuuuggaaaaugcuacacaguaaaaagcuaaucggugacaaaaaauacgaacggcuuacgcgaacaacagaauucacugacgaagaacucuccgauuucauagcaagacaauuagucgaaaccagacaaagcacaaaaauaguagcagauauuuuaaaaaaccuguucccagaaacaaaaaucguauacguaaaggcgaaccucaccuccgacuucagaaagaacuuuaaaauacuuaaaagcagagacauaaaugacuaccaucacgcucacgacgcauauuugaacauaguaacuggaaacgucuacaauauaaaauucacggauaacccaagaaacuucauaaaagauaaaaaauuagaaggcaaaaaauacaauuuaaaagucgaaaaaauauucgaauaucgaaaagaaaaugaaaguuucuggaacccuaaaacaaugguaacaaaaaucgaaaauuacaucuucaaaaagcgaccacaauucaccagguacucguucgaacaacaugguggauucuuugaccagaauauaguagacaaagaaaguugcaaaaaaggcacgggauacauucccauaaaaucaucaaacgccauauuauacaauaccaguaaauacgguggauauggaucaguaaccgggaccuauuucuuccucguagagcauacaaugaaaggaaagagaauccgaaccaucgaaaugaugccucuuuaucuaucgaaaaaaauacacagcaaggaagaauuagaaaaauacuguaaagaaaaacuagaauuacagaaaccgucaguuagauuagcaaggauaaaauauaacucauuacuuaaaauaaauggcuuuccuuaccauauaacugguaaaacuaacgauaguuauuggauaaugagcgcaauacaacuacuauuaucaaaaaauuacuacgaauaccuaagaaaacucuauauauucugcaaagaggagcgacuugaggaggaaaucgucggagaaaagaacaucaaacucuacacuugcauacuugaaaaauuagagaaaagcauauacagccauaaacucuuaaacauuaauuacaauggaaaaaguaaaaacuuaaaagacauacucgaaagcgaaaaagaaaacuuucuacuucucagcgaaaagaaacaagcacaaauucuaaucgaaauauucacauuauuagaaucaaauaacuucggagccaacuuagaaucauucggaugcggaaaaaaaugcggaauaaccaaaauaaacaaaaacauugauaaauuagaagaaguccuauuaaucaaucaaucaccgaccggacuuuuugaaaacucaauagaccucaaaaaagucuga

SEQ ID NO: 5289 - RNA, 4014 nt, Artificial Sequence
  Cas9 variant
augaaaaaggauuauguaauaggucuagauauaggaacgaacagcguaggaugggccguuaugacagaagacuaccaauuaguaaagaagaaaaugccaauuuacgggaacacagagaaaaagaaaauaaagaaaaacuucuggggaguaagauuauucgaagaaggccauacagcagaagacagacgcuuaaaacggacagcaagaaggagaauaaguagacgaagaaaucgucuacguuaccuacaagccuucuuugaagaagccaugacagaucuagaugaaaacuuuuucgccagacuccaagaaucauuccucguaccagaggacaagaaauggcauagacauccaauuuuugcuaaauuagaagacgaaguagcauaucacgaaacauauccuaccauauaucacuuaaggaagaaacuggcagauagcagugaacaagcagaccuacgacuaaucuaucuagcacucgcccacaucguaaaauaccgaggacauuuccuuauagaaggcaaauugagcacugaaaacauaucaguuaaagaacaguuccaacaauucaugauaaucuauaaccaaacuuuuguaaacggcgaauccagauuaguuucugcaccccucccagagucagucuuaaucgaagaagaacuaacagaaaaagcgucaagaaccaagaaauccgaaaaaguauuacaacaauuuccacaagaaaaagccaacgggcuauuuggacaauuccuaaaauuaaugguaggaaauaaagcagauuucaagaaaguauucgguuuagaagaggaagccaaaauuacguaugccagcgaauccuaugaagaagaccuagaaggcauucuagcaaaagugggagaugaauacucugauguauuccuagccgcgaaaaauguuuacgaugcaguugaacuuucaaccaucuuggcagacagcgauaagaaaucacacgcaaaauuaucuucaaguaugauaguaagguuuacagaacaucaggaggaucucaagaaauucaaaagauuuaucagagaaaacuguccagaugaauacgauaaucuguuuaaaaacgaacaaaaagauggauacgcaggauauauugcacacgcagguaaagugucacagcuuaaauuuuaucaauaugucaagaaaauaauucaagauauagcuggcgcagaauacuuccuagagaaaauagcccaagaaaacuuuuuacguaaacagagaacauucgacaacgguguaauaccccaccaaauucacuuagccgaacuucaagcuauuauacauagacaagcagcuuauuacccguuccuaaaagaaaaccaagagaaaauagaacaacucguaacguuucgaauaccauacuacguuggaccccucucuaaaggagaugcaaguacauucgccuggcuaaaaaggcaaucagaagaaccuauucgaccauggaaucuacaagaaacagucgauuuagaucaaucagcaacagccuucaucgaacgaaugacaaauuuugauacuuacuugccuagcgaaaaaguauuaccaaaacauuccuuauuauacgaaaaauucauggucuucaaugaacucaccaaaauuuccuauaccgacgaccggggaauaaaagccaacuuuaguggaaaagaaaaagagaaaauauucgauuaccuuuucaaaacaagacgaaaagucaaaaagaaagauauaauacaauucuaccgaaacgaauacaauaccgaaauaguaacucuaucaggauuggaagaagaccaauucaacgcaucauuuucuacuuaccaagaccuacuaaaaugcggguugacuagagccgaauuagaucauccugacaaugcagaaaaauuagaagacauaauaaaaauacuuacuauauucgaagauaggcaaagaaucagaacccaacuaucgaccuuuaaaggacaauucucagcugaaguauuaaagaaauuagaacgaaaacacuauacaggauggggaaggcuuagcaaaaagcuaauuaaugguaucuaugacaaagaaaguggaaaaacaauacuaggauaucuaauuaaagaugacgguguuuccaaacauuacaacagaaacuuuaugcaauuaauaaacgauagucaacucagcuuuaaaaacgcaauccaaaaagcacaaucaucagaacaugaagaaacucuaucagaaacaguuaacgaacuagcaggaucgcccgccaucaagaaaggaauauaucaaagccuuaaaauuguugacgaacucguagcaaucaugggcuaugcaccaaagcgaauaguaguugaaauggcaagagagaaccagacaacaucaacaggaaaacguagguccauccaacgcuuaaaaauaguugaaaaagcaauggcagaaauagguaguaaccuacuuaaagaacagccaaccacuaaugaacaacuaagagauacuagauuauuccuauacuacaugcaaaacggcaaggauauguacacuggcgacgaacucucacuccauagauuaucccacuaugauaucgaccacaucauaccucaaucauuuaugaaagaugacucacuagauaaucuuguucuaguagguagcaccgaaaaccguggaaaaagugacgauguaccaucaaaagaaguuguaaaggacaugaaggccuauugggaaaaacuauacgcagccggguuaaucucucaaagaaaauuccaaagacuaaccaaaggagaacaaggcggauuaacuuuagaagauaaggcacacuucauucaaaggcaacucgucgaaacaagacaaauaaccaaaaacgucgcaggaaucuuagaucaaagguauaacgcuaacuccaaagaaaagaaaguccaaauaauaacacuaaaagcgagccuaacaucacaauuuagaucaauauucggcuuauacaaaguaagagaggucaaugacuaucaccacggacaagaugccuaucucaauugcguuguagcaaccacccuauugaaaguauacccgaaccuagcucccgaguucgucuauggagaauacccaaaauuucaaacauucaaagaaaacaaagcaacagcaaaagccauaaucuacacuaaucucuuaagauuuuucacagaagacgagcccagguuuaccaaagacggagaaauacucuggucaaacagcuaccucaaaacaaucaagaaagaauuaaacuaccaucaaaugaauauaguaaagaaaguugaaguacaaaaaggagguuucuccaaagaaucaauaaaaccuaaaggaccaucaaauaaacuaauacccgugaaaaauggauuagacccacaaaaauacggaggauuugauucaccaauaguugcauauacaguauuauucacucacgaaaaaggaaagaaaccuuugauaaaacaagaaauccuagguaucaccauaauggagaaaacaagguucgaacaaaauccuauauuauuuuuggaagaaaaagguuucuuaagaccaagaguauuaaugaagcugccaaaauacacucuauaugaguucccagaaggacguagaaggcuguuggcaagugcaaaggaagcacaaaaaggaaaucaaaugguccuuccugaacauuuacucacacuccuauaccaugcuaaacaauguuuauuaccaaaucagucugagucccuaacauaugucgagcaacaccaaccagaauuucaagagauccuagaaagagucguagauuucgcagaaguacauacccuagcaaaaucuaaaguacaacagauaguaaagcuauuugaagcaaaccaaaccgcagaugucaaagaaauagcagcaaguuuuauacaauuaaugcaguucaacgcaaugggagcaccaucaaccuuuaaauucuuccaaaaagacauagaacgagcacgauacacgaguauaaaagagauuuucgaugcaacaauaauauaccaaaguacaacuggcuuauaugaaacuagaagaaaaguaguagacuga

SEQ ID NO: 5290 - RNA, 4014 nt, Artificial Sequence
  Cas9 variant
augaagaaagauuacgugaucggacuagauauaggaacgaacucagucggcugggccgucaugacugaagauuaccaacucguuaaaaaaaaaaugcccauauaugguaacaccgaaaaaaaaaaaauaaaaaaaaauuucuggggaguacgauuauucgaggaaggccauaccgccgaagaccgacgacuaaaaagaaccgcucgaagaagaaucucaagacgacgaaacagauuaagauacuuacaggcauucuuugaagaagcuaugacagaccuagacgagaauuuuuuugcuagauuacaagagucauuuuuaguaccagaagacaagaaauggcaccgucauccaaucuuugccaaacuagaagaugaaguagcauaucaugaaaccuauccaacaauauaucaccuacgcaagaaacuugcagacaguuccgaacaagcagaccuucgacuaauauaucuagcauuagcccauauuguuaaauauagaggccacuucuuaauagaaggaaaauugaguacagagaacacaucaguaaaagaccaauuccaacaauuuauggucaucuacaaucaaacauucguuaacggggaaagcagacuaguuagcgcaccuuuaccugaaucuguacuuauagaagaagaauuaacagagaaagcaaguagaacuaaaaaaucagaaaaaguacuacaacaguucccccaggaaaaagcaaacggacuuuuuggacaauuucugaaauuaaugguaggaaacaaagcagauuucaaaaaaguauucggacuagaagaagaagcuaaaauaacauacgcaagugaaucauaugaagaagaucuagaaggaauacuagcaaaaguaggugaugaguacagugauguguuccuagccgcaaagaauguauaugacgcuguggaacugagcacaauauuagcagauagcgacaaaaaaucacaugcaaaauugaguucaucaaugaucguuagguucacagaacaccaagaagaccucaaaaaguucaaaagauuuauuagggaaaauuguccagaugaauacgauaacuuauucaaaaacgaacagaaagacgguuacgcuggauacauugcccaugccggaaaagugucgcaguuaaaauuuuaucaauacguaaaaaaaauaauacaagauauagccggcgccgaauacuuucuagaaaaaaucgcccaagaaaauuuuuuaagaaaacagcgaacauucgacaauggcgucauaccacaccagauacacuuagccgaacugcaagccauuauacacagacaagccgcuuauuacccauuccucaaggaaaaccaagaaaaaauagaacaauuaguaacuuuuagaaucccguauuauguaggucccuugucaaaaggagaugccuccaccuuugcaugguuaaaaagacaaucugaagagccgauaagaccauggaauuuacaggaaaccguagaccuagaccaaucagcaacagcauucauagaacgaaugacaaauuucgacaccuaccuucccuccgagaaaguauuaccuaaacacucuuuauuauacgaaaaauuuauggucuuuaaugaguuaacgaaaaucuccuauacagacgaccgaggaauaaaagccaacuucaguggcaaagaaaaagaaaaaauauucgauuacuuauucaaaacacgacgcaaagucaaaaaaaaagacauuauacaauucuaccgaaacgaguacaauacagaaauaguaacgcuaucaggacuugaagaagaucaauucaacgcaucauuuuccacauaccaggaucuccuaaaaugcggucuaacaagagccgaacuagaucauccagacaacgcagaaaaacuugaagacauaauaaaaauccucacaaucuucgaagacagacaaaggauccggacucagcucucaacguucaagggucaauucuccgcggaggugcucaaaaaauuagaacgaaaacauuauaccgguuggggcagauuaagcaaaaaacuuaucaacggcaucuacgacaaagaaagugguaaaaccaucuuagauuaccuuaucaaagaugacgggguaucaaaacauuacaauagaaauuucaugcaacuaauaaaugauucgcaguuaucauuuaaaaaugcuauucaaaaagcacaaagcugugaacacgaagaaacacuaucagaaacaguaaaugaauuagcagguucaccugcuauuaaaaaagggauauaccaaaguuuaaaaauaguugacgaauuaguggcuauuaugggauacgcccccaaacgcauaguaguugaaauggcaagagaaaaucaaacaacaucaacagggaaacgaagaucgauccaacgguuaaaaauaguggaaaaagccauggcagaaauaggaucaaaccuacuaaaggaacagccaacuacaaaugaacaauuaagagacacucgauuguucuuguacuauaugcaaaauggcaaagauauguauacaggcgacgaacuuucgcuucaccgacuaagucacuaugacauagaccacauuaucccgcaaaguuucaugaaagacgauucucuugacaauuuaguacucgucggaucaacagaaaacagaggcaaaucugacgacgucccuagcaaaaaaguaguaaaggauaugaaagccuacugggaaaaauuauacgcugccggccucauaagucaacgaaaguuucaaagacuaacuaaaggcgaacaaggugggcuaacucuugaagauaaagcccauuuuauacaaagacaauuagucgaaacacgacagauaacaaaaaacgucgcagguauccucgaccaaagauacaacgccaaaucuaaagagaaaaagguacagauuauuaccuuaaaagcaucucuaacaucccaauucagaaguaucuucggacuauacaaaguacgagaaguuaacgacuaccaccauggacaagaugcauaccugaacuguguagucgcaacaacacuauuaaaaguauauccaaauuuagcaccagaauucguguacggcgaauacccuaaauuucaagcuuuuaaagaaaauaaagcaacggcaaaaacaauaauuuauacaaaccuaaugcguuuuuuuacugaggaugaaccaagauucacgaaagauucagaaauucuaugguccaauucuuaucuaaaaacaauaaaaaaggaacuaaacuaccaucaaaugaacauagucaaaaaaguagaaguccaaaaaggcgguuucaguaaagaaagcauaaagcccaaaggucccagcaauaaacucauaccgguuaagaauggacuagauccacaaaaauacgguggcuucgauucgccaguuguugcauauacuguauuauuuacacacgaaaagggaaaaaagccuuugauaaaacaagaaauucuaggcaucaccauuauggaaaaaacuagauucgaacagaaucccauacuauuucucgaggaaaaagguuuucucaggcccagagugcuuaugaaacuaccaaaauauacacuuuaugaauuucccgaagguagaagaagacuacuagcuucagcaaaagaagcgcaaaaagguaaccaaauggucuuaccagaacaucuauuaacauuguuguaucaugcuaaacaaugccuacucccaaaccaaagugagucucuagcauacguagaacaacaucaaccugaguuccaagaaauacucgaaagagucgucgauuuugcagagguucacacacucgcaaaaucaaaaguacaacaaauaguuaaacucuucgaagccaaccagacagccgacguaaaagaaauugcggcuucauuuauccaauuaaugcaauucaaugcaaugggggcuccuuccacauucaaauuuuuccaaaaagacauugagagagccagauacacaucaauaaaagaaauuuucgacgcuacaaucaucuaucaaucuacaacgggccuauacgaaacgagacguaaaguuguagacuga

SEQ ID NO: 5291 - RNA, 4014 nt, Artificial Sequence
  Cas9 variant
augaagaaagacuauguaauaggauuagacauaggaacaaacucaguaggaugggcgguuaugacagaagauuaccagcuagucaaaaagaaaaugccaauauacgguaauacggagaaaaagaaaaucaagaaaaacuuuugggguguaagacuauucgaagaaggucauacagccgaagaccgcagauuaaaaagaacagcacgacggcgcauaagccgacgaagaaaucgccuaagguacuuacaagcguucuuugaggaagcgaugacagcauuagaugagaauuucuuugcaagacuacaagaaaguuuucuugucccagaagacaagaaauggcauagacacccgauauucgcuaaacuagaagacgaaguagcauaccacgaaacauacccaaccauauaccaucuccgaaagaaacuggcagauuccagcgaacaagcagaccucagacuaauauaccuugcauuagcacauauuguaaaauaccgcggccauuuccuuauugaaggcaaauugagcacagaaaacaucucugugaaagagcaauuccaacaauuuaugauaauauacaaccaaacauucguuaacggcgaaaguagacugguauccgcaccacucccggaaagcguuuuaaucgaagaagaacuuacagaaaaagccucaagaacaaagaaauccgaaaaaguacugcagcaauuuccccaagaaaaagcaaauggacuauucggacaauucuuaaaacuuaugguagguaauaaagcugacuucaagaaaguauuuggacucgaagaagaagcaaaaauaacauacgcaucagaaucguaugaagaggacuuagaaggcauucuagccaaaguaggagacgaauacucagacguauuucuagcggccaaaaaugucuaugaugcaguagaacuauccacuauacuagcagauagcgauaagaaaagucacgcuaaauuauccagcuccaugauuguacgcuucacagaacaucaagaagaccuuaaaaacuucaaaagauucauacgagaaaauugcccggacgaauacgacaacuuauucaaaaaugagcaaaaagauggauaugccggauauauaacccaugcaggaaaagucagccaacucaaauucuaucaauacgugaagaaaaucauacaagauauagcaggagcagaauacuuuuuggagaaaaucgcacaagaaaauuuccuucgcaaacaaagaacauucgacaauggcgucauaccucaccaaauacacuuggccgaacugcaagcaaucauacaucgacaagccgccuauuauccguuuuuaaaagaaaaccaagagaaaauagaacaauuaguaacauuccgcaucccguauuacgucggaccccuauccaaaggagaugccaacacauuugcguggcuuaaacgacaaagugaagaacccauaagaccguggaaucuccaagaaacaguagaccuagaccagucagccacugcguuuauugaaagaaugacaaacuuugacaccuaccucccaucagaaaaagucuuaccgaaacacucccuauuauacgaaaaauuuauggucuucaacgaacuuacaaaaauaagcuacaccgaugacaggggaauaaaagcaaacuucucaggaaaagaaaaagagaaaauauuugacuaccuauucaaaaccagaagaaaaguuaagaagaaagacaucauucaauucuacagaaacgaauauaauacagaaaucguaacccugucaggucuugaagaagaccaauuuaacgcgucauuuucuacauaccaggauuuauugaaaugcggacuuacuagagcggaacuagaccacccagacaaugcggagaaacucgaagacauaaucaaaauacugacaaucuuugaggauaggcaaagaauacggacucaacuuagcacauucaaaggccaauuuucggcugaaguauugaagaaacuugaaagaaaacauuacacaggauggggaagauuaagcaagaaacuaauuaauggaaucuacgauaaagaaucaggaaaaacaauacuagauuaucuaauuaaagaugacgggguaucuaaacauuacaacaggaauuucaugcaacuaauaaacgacagucagcuuucauuuaaaaaugcaauacaaaaagcucaaucgucagaacaugaagaaaccuuaagugaaacaguaaacgaauuagcaggaagucccgcaauuaagaaagguauauaucagagucuaaaaauagucgaugagcuaguagcgauuaugggauacgcaccaaaacgaauaguuguagaaauggcccgagaaaaccagacaacauccacaggaaaaaggagaagcauucaacgucuaaaaauaguugaaaaggcaauggcugaaauaggcucaaaccuauuaaaagaacaaccuacuacaaaugaacaacuacgugacacacgacuauuccuauacuauaugcaaaauggaaaagacauguauacaggugaugaacuaucacuccaccguuugagccacuacgauauagaccauaucaucccucagucauuuaugaaagacgacucacuugauaaucuaguacucgucggcucaacagaaaaccgcgguaaaagugaugacguaccaagcaaagaaguagucaaagacaugaaggcuuacugggaaaaacuuuacgccgccggacucauuagccaaaggaaauuccaacgccuaacaaaaggcgaacaaggcggucuaacauuagaagacaaagcacauuuuauacaaagacaauuaguagaaacacggcaaauaaccaaaaauguugccggaauauuagaccaaagauauaacgcaaaauccaaagaaaagaaaguacagaucaucacacuaaaggcuucacuuacaucacaauuccgaagcauauuuggauuauacaaaguaagggaaguaaacgauuaccaccacggacaagacgcguaccuaaauugcguaguugcuacaacguuacucaaaguguauccaaacuuagcaccugaguuuguauacggagaauacccaaaauuccaaacauuuaaagaaaauaaagcaacugcaaaagcuauaauauacacaaaccuauuaagauucuuuacagaagaugaaccacgauuuacaaaagacggugagauucucuggucuaacuccuaucucaaaacaauuaagaaagaauuaaauuaucaucaaaugaauauagugaagaaaguagaaguacaaaaaggagguuuuagcaaagaaaguauaaaaccaaaaggaccaagcaacaaacucauacccgucaaaaauggacuagacccacagaaauaugguggauucgacucaccaauaguagcauauacagucuuauucacacaugaaaaaggaaagaaacccuuaaucaaacaggaaauauuaggaauuacaaucauggagaaaacgcgauucgaacagaauccaauuuuauucuuagaagaaaaaggauucuugagaccacgcguccuuaugaaauuaccaaaauacacacuauaccaauuuccugaaggccguagaagauuauuagccucagcaaaagaagcacaaaaagguaaccaaaugguccuaccugaacaucuacuuacucuccucuaucaugcaaaacaaugcuuacuaccuaaccaaucagaaucacuagcauacgucgagcaacaucaaccagaauuucaagaaauacuagaacgaguggucgauuucgcagaagugcacacuuuagcuaaaucaaaaguacaacaaauaguaaaauuguuugaggcaaaucaaacagccgauguaaaagaaauagcagccagcuucauacaauuaaugcaguucaaugcuaugggugcaccaagcacuuucaaauuuuuccaaaaagacauagagagagcaagauacacauccauaaaagaaauauuugacgcuacaauaaucuaccaaagcaccacuggauuauaugaaacacgacgaaaagucguagauuga

SEQ ID NO: 5292 - RNA, 4014 nt, Artificial Sequence
  Cas9 variant
augaaaaaagacuauguaauaggacuagacauuggcacaaacaguguuggcugggcuguaaugacagaagauuaucaguuaguaaaaaaaaaaaugcccaucuauggaaacaccgaaaaaaaaaaaauuaaaaaaaauuucuggggaguuagauuguuugaggaagggcacacagcugaagauagaagacuuaaaagaaccgcuagaagacgaauuucuagacggagaaacagacuuagauacuuacaagcauucuuugaagaagcaaugacagacuuagacgaaaauuuuuucgcgcgucuacaagaaucauuucuuguuccagaagacaagaaauggcacagacacccaauauucgccaaacuagaggacgaagucgcuuaccacgaaacuuacccaacaaucuaucacuuaaggaaaaaacuagccgacucuucagagcaagcagaccuaagacucauuuaccuugcccuagcccacauuguuaaguaucgaggccacuuccuaauugaggggaaauuauccacggaaaacaucucaguaaaagagcaauuccagcaauucaugaucaucuauaaccagacauuuguaaauggagagagcagacuaguaagugcuccauugccagaaucaguuuuaauugaagaagaacuaaccgaaaaagcaucaagaacgaaaaagagugaaaaaguacuacaacaauuuccccaggaaaaagcuaauggauuauucgggcaauuucuaaaacuuaugguaggaaacaaagccgauuuuaaaaaaguauuuggacuagaagaagaagccaaaaucacauacgcuucugaaagcuaugaggaggauuuagaaggaauacuagcaaaaguaggcgaugaauauagcgauguauuccuugcagcaaaaaauguauaugaugcaguagaauuaagcacuauacuggccgauagugacaaaaaaucccacgcaaaacugucgaguaguaugauaguuagauucacugaacaucaagaggaccugaaaaaauuuaaacgcuucauacgcgaaaacugccccgaugaauaugacaaucuauuuaaaaaugaacagaaagaugguuacgccggauacauagcacaugcagguaaaguaucgcaauuaaaauucuaccaauacgucaaaaaaauuauucaagacauagcgggagcagaauacuuccuagaaaagauugcucaagagaauuuccugaggaaacaacgaacauucgacaacggaguaauaccacaccaaauacaucuagcagagcuacaagcaauuauccacaggcaagcagccuauuaccccuucuuaaaagaaaaccaagaaaaaauagagcaacucguuacauuuagaauaccauauuauguaggaccacuuagcaaaggagaugccagcacauucgcauggcucaaacgacaaucagaagaaccuauaagaccauggaaccuacaagaaacaguagacuuagaucaaucggccacagccuuuauugaacgaaugacuaauuucgacacauacuugccaucugaaaaaguacuaccaaaacauucauuacucuacgaaaaauucaugguauucaacgaacugacgaaaauaucuuacacagacgaucggggaaucaaagcuaauuucucugguaaagagaaagaaaaaauauucgacuacuuauucaaaacacgcagaaaagugaagaagaaagacauuauacaguucuaucgaaaugaauacaauacugagauuguaacucuaucaggauuagaagaagaucaauuuaaugcaagcuuuucaacauaccaagaccucuuaaaaugcggacuaacacgagccgaauuagaccacccggacaacgcugagaaauuagaagacaucaucaagauacucacaauauucgaggaccgacaaagaauuagaacacaauugagcacuuucaaaggacaauucucagccgaaguucucaagaaacucgaaagaaaacacuacacaggauggggaaggcugucaaaaaaacucauaaacggcauuuacgacaaagaguccggaaagaccauacucggauaucuaauaaaagaugauggagugaguaagcacuauaauaggaauuuuaugcaacucaucaacgauucacaacuuagcuucaaaaacgcaauacaaaaagcucaaucaagugaacaugaagaaaccuugucagaaacuguaaaugaacucgcgggaagcccagcgauaaaaaaagguauauaucaaagcuuaaaaauaguugaugaguuagucgcaauaaugggauacgcgcccaaacgaaucguuguagaaauggcaagggaaaaucaaacuaccagcacaggaaaaagacgaucaauacaaagacuaaaaauuguagaaaaggccauggccgaaaucgguagcaaucuccuuaaagaacaaccaacaacaaacgaacaacuuagagacacuagauuauuccuuuauuauaugcaaaacggaaaagacauguauacaggagaugaacucucacuacaucgauuaagccauuacgacauagaucacauaauaccccagaguuuuaugaaagacgauaguuuagauaaccuuguacuaguaggcucaacugaaaauagagguaaaucagaugauguuccaucuaaagaaguaguaaaggacaugaaagcauauugggaaaaacuauaugcugcggggcuaauaagccaaagaaaauuccaacgacuaacaaaaggcgaacaaggcgggcucacgcuugaagauaaggcacacuucauacaacgucaacuagucgaaacaagacaaauaacaaaaaacguagcaggaauccuagaccagcgguacaaugcaaacucaaaagaaaaaaaaguacaaauuauaacacuaaaagcaucacuuacaucacaauuuagaucaauauucggucucuacaaagugcgugaaguaaacgauuaucaccacggccaagaugcuuacuuaaauuguguuguugcuacuacacuacucaaaguguaucccaaccuagcaccagaauucguuuauggugaauacccaaaauuccaaacguuuaaagagaauaaagcaacggcaaaagcuauuauauacacaaaucuccuucgcuuuuuuacggaagacgaaccaagauuuacuaaggauggugaaauacuauggaguaauagcuacuuaaaaacaauaaaaaaagaacuaaauuaccaucagaugaacauagucaaaaaaguugaggugcaaaagggcggauucucaaaggagucuauuaaaccaaaggggccuucuaacaaauuaaucccagugaaaaauggcuuggacccucaaaaauacggagguuuugacucaccaauagucgcuuauacaguucuuuucacccaugaaaaagguaaaaaaccauuaauaaaacaagagauacuaggcauaaccauuauggaaaaaacgagguucgaacaaaauccaauacuauuccuagaagaaaaaggcuuccuaagaccacgaguacuuaugaaacuaccaaaauacacauuauacgaauucccagaaggucggagaaggcuacuagcaagcgcaaaagaggcucagaaagguaaccaaaugguuuugccagagcaccuacuaacacuauuauaccacgcgaaacaauguuuauuaccuaaccaaucagaaagucuugcauacguugaacaacaccaaccugaauuccaagaaauacuagaaagagucguagacuucgcagaaguccauacauuagcaaaaaguaaaguccaacaaauaguuaaacuauucgaagccaaucaaaccgccgauguuaaagaaaucgcugccaguuucauacaauuaaugcaguuuaacgcuaugggagcuccuaguacauucaaauuuuuucagaaagacauagaaagagccagauauacaucaaucaaagaaauauucgacgcaacuauuauauaucaaucuacaaccggauuguacgagacaagacgaaaaguaguagacuga

SEQ ID NO: 5293 - RNA, 4017 nt, Artificial Sequence
  Cas9 variant
augcaagacuacuaucucggacuagacauaggcacaaauagcguagggugggcaguaacggaugaaaacuacaaucuacucagaaaaaaggguaaagaccuauggggcguuaggcuauucaaagaagcgcaaccagcuacugaacgcagaggacauagaaguagcagaagacgcaccauuagaaaaucacuacguaaacaauuacugagagagcucuuugaagaagagaucaacgcaaucgauaaagacuucuuccuacgacuggacgaaucaaaauacugguuagaagacaaaaagauagaaggaaaauacagcuuguuuaacgaugagaauuucacagacaaagauuacuaugaaaaguuuccgacaauuuuccaccuacgaaaggcacuaauagaaucagacgacaaagaagacauuagacucuacuuccuugcaauaaaucaaaugaugaaaagacguggccauuuccugauugacggaaaacucucuaacguagaagauauaacaccauucaaagaauguauccaaaacuuaauaaacgaagaauuagauaccgaaauagagaccgaauucuacgacaaagcaaucaaaauagugucagacuacagcuuaaaaaaaacugaaaaaaaaaacuuaauaaaagacuuagucaaagaaacagauuccauagaagacucaaaaaaaauuaucaauauauucaaucuauuaaucagugguaaauccaaaguaaacggaaucuucgaugacgaagaaauacuugaaaagaucaaagaagauaauaaagaagacuucuauuuaacgagugagaaauaugaagaaaaucuagaauacuucagccaauuacucgauuaccgauucgaacuaauaucaaguuuaaagucaauauacgacuacauuauccuacaagaaguacucaaaggaaaaaaauacuugucauacgcgcaaguagagcguuacaaaaaccauaaagaagaucuaaggaaacucaagcaacucauaaagaaauacgauaaaaacggcaaaaucuacuaccaaaucuucagggacgaaaacuucaaaaagggcuauguagcuuaccuagguuauuacaaaaagaauaaaaaaaauguaccuguaaaaaaaugugacuaugacacguuuaguaaaaacauaaaaucaacacuggacaaaauaugugacaaggaagacccacucuauauagaacuaauagacaaaauagagaaaggaggauuccuucuaaaacaaauaguaucaacuaacucaguaauaccucaucaagugcaugagcuagaauuagacaaaauacuagaaaaccuugaaaaaaauuauccaaguuuuaaggaaaucucagauggcguaaguaaaauugauaagauaaaaaugauuuuuaacuuuagaauaccauacuauguuggcccccuuaacgacuaucacaaagacaaaguaaacagcaacacguggaucguuaaaaacgaaggauuugagaaugaaaacauacgaccuuggaacuuuucaaaaaucguagacgaacaugcaugcgaagaagaauucaucaaacgaaugauuaaugaauguucauacauaccaggcgaaaaaguccuaccaaaaagcucauuauuauauucagaauacaugguauuaaacgaacucaauaaccuacgcguuaauggagacaaacuaaaccccaagaucaaaaaggaaauaguugaaaacauauacaaaaaagaacgaaaaguaacgcucaaaaaaauaagaaauuuuuuaauaauaaacaauuacgucgacuccaagguagaauucucuggauuaagcgacggaaucaaagcaaauaugucaagcuacaucgauuuugcggaaauccuugacgauaacuuugacaacaauaugguagaagauuuaauagaacaaauaacaauucauguaggcaacguaaaacuacuaaccgaaaaaauaucaaauaaauacccaaaucuugaaaaaaaacaaaucaauaaaauuguaaacuuaaaguuuaaagauugggcaagguucucaagaaaguuauuaguaggaauagaaggaacagaaaaagaaaccggagagaucaauacaauaauuggauuucuacgugaaacuaacgaaaacuucauggaauuaaugagcaaucgauacacuuucagcgaagaaaucagugaaaucaaaaaaaaauacauaccuaauaaauuaucuaagcaaaucguggacgaucucuacguaucacccgcaguaaaaaaaaugauauggcaaguacuaaacauuaaugacgaacuaauaaaaguacuaggaaaacagccaaagaaaaucuucaucgaaauggcacgcgggaaagaagagaaaccagaaguaaaagacucaaggaaaaauaaacucauagaauuauacaaaaaccuaggaaaagaagguaaagaauggcuaaauagaauugaagauaaaaccgaagccgacuucagaaaucgugccuuauaccuauacuacacucaaaugggaagauguauguacacaggagaaauaauagacauugaacguuuauacgacaaagaauuauacgaccucgaccacaucauaccucgcaaaaugaaaaaggacgauuccauacacaaaaauuuaguacuaguaacaagaaacaguaaccaauacgaaaaaaaagacaauuacccaguaccggaaguaauaaaaucuagagaaaauguacgucaccucugguaugcacuaaaaaaaaagggccuaaucacagaggagaaauacaaucgacuuacucguaucaacccacucucagauaaagaacuaucagaguucauagaaagacaacuaguggaaacaaggcaaacaacaaaagucguaaaagaccucuuugaaaacuacuacacagacucgaaaauagucacagugaaagcagggcuagucucugaacugcgacgagauuuugaaguucuaaaaugcagagaaauaaaugaccucaaccacgcccaugacgcauuccuuaauaucauaguaggugacguauggagcaaaaaauuuaccuccaacccauauaauuuugucaagaaaaaccgagagaaauacacauuaaacaacaucuucacuaaaaaucaaaaagaucuacgagggaacgaaauuuggaacugcgcagaagguaaaaaaagaauaauuaaaacauuaaacaaaccaucuguccuauucagcguagaaaacuucgaacaaaccggucaacuauuugaccaaaauaucauaggcaaacaagacuauaaagaaaaaacaagcuauguuccaauaaaaggagacgaaagauuacaagacauaucgaaauauggaggauaccgaggaauaucaggcgcguacuuuuucaucguagaacauaccgaaaaaaauaaaagagucaaaacaaucgaaagccuaccaauauacaugaaaaguuauguagaagagaauggcuugcuagacuucuguacaaaugaaaugaaauuaguagacccuaaaauaauagugaaaaaacuaaacuacaaaucugaaauaauaguugacggauucaaauaucucauaucaggaaagacagaaaaccgauuaagcuuagaaacaaaugaauaucucuauuggaaucauacccaaacaacagacauaaaaaagauccuaaauauaaaugaaaaaauagagcuugaaaaauacaacggagauauagagagugaacgagaaaacauaauaaaauacauacaaauaauauuagagaaauuuaaacuuaagccauucauaaagcgacgaaaccuuccaaacauagagaucaauuucgcagauuacgaaaccgaaaaauuacuacaauuacucgucaaccucaucccacucacaacuaaauacgucaguccaguagaucucacaguaaucagcggauccaaauaugccggcaaaguccuaaucccgaaaaagauaaguaaucucaacgaagucauauucauaucuaaaagcauaacaggaaucuaugaaucacgccguagaauuauauga

SEQ ID NO: 5294 - RNA, 4017 nt, Artificial Sequence
  Cas9 variant
augaaacaagaauauuucuuaggacuugauaugggcacaggaagucuaggaugggccguaacagacagcacguaucaagucaugagaaaacauggaaaagcacuauggggaacgagacuauuugaaucagcaucaacagccgaagaacgcagaauguuuagaacagcaagacgaagacuggacaggcgaaauuggcgaauacaaguauuacaagagauauuuucagaagaaauaucaaaaguagauccgggauucuuuuuaagaaugaaagaaagcaaauacuacccugaggacaaaagagacgcagaaggaaauuguccagaauuacccuacgcgcuauuuguagacgacaauuacaccgauaagaauuaucacaaagacuaucccacgauauaucaccucagaaaaaugcuaauggagacaacugaaauuccagauauuagauuaguauacuuaguacuccaucacaugaugaaacaucgaggacacuuucuucucagcggagauauaucacaaauuaaagaguucaaauccacuuuugaacaguuaauacagaacauacaagaugaggaacuugaauggcacauaagucuagaugaugcugcuauacaguuuguagagcacguacuaaaggacagaaacuuaacaagaucaacaaagaaaucaagacuaauaaaacaacucaaugccaaaucagcaugugaaaaagcaauacuaaaccuacuaucaggcgguacagucaaauugagcgauauauuuaacaacaaagaacuggacgaaagugagagaccaaaaguaucauucgcagacucuggauaugacgacuauauuggaauaguagaagcugaacuugcagaacaguacuacaucauagccagugcgaaagcaguuuaugacuggucaguccucgucgaaauacugggaaacagcguaucaauuagcgaagcaaaaauaaaaguauaucagaaacaccaggcagacuuaaaaacuuugaaaaagauagucagacaauauaugaccaaagaagauuacaaaagaguauuuguagauacagaagaaaaauuaaacaauuauucagcauacaucgguaugacuaagaaaaauggaaagaaaguagaccuuaaaucaaaacaaugcacccaggcagauuuuuaugauuuccuaaagaaaaacguaauaaaagucaucgaccauaaagaaaucacacaagaaaucgaaagugaaauugaaaaagaaaacuuccuaccaaaacaaguuacaaaagacaaugguguaaucccauaccagguacacgauuaugaauuaaagaaaauauuagacaauuuagggacaaggaugccuuucaucaaagaaaaugcagagaaaauacaacaacuauuugaauuucggauuccuuauuacguagguccucuaaacagaguugacgacgguaaagauggaaaauucaccuggaguguaagaaaaucugaugcacguauauaucccuggaauuucacagaaguaauugauguagaagcauccgcagaaaaauuuauacgaagaaugacaaacaaaugcacauauuuaguaggcgaagacgugcuaccgaaagacucauuaguguauuccaaauuuaugguguuaaaugaauuaaauaauuugcgguuaaacggggagaaaauaagugucgaacuaaaacaaagaaucuaugaagaacuauuuugcaaauauagaaagguaacacgaaagaaauuagaacgcuaucuaguaauagaaggaauagcaaagaaaggagucgaaauuacaggaauagacggcgacuucaaagccucgcucacugcauaucacgauuucaaagaacgucugacggacguacaacuaucucaaagggcaaaagaagcuauaguauuaaacgucguacucuucggcgacgauaagaaauuacuaaaacagcgacuaucaaaaauguacccaaaccuaacaacaggacaacuaaaagggauuuguucacuuaguuaccaaggcuggggcagacuuagcaaaacguuccucgaagaaauaaccguacccgcgccgggaacuggugaaguuuggaacauaaugacugccuuauggcaaacaaacgacaacuuaaugcaauuauuaucaagaaacuacgguuucacaaacgaaguagaagaguucaauacacugaagaaagaaacagacuuaaguuacaaaacuguagaugaauuauacguuuccccugcuguaaaaagacaaaucuggcaaacccuaaaaguuguaaaagaaauucaaaaagucauggguaacgcaccaaaaagaguauucguggaaauggcccgcgaaaaacaagaaggaaaaaggagugacucaagaaagaaacaauuaguagaacuuuacagagccuguaaaaaugaagaaagagacuggauaacugaguuaaacgcacagucagaccaacaacugagaucggauaaauuauucuuauauuacauacaaaaaggacgauguauguacucaggggaaacgauacaauuagacgaauuaugggacaauacaaaauaugacaucgaccauauauacccgcaaucaaaaacuauggaugacucgcugaauaauagaguacuuguaaagaaaaauuauaacgcaauaaaaucugacacuuacccccuuucacucgacauccaaaagaaaaugaugucauucuggaaaaugcuucaacaacaaggguuuauaacaaaagaaaaauaugucaggcuaguccgaucagaugaacugagcgcagacgaauuagccggcuuuauagaaagacaaauaguagaaacacgucaaucuacaaaagccgucgcaacuauccuuaaagaagcacugccagacacagaaauaguauaugucaaagcugguaauguaucaaacuuucgacaaacguaugaacuucuaaaaguuagagaaaugaacgaccuucaucacgcaaaagacgcuuaucuaaacauaguugucggaaaugccuauuucguuaaauuuaccaaaaaugccgccugguucauaagaaauaacccaggcagaaguuacaacuuaaaacgaauguucgaguucgauaucgaaagaucuggggaaauagccuggaaagccggaaauaaaggcaguauaguaacaguaaagaaaguuaugcagaaaaauaauauacuuguuaccaggaaagcauaugaaguaaaaggaggacuuuucgaucaacaaauaaugaagaaaggaaaaggucaaguuccaauaaaaggaaacgaugaacgacuagcagauaucgaaaaauauggagguuauaacaaagcagcagguacauauuucauguuaguuaaaucauuagacaagaaaggcaaagaaauaagaacuauagaguucgucccucuuuaccuaaagaaccaaauugaaauaaaucaugaaucagcgauacaauaucuagcacaggaacgaggccuaaacagcccagaaauacuauuaaguaaaauaaaaauugauacacucuuuaaaguagacggguuuaaaaugugguuaagcggcagaacagguaaccaauuaauuuucaaaggagcaaaucaacucauacuaucacaucaagaggcagcaauauuaaaaggaguggugaaauauguaaaccgaaagaacgaaaauaaagaugcaaaauuaagcgaaagagacggaaugaccgaagaaaaauuacuacaauuauacgauaccuuucuugacaaacuaaguaacacaguauacagcauaaggcucucagcacaaauaaaaacacuaacagagaaacgagcuaaauucauaggacuuaguaaugaagaucaauguauaguacucaaugaaauucuacauauguuccaaugucaaucaggaucugcaaacuuaaaacucauuggcggcccuggauccgcaggaauauuaguaaugaacaauaauauuacagcuuguaaacaaauaucugugaucaaccaaucaccaacaggcaucuacgaaaaagaaauagaccuaauaaaacuauga

SEQ ID NO: 5295 - RNA, 4017 nt, Artificial Sequence
  Cas9 variant
augacuaaaccauacaguaucggauuggacauuggaaccaacaguguaggaugggcuguuguuacagaugguuacaaaguccccgcuaaaaaaaugaaaguauuaggaaacacugauaaaagccacaucaaaaaaaaccugcuuggagcccuauuauucgacagcggaaacaccgcaaaagaccgcagacucaaacgcacagcuagaagaagauauacaagacgccgaaacaggauccuuuauuuacaagaaaucuuugcugaagagauggcaaaagcagacgaaucguuuuuucaaagauuaaaugaaucuuuucuaaccaaugacgacaaagaauucgacucacacccuauuuucgguaacaaagcugaagaagaagcgcaccaccacaaguuucccacaauauuucaccuaagaaaacaccuagcagacucaacagaaaaaagugacuuaagauuaauauaccuagcauuggcacauaugauaaaguuuagagggcacuuuuuaauagaaggccaacuaaaagcugaaaauacaaaugugcaaacccuauuugacgauuucguagaagucuacgacaaaacaguagaagaaucacaccuuucagagauuucgguauccucaauacuuacagaaaaaauuaguaaaucaagaagacuagaaaaucuaauaaaauacuauccaacagaaaaaaaaaauacacuauuugguaaccuaauagcguuaagucuagguuuacaaccgaacuucaaaacuaacuuuaaacucucagaagaugcaaaauuacaauucucaaaagacacauacgaagaagacuuaggagaacucuuggguaaaauaggagauaauuacgcagaucuauucauaucugcaaaaaacuuauaugacgcuauauuacuauccggaauccuuaccauagacgauaauacaacaaaagcaccauuaagugcgaguaugauaaagagguacgaagagcaccaagaagauuuagcucaauugaaaaaauucauaagacaaaaccuaccagaucaauauuccgagguauuuucagacaaaaccaaagaugguuaugcuggauauauagacgggaaaaccaaucaagaagcauuuuauaaauauauuaagaacaugcuaucuaaaaccgaaggcgcggacuacuuccuugauaaaaucgacagagaagacuuucuaagaaaacaacgaacauucgacaauggaucuguuccgcaccaaauccaucuacaggaaaugcaugccauccucagacgucaaggagaauacuacccauuccugaaagaaaaccaagauaaaauagaaaaaauacuuacguucagaauccccuacuauguaggcccuuuagcccgcaagggcucgcgcuuugcuugggcagaguauaaagcagacaaaaagguuacaccauggaacuuugacgacauauuagauaaagaaaaaagcgcagaagaauucauuacuagaaugacguuaaaugauuuauaucucccagaagagaaaguauuaccaaagcauucguuaguauacgagaccuucaacguauacaaugaacucacuaaaguuaaauaugucaacgaacaagguaaagcaaucuucuuugacgcuaacaugaaacaagaaauauucgaucauguuuuuaaagaaaaccgaaaaguaacaaaggacaaacuacuaaauuauuuaaacaaagaauuugaagaauucagaauaguaaauuuaacaggauuagauaaagaaaacaaagcauucaauucaucccuagguacauaccacgaccuaagaaaaaucuuagauaaaucauuccuagacgauaagguaaaugagaaaauaauugaagauauaauacaaacucuuaccuuauuugaagauagagaaaugauuagacaaagauugcaaaaauacucagauauuuuuacuacccaacaacucaaaaaacuagagcgaagacacuacacaggguggggccgcuuaagugcuaaacucauaaacggcauaagagacaaacaaucaaauaagacaauacuaggauauuuaaucgacgacgguuauucaaaucgaaacuuuaugcaacucaucaaugaugauucauuaccauuuaaagaagaaauagcucgagcacaagucaucggagaaacugaugauuuaaaccaauuagugagcgauauagccggcucuccagccauaaaaaaaggcauacuacaauccuuaaaaauaguagaugaguuaguaaaagugaugggccauaaucccgcuaacauuguaaucgaaauggcacgcgaaaaccaaacgacagcuaaagguagacguucgucacaacaacgauauaaacgauuagaggaagcaauaaaaaaccuggaccaugaucuaaaucauaaaauacuaaaagaacacccgacggauaaccaggcucuacaaaacgaccgccuauucuuauacuaccuacaaaacggaagggacauguauacugaagauccgcuagacaucaaucgcuuaagcgacuaugacauagaucauauaaucccccaauccuuuaucaaagacgacagcauugacaauaaagucuuaguuucuucagcaaaaaacagagguaaauccgacaauguaccaucagaagaugucguaaaucgcaugagacccuucuggaacaaacuauuaucuugcggacucaucucacaaagaaaauauucaaacuuaacaaaaaaagaacuuaaaccagacgauaaagcaggauuuauaaaaagacagcuaguagagacacgacaaaucacaaaacacguagcgcaaauacuggacgcaagauucaacacaaaaagagaugaaaacaaaaagguuauaagagaugucaaaauaauuacucuuaagucaaacuuaguaagccaauuccgaaaagacuuuaaauuuuacaaaguaagagagauaaacgauuaucaucaugcacaugaugcauaucuaaaugccguaauaggaaaggcacucuuagacguauauccgcaacuagaaccugaguuugucuacggugaauauccucacuuccauggauacaaagagaauaaagcaacugcgaaaaaauucuuuuauucuaacaucaugaacuucuucaaaaaagacgacauaagaacagaugaaaauggugaaauaguuuggaaaaaagacgaacacauaucaaauauaaagagaguacuaaguuacccucagguaaacauagucaaaaaaguagaaauacagaccguaggacaaaauggcgggcuauucgacgacaacccuaaaagcccacuagagguuacuccuaguaaacucguuccccuaaaaaaagaauuaaauccaaaaaaauacgggggcuaucaaaagccuaccaccgcauacccaguauuauuaaucacagauacaaagcaauuaauaccaauaucagugaugaauaaaaaacaauuugaacaaaaccccguaaaauuccuuagagaucgaggguaccaacaaguaggaaaaaacgacuucauaaaauuaccaaaauacacacuaguugauauaggagacggcauaaagagacuaugggccagcucgaaagaaauacacaaaggaaaccaauuagucguaaguaaaaaaagccaaauccuacuauaccacgcacaccaccuugacucagaccucucaaaugacuaccugcaaaaccauaaucaacaguucgauguauuauucaaugaaaucauauccuuuucaaaaaaaugcaaauuaggaaaagagcacauacaaaaaaucgaaaacguguauagcaauaaaaaaaacucugcauccauagaggaauuagcagagucauucauuaaacuacucggcuucacucaacuaggcgcaaccucaccguuuaacuuuuuagguguaaaacuaaaccaaaagcaauauaaaggcaaaaaggauuauauacucccaugcacagaaggaaccuuaauuagacaauccauuacaggauuauacgaaacaagaguggaucuaagcaaaauaggagaagauuga

SEQ ID NO: 5296 - RNA, 4017 nt, Artificial Sequence
  Cas9 variant
augcgcgacuauuauauaggacuagaccuaggaaccggaucacuaggcugggccguaacagaucgagaauaugaaaucaugagagcacacggaaaagcauuauggggaguuagacucuucgauuccgccaauacggcugaagagcgcagaggcuucaggacagcacgacgaagauuagacaggagaaauuggaggauagaacuccuacaagaguuauuuggugaggauauaggcaaaguagauaguggguuuuuccugcgcaugaaagaaucaaaauacaugccagaagacaaaagagauguuaacgguaacugcccaaaauuaccuuacgcacuuuuuguagaagaugguuauacagacaaagauuaucaccgucaauuuccgacaauuuaccaucucagaaaaugguuaauggaaacagaagaaacgccugauauacgucuuguuuacuuggcauuacaccacaugaugaaacaucgaggccauuuuuuauuuaguggcaacauugaaaaaauaaaagaauuucaagaaaccuucaggcaauauauaggaaaaauaagagaggaagaacuugauuuccauuuauguauagaaggagaagaauuaagagagacagagaacauacuaaaagauaaaaaccuaacgcguucggcuaagaaaacuagguuaauaaaauuacuaggagcgcacacagcuugcgaaaaagcagcauuaaacuuagucgcgggagggacagugaagcuaagcgacauauuuggaaauucagaacuagaugcuugugaaaaaccaaaacuaucauuugcugaugccgguuaugaugacuacgcaggaaugauugaagaugaauuaggugagcaacauguaauuauagaaacagcgaaagccguauaugacuggucaguauuagcagauauauuaggagacuaccgcugcauuucagaagcgaaggcugcgguuuacgagaaacaucaaaaagaucuaagacauuuaaaagaauuaguaaaagaaaaccuaggaagagauguauauaaggaagucuucgucaagacuaacgaaaagcuuccgaauuacagugccuauauagguaugacaaaaaaaaacggaguaaaaagugaaauggaaggaaagaggugugacagaaaagcauucuaugauuaccuaaaaaaaacagugguaaacgccauacccgaugaaaguaaaacugaauaucuaagaaaggaaauggaaacagaaacauuucuaccaaggcagguaaccaaggauaacggaguaauaccgcaccaaguccaccuccaagaguuagacgcgauacuagaaaaccuaagcgguagaauaccggcacucaaagaaaauggcagcaaaauaagagacauauucacuuuuagaauaccauauuauguaggaccacuaaaugggauuguaaaagguggcgaaaggacaaacuggguuaggagaaaaaaagcgggacgcauauguccauggaacuuugaugaaaugguagacacgggagcgucagcagaagaguuuauaagaagaaugacaucaaaauguacauaccucauccacgaagaugucuuacccaaaaauucaaugcuguauucuaaauuuaugguauugaaugaauuaaacaaugugcggcuaaacggugaacccauuaguguagaauugaaacaaaaaacauaugaagaccucuuucagagacauagaaaaguaacacguagacgacuaaccgauuauauaagaagagaaggaauagccggacgagacgcugacaucacgggaaucgacggugauuuuaaaggaagcuuaacagcuuaucacgacuuuaaagaaaaacucaccggaugugaauuaucacaagcagauaaagaaaauauaauuuugaacaucacacuauuuggagaagauaaagcauuauuaaaaaagagacuaggcgcuuuauauccagcuuuaacagagccccaaaaaaaagcaauaugugcacuaucauacaagggauggggaaggcuaagucaaagguuauuagaagguauaacagcaccagcaccagaaacuggagaaauauggaccguuauuagagcgaugugggaaacaaaugauaauuugaugcaggugcucucagaaaaauauuguuuugccgcugcgauagaugaggaaaaugcaggagaggaacuaaaagaaauaacauauaaaaccguugaacaaaugaacguaaguccagcgguaagacggcaaauauggcaaucauuacaagugauuaaagaaauaugcaaaguaauggguggcccucccaaaaggguguucguggaaauggcacgagagaaaauggaaucgaaaagaaccgaaaguagaaagaaaagacucauugauuuauauaaaaagugccgugaagaagaaagggacuggaucgaagaauuaggaaauacagaggaaacaaggcuacgaucagauaaauuauaucuauacuacacucaaaaagguagaugcauguauucaggugaaguuauagagcuagaagagcuuugggauaaucgaaaguaugauauugaucauauauacccccaaagcaaaguaauggacgacagucuugauaauagggucuuaguuaaaaaggaauacaacgcagacaaaacagaugaauacccaauaagagcugacauuagaggcaaaaugagagcauuuuggcggauccuucgagaagaaggauuuauauccaaagaaaaauacaaucgauuaacaaggggaacaggguuugaaccauccgaauuggcgggauucauagcucgacagcuaguagaaacaagacaagguacaaaagccguagcaucaguacucaaacaaguauuucccgaaacggauauaguauacgcuaaggccaggguugcuucacaauucagacaagaguuugaucuaauuaaaguccgcgaaaugaaugaucuacaucacgcuaaagacgcuuacgucaacauagucguugguaacguauauuauacaaaauuuacuucgaaugcagccugguauguaaaagaacacccaggaagaaguuauaaucugaaaaaaauguuuacgagcgaaagagacguugcaagaaacggagaaacagcauggagggcagggaauucuggcacuauagcgaccguaaaaagaguaaugggaaaaaauaauauauuaguuacuagaaggaguuaugaaguaaaaggaggucuauuugaucagcaauuaaugaaaaaagggaaaggacagguacccaucaaaggacgagaugaaagauuagcagauauagauaaauacggaggauacaauaaagccgcagggacauacuucaugcuggcugaauccgaggauaaaaagggagcaaaaauaaggaguguugaauauguuccacuauacuuaugcaacugcauagaaaaagaugaagaagcagcaaaaaaauauuuacagaaagaaagaggacuaaagaacccaagagucuuaauagccaaaauaaaaauugauacgcuuuuuaaaguagacggauuuuauaugugguuaucaggaagaacuggaaaucaacuaauuuuuaaaggugcaaaucagcucauauuaucagaaccggauaugcgaauacuuaaaaaaguacucaaauacguaaauagaaaaaaagaaaauaaaaaugccguguuaggagaacacgaccaauuaccugaaacagaccugauacggcuauacgaugucuucuuagacaagaucgaaaauacaguuuaucauguccgucuaucagcucaacaaggcacauuaacaaaaaauaaagacacuuuuugugaacuaucaaacgaagauaaauguauaguacuaagcgaaauccuacauauguuucaaugucaaucggguagugcaaaucuuaaacuaauaaaaggaccggguagcgcagguauacugguacuaaauaauauaauaucgaaaugcaaucaaguaaguauaauacaucaaagcccaacaggaauauacgaacaagaaauugauuuaaaaaagaucuga

SEQ ID NO: 5297 - RNA, 4020 nt, Artificial Sequence
  Cas9 variant
augaacaaggcuuacaccuuaggauuggacauaggaaccaauagcguaggaugggccguagugacagaugacuaccgcuuaauggcaaaaaaaaugccaguacauucaaagauggaaaagaaaaaaauaaaaaaaaauuuuuggggugcgagauuauuugaugaaggccaaaccgcagaagaacguagaaacaaaagagcaacacgacgaagauuacgaagaagaaaguaccgcauucuagaacuccaaaagauauuuuccgaagaaauauuaaaaaaagacucacauuuuuucgcaagauuagacgaaucguuccuaaucccagaagauaaacaguaugcaagauuuccaauauuuccaacccucuuagaagaaaaagcauacuaucaaaauuauccaacuauauaccaccuuaggcaaaaacuagcggauucaacugaaaaagcggacauacgccuaguguaucuugcuuuagcucacaugaucaaauaccgaggacacuuucucuucgaaggggaacuagacaccgagaauaccuccguugaagagaccuuuaaagaauuuauagacaucuacaacgaacaauuugaagagggaauaauauuuuauaaagauauaccacuaauacuaacagauaaacuuagcaaaucaaaaaaaguagaaaaaauucuucaguauuaucccaaagaaaaaacgacuggaugccuagcacaauuucugaaacucauugucggcaaucaaggaaauuuuaaacaagcguuccacuuagacgaagaaguaaaaauccaaauauccaaggaaacauaugaagaagacuuagagaaacuauuaagaaaaucaaacgaagaaaugauagauguuuucuuacagguuaaaaaaguauaugaugcaauacuucuaagcgacauacuaagcacaaaaaugaaagauacgaaagcaaaacuauccgcaggaaugauugaaagauaccaaaaccauaaaaaagaucuugaagaauuaaaacaauuuguucgggcgcaccuacacgaaaaaguuacaguauucuucaaagacagcuccaaagacggauacgccggauacaucgauggaaagaccacgcaagcugacuuuuacaaauucuugaaaaaagaauuaacaggaguaccaggaagcgaacccauguuagcuaaaaucgaucaagaaaauuuccuauuaaaacaacggacucccacaaaugguguaauaccucaucaaguacauuuaaccgaauuuaaggcgauaauagaucaacaaaaacaauauuacccauuucuagaaaaaucuaaggaaaaaaugauccagcuccuuaccuuccgaauacccuacuauguugguccacuugcacaagacaaagaaacuaguucauuugcauggcuugaaagaaaaacuacagaaaagauaaaaccguggaaugcuaaggauguaaucgacuauggugcaagugcuacaaaauuuauacaaagaaugaucaauuacgauaccuacuuacccacagaaaaaguacuaccaaaauauucaaugcuuuaucaaaaauacacaaucuucaacgaacuaacaaagguugcauacaaagaugaucguggaauaaaacaucaauucaguucugaagaaaaacuacgaauauuucaagaauuauuuaaaaaacaacggcgaguuacaaaaaagaagcuccaacauuucuuaucagcgaauuauaacauugaagacgcugagauucuaggaguagacaaaguauucaacagcagcuacgcaacauaccaugacuuucuagaacuugccaaaccauacacggaaaaaauaauugaauuacuagaacaacccgaaauggaagaaauguuugaagauauaguaaaaaucauaacaaucuucgaagacagagaaaugguacgaacccaacuaaaaaaauaccaaagaauuuuaggagaagaaauuuuuaaaaaacuaguuaaaaagaaauacacaggauggggcagacuuucaaaaagauugauaaauggaauucgggaccaaaaaacaaauaaaacaauccuggacuaccucauuaacgaugacgauuuccccuauaaucggaacagaaacuuuaugcaacuuauaaaugacgaccacuuaucauuuaaagaagaaauagcaaaagaacugaccuugucagacaaacaaagccugcuagaaguagucgaagcuauaccaggaucacccgcuauuaaaaaagggaucuggcaaacacuuaagauaguagaggaacuaauagccaucaucgguuacaaaccaaaaaacauaguaauagaaauggcacgggaaaaccaaaccacaaccggaggcaaaaauagaagcaaacccagacuaaaaagucuugaggaggccuuaaaaaauuucgacucacagcuguuaaaagaaagacccgucgacaaccaaucacuacaaaaggaccgauuauaccuguauuaccuacaaaauggcaaggacauguauacuggcgaaucacuugacaucgaccgcuuaucggaauacgauauagaccacauaauacccagaagcuucauuguagaucauucacuagacaauaaaguacuaguauccucuaaagaaaaccgcuuaaaaaaagacgacguaccggauucaaaaguagucaaaagaaugaaagcguacugggaaaaacuacuacgagcaaacuuaaucagugaaagaaaauucuccuauuuaacaaaacuagaacuaacagaugacgauaaagcacgguucauacagagacaacucguagaaaccagacagauaaccaagcauguagcagcuauucuacaucaauauuucaaucagacucaagaacuagaaaaagaaaaggacaucagaauaauaacccuaaaauccagucuuguuagccaauuucgacaaguauuugguauacacaaaguuagagagauaaaccaucaucaucacgcgcaugaugcuuaucuaaaugccgucgucgcucuggcauuacuaaaaaaauauccaagacuagcaccagaauuuguauacggaucguuugccaaauuccacuuaguaaaagaaaacaaagcaacugccaaaaaagaauucuauucaaacauccuuaaauuuuuugaaaaagaagaacaauucugcgacgaaaacggagaaaucuucugggacaaaagaaaacacauacagcaaauuaaaaagguaaucuccagucaucaaguaaacaucguaaagaaaguagaaguacagacagggucauucuacaaggaaacaguuaacacaaaagaaaaacccgacaaacuaauaaaacgaaaaaauaacugggauguaacaaaauauggaggauucgggucaccggucgucgcauacgcaguaguauucacauacgaaaaagguaaaaaccauaaaaaagcuaaagcaauagaaggaauaacaauaauggagcaagcgcuauucgaaaaagaccccauaucauuccuaaucgaaaaaggauacucgaauguaaaccaauucauuaaacucccuaaauacacccuauucgaguuagcaaacggccaacgacgaaugcuugcaucacaccaagaacuacaaaaagccaacucguuuauucuaccagaaaaacugguaacucuacuauaucaugcaaaccacuaugaugagauugcauacaaagacucauacgacuauguaaacgaacacuucucaaacuuccaggacauccucgacaaagucauaauauuugcagagaaauauacaagcgcgccccaaaaacuuaaccagauaauugcaacuuaugaaaaaaaccaagaagccgaccgcaagauuauggcacauagcuucguaaaucuaaugcaauuuaaugcauugggcgcuccagcagacuucaaauucuuugacacuacaaucacucgcaaacgauacacaucgcuaacugaaauauggcaaaguacaauaauauaccaaucaguaacagggcuuuacgaaaccagacguagaauggccgacuuaugggauggcguacaguga

SEQ ID NO: 5298 - RNA, 4020 nt, Artificial Sequence
  Cas9 variant
auggaaagauaccacaucggauuagacauuggaacuucaaguauugggugggcagucauaggugacgauuucaagauuaaaaaaaaaaaggguaaaaauuuaauaggaaccagacucuucaaugaaggagcaaccgcagcagaaagacgaggauuuagaacacaaagaagaagauuaaaccgacgaaaauggagauuaaaauuauuagaagaaauauuugaucccuacauggcagaaguagaugaauacuucuucgcaagacucaaaucaucgaauuuaucaccaaaagacaguaacaagaaauaccuggggagccuacuauuccccgacaaauccgauagcaacuucuaugauaaauacccuaccauuuaccaucuuagaagagacuugauggaaaaagaugaaaaguucgaucuaagagaaauauauuuagcuauccaucacauaguaaaauacagaggaaacuuccucgaaaaaguaccagcaaaaaacuauaaaaacucaggagccucaaucggauuccuacucgaggaaguaaauagucuuuauaaagauauaauaggagacgaauccauagcaaucuuaaacucagaaaaauucgaagacguugaaaaaauaauauuagaugaagaaaccagaaaucuagacaaacaaaaaucaguaggaaaacuacuaguagaagacaaaaaaaaaaaaaauauaguuacagcauucucaaaagcaauuuucggcuacaaguuuaacauagaggaccuucugcuaaucgaaaaugacgaaaagaacaaacuaaccuuuaaugacgaaaacauagaugacaucuuuaaugaguugagucauucacuagacgacaaacaaauggaucuccuaacaaaaacccgagaaauauacuucaaauucaaacuaaauaugauagugccgacaggcuauacccuaagcgaaagcaugaucgaaaaauacgaaaugcauaaagcacauuuaaaaauguacaaagaauucaucaauacauuaaauacaaaagacagaaagauauuaaaaaaugcauacucagauuacauaaacacagaaaaagccaaagcagcaaacgcccaagaaaauuuuuacaagacagucaagaagauaaucaaagauaacaauagcgauacagcaaaaaaaauaauuguacuaauagaugagggaaacuucaugcccaaacaaagaacaggagaaaauggcguaaucccacaucaacuacaccaaauagaacuagauagaaucauagaaaaucaagcaaaauacuacccuuggcucgcagaagccaauccuguggaaaaaaacagaaaauucgcaaaauacaaacuagacgaauuaguaacauuuagaguccccuacuacguaggaccacuaauugacaaaaccgaaaguaauaaaaacgaaaaagaaacaaaauucgcguggauggugcgcaaagcaaaagguacaauuacaccguggaacuucgaaaaucuuguagacagaacagaaucagcaaacagauuuaucaaaagaaugacaucaaaagacacuuauauaauuggcgaagauguuuugcccgcaucaucauugcucuacgaaaaauucaaaguacuuaacgaacuaaauaacaucaaaguuaacgaaaaaaaacuagacauagaacagaaacaggauaucuaccuaaaccuguucacaacagcaaaaaacguaacuaaaaagucauuagcuaccuauuuaaauuguuccgcugacucaaucagcggucuaucugauggagaaaaauuuaacagcucccuaucaucuuacaucgaucuaaaagcuauacugggcaacaucgucgaugauuguaacaaaaacgaggaucuagaaaaaauuauagaauacucaacuguuuucgaagaugggaacaucuacaaagaaaaauuaucugaaauaucauggcuaacggaugaacaaaucgagaaacuuaguaauauacauuuuaaaggauggggccgccuuucaaagaaauuacucacucaaauaacaaaugaaaacggagaaagaaucauagaugcauuauggaacaccagcaauaacuucaugcaaaucauaaaugaugaaagcauacaagcaaagcuagcggagauaaacggcaaauaugccggaaaaucugaucucgaggacauacuuucugaagcauauacuucgccccaaaacaaaaaggcaauaagacaaguaaugaaaguugucgaagauauugaaaaagcaaugcaaugcgaaccgacaucaauaagcauugaauuuacaagaaaaaaacaaaaaaguagacuaacaaauaccagguacaagaaaauauccgacgucuacgaaaaaauagcugaugaagugauuagcgaguacgaacugagaaaacuacaaucggaacuugacagcaaugcaaacaauaugagagaccgauauuauuuauacuucaugcaguuaggccgugacauguacaccggcgaaaaaaucaacauugacgaacuccaccaacguuaugacauugaucauauucucccucaaucauucauaaaagaugauucaauuaacaauagaguacuaacaagaaaagacgucaacaauaaagaaaaaucagacaaaacagccgcugacuuauacgcaguagaaaugucagauuuuuggagaaaauuaagaaaacaaggacuaaucacagagcaaaaauacaaaaauuuauuaacuaagagcgacaguauagacaaauaugcgaaaaaaggguuuauaaaacgacaacuaguagaaacaucacaaguagugaagcuaguagccaacauacuucaagacaaauauucagacacuaaaauaauagaaguaagagcuaaacugaacucaaaucuucgagaggaguauaaauuaauaaaaaaccgggcgguaaacgacuaccaccacgcgauagacgguuaccugacaacauuuauaggacaauaccucuacaaaacauacccaaaacuaagaagcuauuucgucuauaaugacuucaaaaaauuagacagcaacuauuugaaacacaugaagaaauucaauuuccuauggcaacuccaggaugacaaaaccaucgacauauacgacaacguaaauaacaaauucguacugaauguacccgaaaugaaaaaauauauacagaaaaucuacaacuacaaauacauguuagucucaaaagaggucacuaccaaaaacggagcguuuuaugaucaaaccaaguacaacgcaaaaacugucaaucucauaccaaucaaaaaaaacaaaccaacaaauauauauggaggauauaaaggaaaagucucuagcuauaugaugcuaguaaaaauacgaaaaaaaaaggaaguaauauacaaauucguuggaguccccagacuguggacagaugaauuagauagacugaaggacacaacagaaagaaaaauacuauuaaacgagaucgcaaaaaauucacuaucuaaaacagaacaagauuucgaaguuauauuagacaaaguauauuaugggcagcuaauaauugacggaaaccaaaaauauacacucgggaguagugaauauaaauauaacgcaaugcaacuacauuuaagcaaacacgcacuagaaguauuggcaaaagaaaacguaaaagaugcagaaauaacagacaaagacuuagucucaguauacgaagaaauucucucaguaguaaacaaauacuucgagcuauaugacauaaauaaauuccgacaaaaguuaaacgagggauuggaaauauucagaaaacuccccgucuacaacguauaugaaucaaacaaaauuaaacaaguuggaaaauucgaaguacuuaaucgaauauuaaugggccuacacgcgaacgcaaugauaacggaccucaaaguccuaggaaucaagacaaaacuaggucaaaugcaaguaaacgguggcaucaaacuaagcccagaugcaaaacugaucuaucagucaccuacagguaucuucaguagagccguccgagucaaagaccuaggauga

SEQ ID NO: 5299 - RNA, 4020 nt, Artificial Sequence
  Cas9 variant
augagcuuaaauacgaacaagaaauacaauauuggucuagacauagguacaaccucagucggaugggccgucacggaugcagauggacaaaaacugcuuaaagcuaaaaacaaaaauuuauggggaguaucacuauucgaagcagguaaaacagcagcagaaagaagaggauauagaucaacuagaaggaggcuaaaccauagaaaauuuagacuacgccuacuugaagacauguuugaaaaagaaauauuaucuaaagacccuucauucuuuauaagacuuaaagaggcuuuucuaaguccuaaagaugaacaaaaacaauucaaaggcaacauacuauuuaaugacaaagauuacacugaugccgacuacuaugaacaauauaaaacaauuuaucaccuacgcuaugacuuaauaucacaacaccgacaauuugacauacgagaaguauacuuagccauacaccaucugauuaaauacagaggacacuucauuuacgaagaucaaacuuuuacaacagacggcaaccaacuacaacaucacauaaaagcaauaauaaccaugaucaauuccauccuuaacaggauaauaauacccgaaacaauagacaucaacguauuugagaaaacuuuacucgacagaacuaugaaucgcucauccaaagucaaauucuuaaucgaacuaacaggagaagauaaacaagacaaaccucuuuuaaaagaacuauuuaacuuaaucguuggucuaaaagccaaaccagcuucgauauucgaacaagaaaauuuagcgaccaucguugaaacaaugaauaugucaaccgaacaaguacaauuagauuuacuuaccuuagcugacgugcuagcugacgaagaauacgaucuucuucuaacagcccagaaaauauauucagccauaauacuugaugaauccauggauggauacgaauauuucgccgaagccaagaaagaaucauacagaaaacaucaagaagaguuaguauuagucaagaaaaugcuaaaaucgaaugcaaucacgaaugaugaaagagcaaaauuugaauauuuuuacacagauuacaucggagcuaaaaguucaaacuaugaagaaucaaaaauaaucaagaaaggccucagugccgcauacggaaaauacucaaaagaagaaagacuauucaaacacaucgaauuauuauuagccaaagaaaauguacuaaccacagucgaacaugacuuacuggagaaaaacauaaccuuugcuuccuuacuccccuuacagagguccucccgaaacgcuguuauaccguaucaaguucaugaaaaagaacuugucgcaauucuagaaaaucaagcaacguacuacccauuuuuacucgaacagaaagacaauauacacaaauuacuaacauuccgaauacccuacuacgucggaccacuugcagaccaaaaagacucagaauuugcguggauggugagaaaacaagccggaaaaauaacaccauuuaauuuugaagaaaugguagacauugaugccagcucggaagcauuuauaaaaagaaugacaaacaaaugcaccuauuugauacacgaagacguuaucccuaaacacucauuuucauaugcaaaauucgaagugcucaacgaacuaaacaaaauacgccuagacgguaaaccaauugacauaccacuaaagaaaagaauuuuugaaggccucuuccuugagaaaacgaaaguuacccacacaucacuaaagaaauggcuagcggaauaugaacauaugaccgugucaguuguacaggggacacaaaaagaaaccgaauuugcuacaucgcuccaagcauuucaccgauucguuaaaauauuugaccgggaaaccguauccaacccugccaacgaagaaauguuugagaaaauuauauacuggucgacuguauuugaagauaagaaaauaaugagaagaaaauuaucagaauacccccaacucacagaacaacaacagguucaacuagcccaaguucgauuccgaggaugggggagacuuagccaaagacuaauuaaccgaauuaaaacaccaguaaguggagacgaagaccacaaauuaagcaucaaugaaauauuauggcaaacaaacgaaaauuucaugcaaauaauuagaaacaaagacuauuuauuuaagaaaauuaucgaagaacaauuugaaaaugaaacugcguuacucaacaaacaaagaauagacgaacuagcaacgagucccgcaaacaagaaaggaauauggcaagcuaucaaaauuguuaaagaacucgaaaaagucuuacagcaaccagccgaaaacauauucauugaguucgcaagauccgaugaagaaucaaaacgcucaacacccagagacaaauucauagaaaaagcauacgcucaacucaagaaagaaacggacacuuucaacuuagaacaucuuaaagaacuaaaacaaagaagcaaacagcuaagcagccaacgacuuuuccucuacuucauacaaaauggaaaaugcauguacaguggcgaacaccucgacauagaaagauuagacucauacgaagucgaucauauacuuccucaguccuauaucaaagauaacuccauagaaaacuuagcucuagucaagaaaguagaaaaucaaaggaagaaagacagcuuacuccucaauucgucaauaauaaaucaaaauuacucaagaugggaacaacucaaaaacgcaggauuaauaggagaaaagaaauucagaaaucuaacaaggacaaaaauaacagacagagacaaagaaggauucauagcacgacagcuaguagaaacaaggcaaauaacaaaacauguaacacaauuacuucagcaagaguacaaagauacaacaaaaguauucgcaauaaaagcaacgcuagucucagaucuuagaaggaaauucgaguucaucaaaaaucguaaugucaaugauuaucaucaugcacaagacgccuucuuaguggcauuucucgguacaaauauaacaaguaacuacccgaaaauagaaauggaauaucuauuuaaaggguaccaacacuaccucaaugaaguagguaaauccgcugcuaaaccaaaauuuacuuuuauaguagaaaaccuauccaaacaacaauauaacaguacuacaggagaaguuaaauggaacccagaaguagacauagcaaaacuuaaaaggaucuuaaauuucaaacaaugcaauauaguccgaaaagucgaggaacaaagcggagcauuauuuaaagaaaccauuuauccagucgaagaaucuagcagcaagacaaucccucucaagaaacaucuagacacagcuaucuauggaggcuacaccgccguuaauuaugcaucauaugcacuaauccaguucaagaaaggacgcaaacuaaaacgagagauaauagguauaccucuagccguacaaacccgaauagauaauucagaaacaucacuacaaacauacaucgcagaacaaaucaaauccgagguagaaauauuaaauggucgcauucuaaaguaccaacuuaucucuaacaacggaaacagauuauacauagcaggcccucgagaaagacacaacgcaagacaacucauuguaucagaugaagcagcgaaaguaaucuggcucauaucaaccaaacaagcaguggaggccacuuuccuaaaacacuauacucuagaacauuuagaagcaguuuucgaagaauuaauccgcaaacaagcugcagauuaccaaauauucgaaaaccucaucaagaaaauugaggucaauaaagcauauuuuuauucauguaccuacaaugaaaaaguaaaagugauagaagaacuacuaaagaucacacaagccaacgcaaccaauggcgaccugaaauuacuuaaaaugacuaaccgagaaggacgacuagggagcguuucaguugcccucgauuucaaaaucaucaaucagucgguuacagguuuauaucaaucaauagaggacuacaacaacuga

SEQ ID NO: 5300 - RNA, 4020 nt, Artificial Sequence
  Cas9 variant
augucacuuaauaccaauaagaaguauaacauaggacuagauauaggaacaacgucuguaggaugggccgucacugacgcagacggccaaaaacuacuaaaagcaaaaaacaaaaacuuguggggaguaagucuuuucgaagcugguaaaaccgcagcugaaaggaggggcuaucggagcacacgaagacgauuaaaccaccguaaauuuagacuccgacuacuagaagacauguucgaaaaagaaaucuuaucgaaagacccuuccuucuucauuagauugaaggaagcauuuuuaucacccaaggaugaacaaaagcaguuuaaaggaaacauauuauuuaacgauaaagacuauacggaugcagacuauuacgaacaauacaagacaaucuaccaccugagauaugaccucaucucacaacacagacaauuugacauccgagagguauacuuagccauccaccaccuaauaaaauaucgaggucacuucaucuaugaggaccagacauucacaacggaugguaaccaauugcaacaccauauuaaagcaauuaucacuaugaucaacucgauacucaaucgaauuauaauaccugaaacuauagauaucaauguuuucgaaaaaaccuuguuagacagaacuaugaauagaagcaguaaaguaaaauuucucauugaauuaaccggcgaagauaaacaggacaagccuuuacuaaaggaauuauucaaucucauaguaggauuaaaagcuaagccagcuaguauauuugaacaagaaaaccuagcgaccauaguagaaacaaugaacaugaguaccgagcaaguacaauuagauuuauuaacacucgcagacguacucgcagacgaagaauaugacuuacuccuaaccgcacaaaaaauauacucggcaauaauccuggacgaaucaauggacgguuaugaauacuuugcagaagccaaaaaggaaucuuacagaaaacaccaagaagaauuaguacucguaaagaaaaugcuaaaaucuaaugcuaucaccaaugacgaaagggcuaaguucgaguacuucuauacagacuacauaggagcaaaaucuagcaauuacgaagaaaguaaaauaaucaaaaaaggucuaagugcugcauauggaaaauauucaaaagaagaacgacuuuucaaacacauugaauuauuacuggccaaagaaaacguacuaacaacaguagaacacgacuuauuggagaaaaacauuacuuuugcaucccuacuucccuuacaacgcucaucuagaaacgcuguaauuccauaccaaguacaugaaaaagaauuaguugcgauccucgaaaaccaagcaacauacuaucccuuccuccuagaacagaaggacaauauacacaagcuauuaacuuuucgaauucccuacuauguugguccauuagcagaccaaaaagauuccgaauuugcuuggaugguuagaaaacaagcaggaaaaauaaccccuuucaauuuugaagagaugguagauauagaugccucuuccgaagcauuuauaaaacgaaugaccaacaaauguacauacuuaauacacgaagauguaauccccaaacacagcuucucauaugcaaaauuugaagugcuaaaugaacucaacaaaauacgccuagauggaaaaccaaucgacauuccucugaaaaaaagaauauuugagggacuuuuuuuagagaaaacaaaaguaacucauaccagucuaaaaaaauggcuagcugagcacgaacauaugaccgucucuguaguacaaggaacacaaaaagaaacugaauucgcuacaagccuacaggcuuuucacagguucguaaaaaucuuugacagagaaacagucucaaacccagcaaacgaggaaauguucgaaaaaaucauauauuggucaacaguauucgaagauaaaaaaauuaugagaagaaaauuaucagaauauccacaacucaccgagcaacaacaaguacaauuagcacaaguaagguuuagaggauggggacgucuaagucaaagauuaauaaacagaauaaaaaccccgguuuccggugacgaagaucauaagcuaagcauaaaugaaauuuuauggcagaccaacgaaaacuuuaugcaaaucauaaggaauaaagacuaccuauuuaaaaagauuaucgaagaacaguuugaaaacgaaacugcucuacucaacaagcaaagaauagaugagcuagcaacaucaccagcgaauaaaaaagguaucuggcaagcaauaaaaauuguaaaagaacuagaaaaaguccuccaacagcccgccgaaaacauauuuauagaauucgcaagaucugaugaagaaagcaaacgauccacaccaagggauaaauuuaucgaaaaagccuaugcacaauuaaaaaaagaaacagauacauuuaaucuugagcaccuaaaagaauuaaaacaacgauccaaacaacuuuccucacaaagacucuuucucuauuucauacaaaacggaaaguguauguauucaggcgaacauuuagauauagaaagauuagauaguuacgaaguagaccacauacucccccaaucauacauuaaagacaauucaaucgaaaaucuagcauuagucaaaaagguggaaaaccaaagaaaaaaagacagucuacuacuaaacucgaguauaaucaaccaaaauuacuccagaugggaacaauuaaagaacgcaggacuaauaggagaaaaaaaauucagaaaucucacucguacaaaaauaacggaucgagacaaagaaggcuuuauagcacgacaauuagucgaaacucgacaaauaacaaaacacgucacacaacugcuacaacaagaauacaaagacacgacaaaaguauucgcaauaaaagcaacucuagucucugaccuucgaagaaaauucgaauucauaaaaaaucgcaaugucaacgacuaccaucaugcacaagaugccuuccucguugcuuuucucggcacaaauauaacaagcaacuauccuaaaauagagauggaauauuuauuuaaaggauaucaacauuaucuaaacgaagucgguaaaagcgcagccaaaccuaaauuuaccuuuauagucgaaaaucuauccaaacaacaauacaauaguaccaccggagaaguaaaauggaacccugaaguagacauagcuaaacuaaaacguauauuaaacuucaaacaguguaacauaguaagaaaaguagaagaacaauccggugcacuauuuaaagaaacgauauacucgguagaagaguccucaagcaagaccaucccacuaaagaaacaccucgacacugcuauauacggaggauauacagcaguaaauuaugcauccuaugcauugauacaauucaaaaaaggcagaaaauugaaaagagagauaaucggaaucccccucgcgguacaaacaaggauagacaauucagaaacaucuuuacaaacuuacauagccgaacaaaucaaaucugaaguugaaauucucaacggacgaaucuuaaaauaucaacuaauuagcaauaaugggaaucgauuauacauugcaggaccaagggaaagacacaaugcuagacaauuaaucguaagugacgaagcagcuaaaguaauauggcuuauaucaacaaaacaagcaguagaggcaacauuuuuaaagcauuacacacuagaacauuuagaagcgguguuugaagaacuaauaagaaagcaggcagcagauuaucagauauucgaaaacuuaaucaaaaaaaucgaaguaaauaaagcguauuuuuauaguuguacauauaaugaaaaggucaaaguaauagaagaauuacuaaaaauaacucaagcaaacgcaaccaacggagauuuaaagcuccuuaaaaugacuaacagagaaggccgccuaggcagugucucaguugcauuagauuuuaagauaauaaaucaaucuguuaccggacuauaccaaucaauagaagacuacaacaacuga

SEQ ID NO: 5301 - RNA, 4020 nt, Artificial Sequence
  Cas9 variant
augaaaaaagaauacacuauaggacuugauaucgguaccaauagcguuggcugguccgucuugacagaugacuacagauuaguaucgaaaaaaaugaaaguagcuggaaauacagaaaagucaaguacaaaaaaaaauuuuuggggcguacgacucuuugaugaagggcaaacagcagaggcacgaagaucaaaacgaaccgcgagaaggagacuagccagacgaagacaaagaauacucgaauuacaaaaaauauucgcaccagaaauccuaaagauagaugaacauuucuucgcaagacucaaugagagcuuuuuaguuuuagaugaaaaaaaacaaucucgccacccaguauucgcaacuauuaaacaagaaaaaucauaucaucaaacauaccccacuauauaucaccuacgccaggcacucgcugacaguucugaaaaagcagauauuagacuaguauacuuagcaauggcccaccuccucaaauaccgaggucauuuccuaauagaaggugaacuaaacacagaaaacucaagcguuacugaaaccuuuaggcaauuucuaucgacauacaaucaacaauuuuccgaggcagaugauaaacaaaccgaaaaacuggacgaagcuguggacuguaguuuugucuuuacagaaaaaaugucaaagacaaagaaagcagaaacccuacuaaaauacuucccucacgaaaaauccaacggauaucuuucacaauucauaaaacuaaugguaggaaaccaagguaauuucaaaaacguauuuggacuugaagaagcaaaguugcaauucagcaaagaaacauaugaagaagaucuagaagaacuacuagaaaaaauaggagacgauuauauugaccucuucguucaagcaaaaaacgucuacgacgccguguuacucagugagauacuuucagauucgacgaaaaacacaagagcaaaauuaagugcagggaugauaagaagauacgacgcacacaaggaagaucucguacuacugaaaagauucguaaaagaaaaccuaccaaaaaaguacagagcguuuuucggugacaacaguguuaacggcuacgcaggcuacauagaaggccacgcaacccaagaagacuuuuacaaguuuguaaaaaaagaacucacaggaauaagaggauccgaaguauuccuaacaaaaauugaacaagagaacuuuuuaagaaaacagcguacauuugacaaugguguaauaccacaucaaauacaccugacagaauuaagggcaauaauagcaaaucaaaaaaaacauuacccauuucuaaaagaagaacaagaaaaauuagaaaguuuguuaacauuuaaaauccccuauuacgucggaccgcuggccaaaaaacaagaaaauucuccauucgcauggcuaauacgaaaaucggaagaaaaaauaaaacccuggaaccuccccgaaauaguagauauggaaggaagcgcgguacgauucauagagagaaugauaaauacggacauguacaugccccauaacaaaguacucccuaagaacagucuauuauaucaaaaauuuaguauuuacaaugaauuaacaaagguacgauaccaagaugaacgaggccaaaugaacuacuuuuccucaauagagaaaaaggaaaucuuccacgaauuauucgaaaaaaauagaaaaguaacaaagaaagaccuacaggaguuucucuaccucaaauaugacauaaagcacgcagaauugagcgguauagaaaaagcuuucaacgcgagcuacacaaccuaucaugacuuucucacuauguccgaaaacaaaagagaaaugaaacaaugguuagaagaucccgaacuugcaucgauguuugaggaaaucauaaaaacgcugacugucuucgaagauagagaaaugauuaaaacuagauuaagccaucacgaagcaacacugggaaaacauaucaucaagaagcuaaccaaaaaacauuauacaggauggggacgucucaguaaagaauuaauacaagguauaagagauaaacaaagcaauaaaacaauucucgauuacuuaauaaacgaugacgacuucccacaucauagaaauagaaauuucaugcaacugauaaacgacgacaguuuaucauucaaaaaagaaauaaaaaaagcacaaaugauuacugacacagaaaacuuagaagaaauaguaaaggaauuaacuggcucacccgcaauuaagaaagguaucuuacaaagucuaaagaucguugaugaaaucguaggcaucaugggauaugagccagccaauaucguaguagaaauggccagagaaaaccagacaacaggaaggggacuuaaaucaucaagaccccgacuuaaggccuuagaagaaucuuugaaggauuuuggaucccaacugcuuaaagaauacccaacagacaauuccucauuacaaaaagauagacuuuacuuauauuauuuacaaaaugggcgcgacauguauaccggagccccacuagauauccaucgcuuaagcgauuaugacauagaccacauuauaccacgaucuuucacaacagacaauuccaucgauaacaaaguacuuguaucuagcaaagaaaacagacuaaagaaagacgacguuccaucagaaaagguaguaaaaaaaaugcgaucguucugguacgaccuauauucaagcaaacuaauauccaagagaaaauuagacaacuuaacaaaaaucaaauuaacugaagaagacaaagcaggcuucauaaaaagacagcuuguagaaacgagacaaauaacaaaacacguagcaggaauauuacaccaccgauuuaauaaagcugaagacacuaaugaaccaauaagaaaggucagaauaauaacacuaaaaucagcacucguaagccaauuccgcaauagauuuggaaucuacaaaguaagagagauaaaugaauaccaccacgcacacgacgccuacuuaaacgguguaguagcauuagcccuucuaaaaaaauacccccaacuagccccggaguucgucuacggagaauauuuaaaauucaacgcacauaaagcaaacaaagccacgguuaaaaaagaauucuauaguaauaucaugaaauuuuuugaauccgacacaccagugugugacgaaaauggcgagauauucugggacaaaaguaaaucaauagcgcaaguuaaaaaaguaauaaaccaccaccauaugaacaucguaaagaaaacagagauccaaaaaggcggguuuucaaaggaaacaguagagccaaaaaaagacucaucaaaacuguuaccaaggaaaaauaauugggacccugccaaauauggaggguugggguccccuaacguagcuuacacgguugcuuuuacauacgaaaaaggaaaagcaagaaaacggacuaaugcccuagaaggaaucacgaucauggagagagaagcuuuugaacaaagcccaguacuuuuccuuaaaaacaaaggauaugaacaagcggaaauugaaaugaaacucccuaaguacgcgcuauucgaacuggaaaacgguagaaaaaggaugguagcaucaaauaaagaggcucaaaaggccaacucauuucuacuaccagaacacuuaguaacacuacuauaccacgcuaaacaauacgacgagauuucucacaaagaaaguuuugauuauguaaaugaacaccacaaagaauuuagugaaguauuugcaagaguacuagaauuugccgggaaauacacccuagcagaaaaaaacauagaaaaauuggaaaaaauauauaaagaaaaucaaacagaugaccuagcaaaacuagcgucaagcuuuguuaaucuaaugcaauucaaugcaaugggagccccugcggacuuuaaauucuuugaugucacaauacccagaaaaagauauacaagucucacagaaauauggcaaucaaccauuauacaucagucaauaacaggucuuuacgaaacgcgaaucagaaugggaaaauga

SEQ ID NO: 5302 - RNA, 4023 nt, Artificial Sequence
  Cas9 variant
augaaaaaagaauauacuaucggauuagacauaggcacuaauuccgucgguuggagcgucuuaaccgaugauuauagacuagucaguaaaaaaaugaaaguagcuggaaauacagagaaaagcagcacuaaaaaaaacuuuugggggguuagacuauucgacgaaggacagacugcagaagcgcgacguucaaaacguacggccagaagaagauuagcaagaagaaggcagagaauuuuagaacugcaaaaaaucuucgcaccagaaauacuaaaaauagaugaacauuucuuugcaagacuuaacgaaagcuuccucguccuugaugaaaaaaaacaaaguagacauccaguauucgcaaccauaaagcaagagaaaaguuaccaucaaacauacccaaccauauaucaucuacgacaagcauuagcugacucaucagaaaaggcagacauaaggcuaguauaucuagccauggcucaccugcucaaauacaggggucacuuccuuauagaaggggaacuaaauacugaaaacucaaguguaacugaaacauuccgacaauuucuuucaacguauaaccaacaauucagcgaagcagacgacaaacaaacagagaaauuagaugaagcaguggacuguuccuucguauuuaccgaaaaaaugucuaaaacgaaaaaagccgaaaccuuacuuaaauacuucccgcaugaaaaaucuaauggguaucuaucacaguucauuaaacuaaugguagggaaucaagguaacuucaaaaacguauuuggucuagaagaggaagcaaaacuacaauucucaaaggaaaccuacgaagaagauuuagaggaauuauuagaaaaaauuggagacgauuacauagaucuauucguacaggcaaaaaauguauacgacgcaguucuacuuagcgaaauucuaagcgauaguacaaaaaauacaagagcaaaacugucagccggaaugauccgaagauaugaugcgcacaaagaagaccuaguauuacuaaagagauuugucaaagaaaaccucccaaaaaaauacagagcuuucuucggagauaauucaguaaacggcuacgcaggauacauagaaggacacgccacucaagaagauuucuacaaauucguaaaaaaagaacuaacaggaauaagaggaucagaaguuuuccucacaaaaauugaacaagaaaauuuuuuaagaaaacaaagaacuuucgauaauggggucauaccgcaucaaauccaucuaacugaacucagagcuauaaucgcaaaucaaaaaaaacauuauccauuucucaaagaagagcaagaaaaacuagaaucuuuauuaacauuuaaaauacccuacuacgucggucccuuagcuaaaaagcaagaaaauucaccauuugcaugguuaauaaggaagucagaagaaaaaauuaaacccuggaaccuuccagaaauaguagauauggaagggagugcagucagauucauagaaagaaugauuaauacugacauguacaugccacacaacaaaguccuuccaaaaaacagccuccuuuaccaaaaauucucaaucuacaaugaauuaacuaaaguaagauaccaagacgaacgaggacaaaugaauuacuuuucaagcaucgaaaaaaaagaaauauuccacgaacuguucgaaaaaaacaggaaaguaacaaaaaaagaccuacaggaauuucucuacuuaaaauacgauauaaaacaugcagaacuuucugguauugaaaaagcauucaaugcauccuauacgacauaccaugacuucuuaacuaugucagaaaacaaaagagagaugaaacagugguuagaagacccagagcuagcaucgauguuugaagagauaauaaaaacucuaacggucuucgaagauagagaaaugaucaaaacuagauuaagccaccaugaggccacacucggaaaacacauaauaaaaaaacuaacaaaaaaacacuauacaggguggggacgcuuaaguaaagaacuaauucaaggaauacgagacaaacagagcaacaaaacuauacucgacuaucuaauaaacgacgaugacuucccucaccauagaaaucgcaacuucaugcaacucauaaaugacgacucauuauccuuuaaaaaagaaauuaaaaaggcacaaaugauuacagacaccgaaaaucucgaagaaauuguuaaagaauugacuggaagccccgcaaucaagaaaggaauacugcaaucacuaaaaauaguagacgaaaucguaggaauaauggguuacgaaccagccaacauagucguugaaauggcuagagaaaaccaaacgaccgggagaggacuaaaaucuuccagaccucguuuaaaagcccucgaagaaaguuuaaaagacuuuggaucucaacuuuuaaaagaauauccgacggauaauucaucuuuacagaaggaccgccuauaucucuacuauuuacaaaacggaagagacauguauacuggagcuccacucgacauacacagauuaagcgauuaugacauugaucacauaauaccacguaguuuuacgacggacaauucaauagauaauaagguauuagugagcagcaaagaaaaccgacuaaaaaaagacgacguaccuuccgaaaagguagucaaaaagaugagaucguucugguacgaucuauauagcaguaaacuaaucagcaaaagaaaacuugacaaucucacuaaaauaaaacucacagaagaagauaaagcuggauucaucaaaagacaacucguggaaacaagacaaauuacaaaacauguugcuggaauacuacaccaccgauuuaauaaagcagaagacacaaaugaacccauaaggaagguucgaaucauaacacucaagagcgcauuaguuagccaauuuagaaacagauucggcaucuauaaggucagagaaauaaacgaauaccaccaugcccacgacgcguaccucaauggaguagucgcucuagcauuguuaaaaaaguauccccaauuagccccagaauucguguacggagaauaccucaaauuuaacgcccacaaagccaacaaagcaaccguuaaaaaagaauucuauucaaauauaaugaaauucuucgaauccgauaccccugugugcgacgaaaauggagaaauauucugggacaaaucuaaaaguauugcacaaguaaaaaaagucauaaaccaucaucacaugaauaucguaaaaaaaacagaaauacaaaaaggaggauucaguaaagaaacagucgaaccuaaaaaagacucguccaagcucuuaccaaggaaaaauaacugggaucccgccaaauaugguggucuaggaucgccuaauguggccuauaccguugcauuuacguaugaaaaaggaaaagcgagaaaacgcacaaaugcauuagaaggcauaacuauuauggaacgagaggcuuucgaacaaucaccaguguuauuccuaaaaaauaaagguuaugaacaagcagaaauagaaaugaaacuacccaaauaugcauuauuugaacuugaaaacgguaggaaaagaaugguagcaucaaacaaagaagcucaaaaggcuaauaguuuucuuuuaccagaacaucuagucacuuugcuauaccacgcuaagcaauacgaugaaauuucacacaaggaaaguuuugauuacgugaacgagcaucacaaagaauucagcgaaguauuugcaagaguacuagaauuugcuggaaaauacacacucgcugagaaaaacaucgaaaaauuagagaaaauauacaaagagaaccaaacagacgauuuagccaaacuagccaguaguuuugugaaucucaugcaauuuaacgcaaugggcgcuccagcagauuuuaaauucuucgauguuacuauaccgagaaaaagauacaccagccugaccgaaauauggcaaucaacaaucauccaccaaucaauaacaggacuguacgagaccagaauaaggauggguaaauga

SEQ ID NO: 5303 - RNA, 4023 nt, Artificial Sequence
  Cas9 variant
augaaaacagauuacuucaugggacuugauaugggcacagguagccuagguugggccguaacugacucuagcuaucauuuaugccgggcucacgggaaagaccuaugggguguuagacucuuugaaacugcucaaacagcagaagaaagacgaguuuuccgauguaauagaagaagauuagauagaagaaaaagaaggauccaauuacuacaagacauauuugcaccagaaauauauaaaaucgauccagguuucuuucuuagacucaaggaaucaagauaucuccccgaagacaagaaaaaucucgaaggaaaaacucccgaauuaccguacgcauuauuuguugacaaaaaguauacagauaaagauuuccauaaagaauacccaacaauauaccacuuaagacugagacugaugcaagauaggacaccagcugacgucagauuaguguacuuagcauuacaccaccuaauaaaacauagaggacauuucuuauuugcuggaaucgaagcagauaaaguaaccgacuucagugcagccuucucagaauuccuuagaauaguucaggaacaagagcuugacauaucuuuuacaccugaugaagagagcagccaaauaauaaaagaaacacuacaaaauacuaacuucacaagauccaagaaauccacagaauuaauaaaggggcucaaagcaagcacuggaugugaaaaagcuuuacuaaaacuaaucagcggaugcaaggucaaauuaagcgcaguauucgaugacccuggaugcgacgccuaugagaaaccacaagucugcuuugcagaaagcucauaugaagauuaugccgcuauacuagaagacgaacuugaggaccgguuuauuguaauagccgcagcaaaagcacuguaugauuggagugucuugguaaacauucuuggagaagcgagcacgguaagcgaagcaaaaguaggcaucuacgaaaaacacagacgagacuuaaaauauuuaaaacauuuaguuaaaacaaaucuaacaagagaagauuaccaagauuuauucguaaaggcaggcgccaaaaaaaacaacuacugugcauauauuggaaugacuaagaaaaauaacaaaaaagucguacuagaagaaaaacgauguacaaaagaagauuuuuacgcuuaccuuaaaaaagaaauauacaguaaaguacaagaaaauccagaagcagaauaucuacuagaagaauuagaaaaaggaacauuucuuccaagacagguuaguaaagacaacggaguaaucccguaccaacuacaauuccuagaacuacaaaaaauacuaaaaaaugcaguugaguauuuaccguuccuaaaagaagaauccgaaaaaauccagcaaauaaugacauuccguauaccauauuaugucggcccauuaaaugguaaaaaagaaggucaaaauaccuucgcaugggcaguuagaaaaaauaacgagccaguuuaccccuggaauuuugaagaaguuauagauacagaagcgagcgcagaacaauuuauuagaagaaugacaaauaaauguacuuauuuaccaggagaagacguuuuaccaaaagaaagucuauuauauucgaaauuuaugguacuaaacgaauuaaauaaccuaagaauaaauggaacuaagaucaguguagaacucaaacaagagcuguacgaaaaacuauuccagagauauagaaagguauccgcaaaaaaauugcgugacuaccucguuagaaaugggauaacagaaaaagaugcagaaauuaguggcauagacggcgacuuuaaaggaacauuaagagcauaucacgacuucaaagaaaaacuaacuggcguagaacuaacggaggccgaaaaagaaaccaucaucuugaauaucaccuuauucggggaagauaaaguacuauuaaaaaaaagaaugcaacgacuuuuaccuaaccucacagaggggcaaaaaaaggcaauaguaacauuaaacuauucaggauggggcagauuaagcagggaauuccucgaagaaguacaagcaccaaacccugaauccggagaaauacucucaauaauuagagcgcuaugggaaacaaaugcaaauuuaaugcaacugcuaucuaaucaauacggauaccaagaaauauuagaacaaaugcgugccgauuggacaggacauaaacuugauuaucaaacgguagaagaacuguauguaucacccgcagugaagagacaaauauggcaaacccuacaaguaguuaaagaauuaaaaaaaguaaugggaggagaaccaaaaagaguuuucuuagaaguagccagagaaaaaauggagucuggucgaaccguuagccgaaagaaacaucuuaaagaucuuuaucuaucaugcaaaucggaagaacguaacuggcuagcagaacuugacagacaugaagagcacagcuacagaucggaccgccuuuuccuauauuauacccaaaaaggcagaugcauguauugcgggaagccaaucgaucuaggacauuuaugggacguaaauauguaugauauagaccacauuuauccacaaagcaaagucauggacgauaguauaagaaaccguguauuaacuugcagaacauguaaugcagagaagacugaccauuacccuuuaaaagcugagauaagacaaaaaaugagaccauucugggauaguuuaaaagccggcaacuucauagaagaagaaaaauggaaacgauuaauuagaagugaagaauucaccagcacugaacuugcugguuuuaucgaaagacaacuagucgaaacaagacaaucuacuaaagcaguugccgauaucuugaagcaagcaaugccagaaacagaaauaguauacguaaaagcaaaaaacgucagugcuuuucgacaagacuuuaacuuuguaaaaaaccgcgauguuaacgauuuccaccaugcgaaagacgcguacuuaaacauugucguuggaaauacauacuucguaaaauuuacaaaaaaugcaucuugguuuauagaaagaaauccagggaggagcuauaacuuaaaaaggauguucaccagugauuacgauguaaugucaaacggagaaauagcauggaaagcaggaaacucaggaacaaucacuacaguacgcaaaaugaugaaaaaaaauagcguacuauucacaagacguuccuucgagguuuccggaggucuauuugaccaacagcuuaugaaaaaaggcaaaggacaaguauacguaaaaagcggcgaugaaagacuuagaucaauagaaaaauaugguggguacaauaaagcuacaggugcauauuucaugcuaguagaaagcgaaggaaaaaaaggaguuaaaaaaagaacuaucgaauuuguaccacucuacagaaaagcagaauuagaagcaucugaagaaaaaaugcuagaauaucuuagaaccgagauuggcuuaaaagaaccacacguacuacugcacaaaauaaagacugauaccuuguuucaagcugaugguuucaaaaugcacuuaucugguagaacaggaaaacaauuaguauuuaaaggugcaaaccaauuuuugguagcugaagauuaugagcgguuauugaaaaaggugggaaaggucacagaacaacuuaaaacaaauaaaaacuacaaaauuaaugauuacgacgguauaacugaagaaggauuaaaagcgcucuacucagaauuucuaucaaaacugcaaaaagcaccauacgguaacagauuaggaacccaagcagaaacacuagagaacggaaaggaaaaguucgauaaacuauccuuagaaaauaagugccaaguauugucagagauuuuacaccucuuucaguguaacagcucagcagccgaucuaucaaaacucgguggaccaggacacggaggaauucuuguacucaguaacgaaauuacaaaaugcaauaaaaucaguauaauacaccaaagcccagccggaauauacgaacaagaaauagaucugaaaacacuauga

SEQ ID NO: 5304 - RNA, 4023 nt, Artificial Sequence
  Cas9 variant
auggagcaagaauauuacuugggauuggacaugggcacaggaaguguaggaugggcuguaacagauucugaauaucauguauuacgaaagcacgguaaagcauuauggggagucagauuauuugaaagugcaucgacagcagaagaaagaagaauguuuaggacaucaagaagaaggcuagaucgaagaaauuggcgaauugaaauauuacaagaaauauuugcagaagaaauaucaaagaaagacccaggguuuuucuuaaggaugaaagaauccaaauacuauccagaagauaaacgagauauaaauggaaauugcccagaguugccauacgcucuuuucgucgaugaugacuuuaccgauaaagacuaucacaagaaauuuccaacuaucuaccaccuaagaaaaaugcuuaugaauacggaagagacgccagacauaagguuaguauaucuagcgauacaucacaugaugaaacacagaggacacuuucucuuaucgggcgauauaaacgagauaaaagaguucggaaccacauucucaaaacuacuagaaaacauuaaaaacgaagaauuagauuggaaccuagaacuuggaaaagaagaauaugcaguaguggaaaguauauuaaaagacaauauguuaaacagaucgacgaagaaaacgagacuaauaaaagcauugaaagcaaaaagcaucugugaaaaagcgguccugaauuugcuggcaggaggcacaguaaaauuaagugauauauuuggucuagaagaacuaaaugaaaccgaaagaccaaagauaaguuucgcagacaacggcuacgaugauuauauaggagagguagaaaaugaauugggugaacaguuuuauaucauugaaacagcaaaggcgguauaugauugggcaguauuaguggaaauauuaggaaaauacacaagcauaagcgaagcaaaaguagccacauacgaaaaacauaaaucagaucuccaauuuuugaaaaagauaguaagaaaauauuuaacaaaggaagaguauaaggauauauuuguaaguacaucagauaaacucaaaaacuacagugcauauauagguaugacaaaaauuaacggaaagaaaguagacuuacaauccaaaagauguucaaaagaagaguucuacgauuucauaaagaagaauguucuaaagaaauuagaaggccaaccagaauacgaauauuuaaaagaagaauuagaaagagagacauucuuaccaaaacaaguaaauagagacaauggaguaauacccuaucaaauucaucuauaugaacuuaagaagauuuuagggaaucucagggauaagauagaucuaauaaaagaaaaugaagacaaacuugugcaauuauucgaauuuaggaucccuuacuacguaggaccauuaaacaagauugaugacgguaaagaaggcaaauuuacaugggcgguaagaaaaucaaacgagaagaucuauccauggaacuucgaaaacguuguugacauagaggcaagugcagaaaaguuuaucaggaggaugacaaauaagugcacuuaucugaugggugaagauguauuacccaaagauagccuacuuuacagcaaauauaugguauuaaaugagcucaacaaugugaaauuggauggagaaaaacugucaguagaauuaaaacaaaggcucuacaccgauguauuuugcaaauaucguaaaguaacaguaaagaaaauuaaaaauuauuuaaaaugugaagguauaauaucaggaaaugucgaaauaacaggaauugauggagacuuuaaggcuagccuuacggcuuaucacgacuuuaaagaaauauugaccgguacugaauuagcgaaaaaggauaaagaaaacauaauaacaaauaucguacuauuuggcgaugacaagaaauugcuaaagaaaagacuaaauagauuauauccacaaauaacacccaaucagcugaagaaaauaugugcccuaucauauacaggguggggaagauuuuccaagaaauuccuugaagaaauaacugccccagauccagaaacaggggaaguuuggaauauaauaacugcacuaugggagucaaauaacaaucuaaugcaauuacuaucaaacgaguauagauucauggaagagguagaaacguacaauaugggaaaacagacaaaaacucuuucguaugaaaccguagaaaacauguacguaucaccuagugugaaaagacaaaucuggcaaacauuaaaaauaguaaaagaguuagaaaaaguaaugaaagagaguccaaaacgugucuuuauagaaauggcuagagaaaaacaagaaucaaaacgaaccgaaucacgaaagaaacaauuaauagaccuuuacaaagcaugcaaaaaugaagagaaagacuggguaaaagaacucggagaccaagaagaacaaaaguuaaggagugauaaauuauaccuauauuauacacaaaaaggacgauguauguacagcggggaaguaauugaauuaaaagauuuaugggauaacacgaaauaugauaucgaucauauauauccgcaaucuaagacaauggacgacagucuaaacaacaggguacuuguaaagaagaaauacaaugcaaccaaaucagauaaauacccauuaaacgaaaauauaagacaugaacgaaaaggauuuuggaaaagccuacucgauggaggcuuuauaaguaaagaaaaauaugaacgucuuauacgaaacacagagcugagucccgaagaacuagcaggauucauagaaaggcaaauuguagagacgagacagucaacaaaggccguagcggagauauuaaaacaaguuuucccagagagugaaaucguauacguuaaagcagggacaguaucaagauuucgaaaagacuuugaauuauuaaaagucagggaaguaaacgaucuacaccaugcaaaagacgcguauuuaaauauaguaguaggaaacucauauuauguaaaauuuaccaaaaaugcgucgugguucauaaaggagaauccaggaagaacauacaauuuaaagaaaauguuuacaagcggguggaauauagaaagaaacggagaaguagcaugggaaguggguaagaaaggaacaaucgucacaguaaaacagauaaugaauaaaaauaacauuuuaguuacaagacaaguacacgaggcuaaaggaggacuauuugaucaacaaaucaugaagaaaggaaaaggacaaauagcaaucaaagaaacagacgaaagauuagcauccaucgagaaguauggaggguauaauaaagccgcgggggcguauuucaugcuaguagaaagcaaggauaagaaaggaaaaacaauaagaacgauagaguucauaccccuauaucugaaaaauaaaauagaaagugacgaaagcauugcuuugaacuuccuagaaaaaggaagaggauuaaaagagccaaaaauucuuuuaaagaaaauaaaaauagauacacuauuugauguagauggauuuaaaauguggcuaagcggucgaacgggcgaucguuuauuauucaaaugugccaaucaacuuauacuagaugagaaaauaauaguaacaaugaagaaaauuguaaaauuuauacaaagaaggcaagaaaacagagaacuaaaacuuagcgauaaagacggcauagauaaugaagugcugauggaaauauacaacaccuucguggacaaacucgaaaauaccguauauagaauaagacuaucagaacaagcuaaaacacuaaucgauaaacaaaaagaauuugaaagguugucacuagaagauaaaagcaguacuuuauucgaaauucugcauauauuucaaugccaaucauccgccgccaaccuaaaaaugauaggaggaccaggcaaagcagggauauuagucaugaauaacaacaucucgaaauguaacaaaauaucaauuauuaaccaaucaccgacagguauauuugaaaacgaaauagaccuauuaaaaauauga

SEQ ID NO: 5305 - RNA, 4023 nt, Artificial Sequence
  Cas9 variant
augggagaagaguauuucuuaggccucgacaugggaacuggaucauuagguugggcgguaacagacgauaaauaccaaauucuaagaagacauggaaacgcucuaugggguguacggcuuuuugaaacggcaaauacagccgaagaacgaagaauguuuaggacaaaccgaagacgacuagaucgacagggguggcgaaucaagauacuacaagaauuauuugcugaagaaauuuguaggguggacccagguuucuacuuacgcaugaaagaaaguaaauacuacccugaagacaaacgagaugcaaauggcgaaugcccggcacuaccauacgcuuuauucgcagacgcacaguacacagauaaagauuaucauagagaauuucccacaauauaccaucuccgaaaaaugcugauggaaacagaaacaacacccgauauuagacuaguauaucucgccuuccaccacaugaugaaacacagaggccauuucuuauuaucuggagauaucucgcaagucaccgaauuccguaacacguuuuuacaaaugauagcgaacauuaaaagcgaagaauuagacuuuucuuuagaaauagaggagacccaaaugggccaaauugaagcuguguuaaaagaucauaaacuaaccagaucggaaaaaaaaaggcgacugacacaaauauuaaaaccugccaccgcgugcgaaaaagcaaucuuuaccuuacuaucagggggaacaguaaaacuaagcgacauauuuggaaaggcugaauuagaugaaggagaaagacccaaaauaagcuucgcagauaacggauacgaugacuauagcgccucaguggaagcagaucuaggcgaacaauauuauauaauugaaucagcgaaagcaguuuacgacuggucuguauuaucagauauauugggcgauagcguaucaauaucggaugcuaagguaaaacuauaugaaaaacacaaaaaagauuuagcuuaucuaaaaaagguaguaagagaaaaucugccaagagaaguauacaaucaagucuucguaaacacugaugaaaaauuauguaacuauugugcguauauugguauggcaaaaaaaaauggaaggaaaguagcacuagaaggaaaaagaugcacaagagaagaguucgagaguuuuuuaagaaaaaaaauaguaaauaaaaucgaagacaaagaaauccaagaguacuuauccgaagaaaucgaaaagggaacauuccuuccaagacaagucacuaaagacaauggaguaauaccguaccaaauucauuuauaugaauugagaaaaauaaucgacaaccucaguccaagaaugccuuuuauaagagauaacggagacaaaauaauacaacuguuuaccuuuagaauaccauauuauguggguccucuaggaaaaggagaaggaagcgaaaaauuuuccugggcgguaagacgaaccgacgaagcgauauacccguggaacuuuaaagauguaauagauguagaagccucggcagaaaaauuuauauguagaaugacaaauaaaugcacauaccuauauggagaagacguccucccaaaagacaguccacuauauagcaaauuuaugguccuaaaugaauuaaauaauuuaaaauuagauggacaaagcgucucuguggaguugaagcaacggauauaucaagaacuauuuugccauacuagaaaagugacacaaaaaaagcuaguaucuuaucuaguuagagaaggaaucacuggaaaaaauguagaaauuucagggauagacggagacuuuaaagcaagccuuacagcguaccacgauuuuaaagaaaaacuuacaggaguagaauuaagccagcaagaacaagaagaaauaguucgaaauaucguacuuuuuggugaagacaaaaaacuuuuaaaacagagauuggagggacgguucccacaauuaacccaaaaacaaauaucggucauagcuacauuaucauacaaaggcuggggaagguuaagcagagaauuccuagaaaauauaacuguuccugcccccgggacuggcgaaguauggaauauaauuacagcauuaugggagacaaacgauaaucuaaugcaauuauuauacggcgaauauggcuuucaaacagaaaucgaaugcuuuaaugcaaaagaaaaaaaaaaaucacucucguacgaaacaauagaagaaucguauguuuccccuucaguaaaaagacaaauauggcaaacccuacaaguaguaaaagaacucaaaaaggucaugcgaggagacccgaaaagagucuucauagaaauggcuagagaaaaccaggaaucuaaacgaacagaaaguagaaaaaaaacccuucuagaccucuauaaaaauuguaaaaaagaagagccugaauggauugcagaacuuacagaacaucuagagaaauuggacgauucacaacuuagaaaggauaaauuauuuuuauacuauacgcagaaggggagauguauguauucaggggaaagaauagagcuagaagaccuaugggacaacacuagauacgauauagaccauaucuauccgcaauccaagacgauggacgacucuguagacaauagagugcuagucaaaaaagaauauaaugcuaaaaaaacugacguauacccaauagcagccgacauaagaggaaaaaugagucccuuuuggaaaaaacuacuugacaauaaacucauaucaaaaaaaaaauacgauagacuaguaagaacagaagaacuuacaccagaagaguuagccggauucauagacaggcaguuaguggagacccggcagagcacuaaagucguagccgaaauccuaaaagaagcauucccagacacagaaauagucuacgucaaagcaggaaacguaagcaauuucagacauauguuugauauaguuaaaguuagagaguugaaugacuuacaucacgcaaaagaugccuaucuuaauauaguaguaggaaacgcauauuacgucaaauucaacaaaaaugcagccugguuuauaaaagaaaacccaggucgcucauauaauuuaaagagaauguucgauuaugauauaaggagaaauaacgagguagcaugguuagcggguucaacagguacaauaagccaagugaaaaacaugguaucuaaaaaucacauauuagugacaagaaagagcuacgaagugaccggaggacuuuucgaucaacaacugaugaaaaaagguaaaggccaaguacccguaaaaacgucagacgaaaggcuuggaaacauugaaaaauauggaggauacaauaaagcuucaggugcuuauuuuauguuaguuaaaaguaaaaauaaaaagggcgaagaacaaagaacaaucgaguauguacccauauacuuaaagcauuauauagaagagucaaaagaaaaugcguuagacuauuuaaaaaacgaaaggaaauuaaaugaaccugaaauacuacuugauaaaauaaagaaagacacacuauuuagaguuaacggauucuacauguguuuauccaaacgaacaggcaaacaauuagcauuuaaaggagccaacgaacuacuauuaccagaaccagaaaccuuauuauuaaaaaaaauuacuaaauauauacagcgaagaaaagagaauaaagaucuaaaacucacaaaacaagacaauauuacugaaaaagaacuccuagaacuuuacgauguauuuaccgagaaguuaaaucacucuguauacgcuguaugucucggaacacaagguaaaacuuuaguccaaaaaaaaccagcauuuguagcacucccagucgaagaaaaauguauuguacugucugaaauacuacacuuauuccagugccaaucgggaagugcaaaucuaaaacuaauaggaggaccagcaucugcaggaauacuauaucuuaacucuaacauuucugacgcgggagaaauuuuaauaaucaaucaaucaccaucaggaauauucgaaaaaagaauagauuugcuacgacucuga

SEQ ID NO: 5306 - RNA, 4023 nt, Artificial Sequence
  Cas9 variant
augaaaaaagaauacacaaucggccuagacaucggaaccaauagcguagguuggucagucuuaacagacgauuaucgcuuaguaagcaaaaaaaugaaaguagcaggaaauacugaaaaaucuucuacaaaaaaaaauuuuuggggaguaagacuuuuugacgaaggccaaacagcugaagcuagaaggucaaaaagaaccgcuagaagacgccuagcccgacgaagacagagaauacuugaacuacaaaaaauauucgcucccgaaaucuugaaaauagacgaacacuuuuuugcaagacuaaacgaaagcuuucuuguucccgacgaaaaaaaacaauccagacacccuguauuugcuacaauaaaacaagaaaaaucuuaccaucaaaccuaccccacaauauaucaucuaagacaagcauuagcagauagcuccgaaaaagcagauauccgauuaguauauuuagccauggcacacuuacuaaaauaucgcggacacuuuuuaauagaaggugaacuaaacacagaaaacucuuccguuacagaaacauucagacaauuuuuaagcacauacaaccaacaauuuuccgaagccggugauaaacaaacugagaaacucgacgaagcggucgauugcucauuuguauucacagaaaaaaugagcaaaacaaaaaaagcagagacauuauuaaaauauuucccccacgaaaaauccaauggauaucugucucaguucauaaaacugaugguagggaaucaagguaacuucaaaaacguauucggucuagaagaagaagccaaacuacaguucagcaaggagaccuacgaagaagaccuugaagaacuacuagagaaaauuggggaugacuacauagauuuauucguccaagcuaaaaauguguacgacgcugucuuauugucugaaauucuauccgacucuacaaaaaacacaagagcaaagcucagugcuggcaugaucagaagguaugaugcacauaaagaagaucuaguccuacuaaaacgauuuguaaaagaaaaccuaccgaaaaaauauagagccuucuucggcgacaauuccguaaacggauacgccgguuacauagaaggucacgcuacacaagaagcuuucuauaaguucguaaaaaaagaauuaacaggaauacgaggaucagaaguguuucucacaaaaauagaacaagaaaacuuucuacggaaacaaagaaccuucgacaaugguguuauaccucaucagauucaccucucagaauuaagagccauaaucgcuaaccaaaaaaaacauuaucccuuuuuaaaagaagaacaagaaaaauuagaaucuuuacuaacuuuuaaaauaccguauuacguaggaccccuagcaaaaaaacaagaaaacucaccauucgcuugguuaauaaggaaaagugaagagaaaauaaaacccuggaacuuaccagaaauaguagauauggaagggucagcgguaagauuuaucgaaagaaugauaaacacagacauguauaugccccauaauaaaguuuugccuaagaacuccuuacuuuaccagaaauuuucaauuuacaacgaacuaaccaaaguacgauaccaggacgaaaggggacaaaugaacuacuucucaagcauugaaaaaaaagaaaucuuucaugaacuauuugagaaaaauagaaaaguaacuaaaaaagaucuucaagaauuucuauaccuaaaauaugacauuaaacacgccgagcucaguggcauagaaaaagccuucaacgcaucauacacaaccuaccacgauuuucuaacaaugagcgaaaacaagagagaaaugaaacagugguuagaagauccggaacuagcaucaauguucgaagaaauaauaaaaacacuaaccguuuuugaggacagagaaaugauaaaaacuagacucagccaccacgaagccacacuagguaaacauauaauuaaaaaauugacaaaaaaacauuauacggguuggggaagacucucgaaagaguuaauacaaggcauacgcgacaaacaauccaacaaaacuauucuagauuaccucauaaaugacgaugacuuuccccaucaucgcaacagaaacuucaugcaauuaauaaacgacgacucacuaucauuuaaaaaagagauaaaaaaagcacaaaugauaaccgauacggaaaaucuagaagaaaucguuaaagaacuaacaggcuccccagcuauuaaaaaaggaauuuuacaaagcuuaaaaaucguugaugaaauagucgguauaaugggcuacgaaccggcuaauaucgucguagaaauggcucgagaaaaccaaacuacuggcagaggauuaaaaaguucccgaccuagacucaaagcguuagaagaaucucuaaaagacuucgggagucaauuacuaaaagaauauccgaccgauaauucaucacuccaaaaagauagauuauacuuauauuaucuacagaacggaagagacauguacacaggcgccccacuagauauacauaggcucagugacuacgauauagaccacauaauacccagaucauuuacaacagauaacucaauagacaacaaaguacuuguuucauccaaagagaaucgucuaaaaaaagacgacguaccaucagaaaagguuguaaaaaaaaugagaagcuucugguaugauuuauacucaucaaaauugaucucaaaaagaaaacucgacaacuuaacaaaaaucaaauuaaccgaggaagacaaagcaggauuuauaaaaaggcaacucguagaaacaaggcagaucacuaaacauguagccggcaucuuacaucacagguuuaauaaggccgaagauaccaacgauccaaucagaaaaguucgaauaauuacccuuaaaucugcacuaguuucacaauucagaaacagguuuggaauauacaaaguacgugaaauuaacgaguaucaucacgcccaugaugcauaccucaauggcguagucgcacucgcauuacuaaagaaauauccucaguuagccccagaauucguuuauggcgaauaucuuaaauuuaaugcgcauaaagccaacaaagcaacaguuaaaaaagaauucuauucaaacauuaugaaauucuucgaaucagauaccccagucugcgaugaaaacggagaaaucuuuugggauaaaucaaaaaguauugcacaagucaaaaaaguaauaaaucaucaccauaugaauauagucaaaaagacagaaauccagaaaggcgguuuuagcaaagaaacagucgaaccuaaaaaagauucaucaaaauuauuaccgagaaaaaacaacugggauccggcuaaauacggaggccucgguuccccaaacguagcauacacagucgcauucacuuaugaaaaaggaaaagcacgcaaaaggacaaacgcauuagaaggaauuacaauaauggaaagagaagcauucgaacaaagucccguucuauucuuaaaaaauaaaggauaugaacaggcagaaauagaaaugaaauuaccaaaauaugcacuuuuugaacuggaaaacggcaggaaaagaaugguagcauccaauaaagaagcccaaaaagccaacucauuucuacuaccagaacaccuugucacauuauuguaccaugccaagcaauaugaugaaauaucacauaaggaaucuuucgacuaugucaacgagcaucacaaagaauuuucugaaguguucgcccgcguacuagaauucgccggcaaauauacauuagccgaaaaaaauauagaaaaauuagaaaaaauauacaaagaaaaccaaacggaugauuuagccaaacuagccucaucauuuguaaaucuaaugcaauucaaugcaaugggcgcaccugcagacuuuaaguuuuuugauguaacaauaccuagaaaacguuacacaucccuaacagagauuuggcaguccacuauaauacaccaaaguauuacuggguuauaugaaacaagaauaagaaugggcaaauga

SEQ ID NO: 5307 - RNA, 4023 nt, Artificial Sequence
  Cas9 variant
auggaacaagaauacuaucuaggguuagacaugggaacaggaucggugggaugggcaguaacugacagcgaauaucauguguuaagaaaacaugguaaagcgcuauggggaguaagauuauucgaaagcgcauccacugcugaagaaagaagaauguuuagaacaucacgcagaagacuagaucguagaaacuggagaauugaaauauuacaagaaauauuugcagaagaaauaucuaagaaagauccagguuucuuuuuacgaaugaaagaaucuaaauauuaccccgaagauaaacgggacauuaaugguaacugcccagaacuaccauacgcacuguuuguagaugaugacuuuacagauaaagacuaccacaagaaauuuccuaccauauaucauuuaagaaaaaugcuaaugaacacggaagaaaccccggauauacgauuagucuaucuagcaauucaucauaugaugaaacaccgaggacacuucuuacucaguggcgauauaaacgaaauaaaagaguucggaacaacauuuagcaaauuacucgaaaauaucaaaaacgaagaacuagauuggaaccucgaacuugguaaagaagaauacgccguaguggaaucgauucuaaaagauaacaugcuaaacagaagcacgaagaaaaccagauuaauaaaagcacucaaagcaaaaucaaucugcgaaaaagcuguacucaacuuacucgcaggcggaacagugaaacuguccgacaucuucgggcuugaagaauuaaaugaaacagaacguccgaaaauuucauucgccgacaacggcuaugacgacuacauaggcgaaguagaaaaugaacuaggagaacaauucuacauaauagaaaccgcaaaagcaguauaugacugggcaguauuagucgaaauacuaggaaaauacacauccauaagugaagcaaaaguugccacauacgaaaaacacaaaagcgaccuccaguuucucaagaaaauuguaagaaaauaucuaacgaaagaagaauauaaagacauauucguaucaacaagugacaaacucaaaaacuauagcgcauauauugguaugaccaaaauaaaugggaagaaaguggaucuccaaaguaaacgauguagcaaagaagaguucuaugauuuuaucaagaaaaauguacuuaagaaacuugaagggcaaccagaauaugaauauuuaaaagaggaacuagaaagagaaacguuccuaccuaaacaaguuaacagagacaauggaguaaucccauaccaaauacaccucuacgagcuaaagaaaauacugggaaaucuuagagacaaaauagauuuaauaaaagaaaaugaagacaaauugguacaauuauucgaguuccgcauaccauacuauguaggaccauuaaacaaaaucgacgacgguaaagagggaaaauucacgugggcagugagaaaaaguaaugagaaaauauacccuuggaacuucgaaaauguaguggauauugaggcuucagcagaaaaauucauaagaagaaugacaaauaaauguacauacuuaaugggugaagauguccuacccaaagauaguuuacuauauucaaaauacauggucuuaaacgaauugaacaacguaaaauuagauggagaaaaacuaaguguagaauuaaaacaaaggcuauauacugacguauucugcaaauaucgaaaagugacggucaagaaaaucaaaaacuaccuaaaaugugaggggauaauaucaggaaauguagagauaacuggaauagauggcgauuuuaaagcuagucucacggcauaucacgauuucaaagaaauauuaacuggaaccgaacuagcgaagaaagauaaagaaaauauaauaaccaauauaguacuauucggugaugauaagaaacuacucaagaaaagauuaaacagacucuacccucaaauuaccccaaaucaacuaaagaaaaucugcgcacuaucauauacuggaugggguagauucaguaagaaauuucuugaagaaauaacagccccagauccagaaaccggcgagguuuggaauauaauuacagcucuaugggagagcaacaacaacuuaaugcaguuacuaaguaacgaauacagguuuauggaggaaguagaaacauauaacaugggaaaacaaacaaaaacuuuaaguuaugaaacuguugaaaauauguaugucaguccgucagugaaaaggcagauauggcaaaccuuaaaaauaguaaaagaauuggaaaaagugaugaaagaaaguccaaaaagggucuuuaucgaaauggcacgagaaaaacaagaaagcaaacggacagaaucgaggaagaaacagcucauugacuuauauaaagcauguaaaaaugaagaaaaagacuggguaaaagaauuaggagaccaagaagaacaaaaacuucgauccgacaaauuauaucuguauuacacacagaaaggccgaugcauguacagcggcgaaguaauagaacuaaaagaccuaugggauaauacaaaauaugacauagaccauauauacccacaaucaaaaaccauggaugacuccuuaaauaauagaguauuaguuaaaaagaaauauaacgccauaaaaucagauaaauauccucuaaaugaaaacauacgacacgagcgcaaaggauuuuggaaaucccuccuagacgguggauuuauaagcaaagaaaaauacgaaaggcuaauacguaauacugaacucucaccagaagaguuagcaggauucauagaaaggcaaauaguugagacccgacaaucaacaaaagcugucgcagaaaucuuaaaacagguauucccagaaucagaaauuguauauguaaaagcaggaacgguaagucgauuucgaaaagauuucgaacuccuaaaaguaagagaaguuaacgaccuacaccacgccaaagaugcauauuuaaauauaguaguuggaaauaguuauuacguuaaauuuacuaaaaacgccaguugguucauaaaagaaaaucccggaagaacauacaaucuaaagaaaauguuuacaucagguuggaauauagaaaggaacggagaaguagccugggaaguaggcaagaaagggacgauagucacgguaaaacagauaaugaauaaaaacaacauccucguaacaaggcagguacacgaagcaaaaggaggacuauuugaccaacaaauaaugaagaaaggaaaaggucaaauagccauuaaagagacugacgaaagacuagcaaguauagagaaauauggaggauacaauaaagcagcaggcgccuacuucauguuaguugaaucuaaagauaagaaaggaaaaacaauaagaacaauagaguucauaccucucuacuuaaagaacaaaauagaaucugaugaaucaauagcauuaaauuuccucgaaaaaggaagaggauuaaaagaaccaaaaauccuuuuaaagaaaauaaaaauagauacauuauuugacguagauggcuuuaaaauguggcuuucaggaagaacaggagauagacuccuauucaaaugcgcgaaccaauuaauacuagaugagaaaauaauaguaacuaugaaaaagauagugaaauucauacaaagacgacaagaaaaccgagaacucaaauuaucagauaaagacggaauugacaacgaaguucugauggaaauuuauaauacguucguagauaaacuugaaaacaccguuuaucgaauaagacuuucagaacaagcaaaaacacuuauagaccgacaaaaagaauuugaaagacuuucauuagaagacaaaaguaguacacuauucgaaauuuuacauauauuucaaugccaaucaagcgcagcgaacuuaaaaaugauaggagggccaggaaaggccggaauccuaguaaugaauaauaauaucucaaaaugcaacaaaaucucaauuauaaaccaaagucccaccggaauauuugaaaaugaaauugauuuacuaaaaaucuga

SEQ ID NO: 5308 - RNA, 4026 nt, Artificial Sequence
  Cas9 variant
augagguuccaaaacaagaaaacgggagauuacuuugucggucucgauauagggaccaauaguguugguugggcuguaacuaaugaaaaauacgaaauauuaagagcuaaaaaucauagaauguggggcucaagauuguucgaagaaggcaaaacagccgaagaacgaagaguacacagagcaggucgccgucgcuuaaaccgacgaaacgauagauuaaugaucuuggaagaccuauucgcggaagaaauaaguaaaguagacaaagcguucuaccaaagacuacaugaaucacaauaccgacaagaacauaaaacgguuagcggaccguacuuccuauuuaacgacaaagaauuuacugacgaagacuaccauauugacuacccaacuauauaccauuuacgagucgcuuuaaugaaagccccagcaaaagauguacgcuuauuauucuuagcaauucaucauauaauaaaauauagaggaaacuucuuacacgaaggcgaaacauucaaaacaacagguggacucacugauauauuacaacguguucuagcaugcaaugaguucagugguuuaaaacaacacaucgaugacaccgcuuuaguuaaauugcuaaccaauaaagguauuacaagaagcgacauagcaaaacaaaucucagaacucgcaacagauaaacucuacagaaagcaagccaaagcauuugccucgcuaguacuuggccuaaaagcaaacuuggaugauuuauuuaacgaaccagaauacaaagaauuagacucagaaauuaggaccguggaauuuucaggcaaagaauauugggaagaacgagacaaguaugaaccauacuugggagaaucucucuucgcucuggacggauguaaaacauuauacgauacauuacuauuaucaaauauaaaacccgauggaaaauauuuaucggaagcaaaaguagaaacauuugaaaaacaccacgaacaucuggaaucgcuuaaagacuuauuaaaaucaaacaaagcacuauacaaucgaguauuaagagaugacgaaaagaauuuaaauaauuauauaacauauauugguaaaagugaauuuaacaaaagauguagucgagacgaauuuuauaaauuccuuaaacaaacaauaaaagauauaagcgacaaugaaaauaaagcugaaauuguacaauuaauggaacucgauucauuccuuccacuauuaaggguacgagaaaauggugucauuccuuaccaaauucacgaagaagaauuagaacaaauauuaaauguuuccucagaaaaauacccauuuuugaacaaagcggacggcucaggauucaccaucgcgcagaaaauucuaaaacuccuuaccuucagaauaccauacuucguagguccccucaacccagcacauaaagauagggacaacggguucgcauggguaguaagaaaagcaccagguaaaguuuacccuuggaauuucgaagacaaaguugauauauccgcuucagcaaccgcuuuuauagaaaacuuaaccaacaaaugcacauacuugauaggagaagacguacuucccaaauacagcuuagcauauaguaaauuuagccuacuaaacgaauuaaauaaucuaagauacgacggcaaaccauuaucauaugaaacaaaacagagcuuuauaaaggauuguuucgaaaaagaacaccguaagaugaccgagaaaaggauacgagaauuuuuaaaacauuuaggaggaacagacgguaaaggagcauuaacaggacucgacguagauaucaaaucagaucuuaaaucuuaucgagauaugguacggauauugggcgacggauucgacgaaaccauggcagaacgaauaauacguuauguuacacuauuuggugaagcuaagaaaguauuauuaaguacacuagaaauagaauuuggagacgacuugucugauacacaaaagaaacaaauauuaaaacuacaauauagagauuggggaagacuaucagcuacccuacuaaaagguauuaaaggggucgccggagauaauccagaaugcuccauauuagaaugcauggaacaacaaccguuaaauuuaauggaaguguuaucaucacauaacacuuauuuggcagcaauugaggaguucaauaaagaaagaacugaacccacugacauuguagacuauaaauuaguagaugaccuuuacauuucgccagcuguaaaacgcucgguuuggcaaacgcucagaauauuagacgaaauaacaaaacucagaggcuccgucccuaagaaaguauuuguugaaguagcuagaacaaaucgugcagagaaaaagaaaaccgauaguagaaaagaaagauuauuacagcuauacaaaacaauaaaagacgaaggaaggaacuggacagaagaaauuaaacaaagagaugcuggggauuucaacagcaagaaacuuuucuuguacuacacccaacaaggccgauguauguacucaggugagaaaauaaccaguauuggugacuuauuuacgagcaaauaugauaucgaucauauauacccaagaucggucacuaaagauaacucaugggacaacuuagucuuagucaaagcagaacuaaaccgcgaaaagaaagacauuuacccaaucgaaaaagacacacaggacagaugcauaagccuauggaaacagcuucucgaacaaggacucauaucagaaagaaaauacgaaagacuggucagaacaaccccacuaacagcagacgaacuagcagacuuugugaauaggcaacucguagaaacaaaccaaaguguaaaagcaguuaccaauuuauuaaaaagacuguacccagacaccacaauaugcuauguaaaagccgaaaauguauccgacuucagacaggaaagagaauuugugaaacuuagaucacuaaaugcacaccaccaugcaaaagaugccuaccucaauauagucguuggaaacguauaccaugaaaaauuuacuaacaacccacgcaacuuuauuaaaaaugcacggucagacaagaaaagaccuuacagccuaaaucacauguuugauuaucuccuacaaguagguaauaaagaaauauggaaucccaaaacugauaauaaucucgucaagaaaaugaugcgaaauaaugauguacaaguaacuagaaugcucguagagcaaacuggcgcacuguacgaugcaacaauauacaaggcuucagugacaaaaagcgaaucauauguaccacuaaaaucauccgaugccauuuuaucagauguaaagaaauauggaggcuucacaucaaucaaaauugcauauuauucgauauucagguucuacaagaaaaacucagaagaauuugagacacauauaauaagcauaccuguauuaaaagcaggcacacucaauagcaaagaagauuauguagcuuacggagaagagauaaugaauaaacaaaaauucgacagaguagagcuaguuuauaagaaauuauguaugaacucacucguacgaauaaacgguguuauguauuaucuaggagggaaaaccaauaacucacuuuauauagauucagcaaucagccuaguacugccagacaauauagcaaagaaaauaaaagccguagaaaaauauauagcacgugucgcagaaaacggcaauuauaaaccacagccagaccaagucucaccugaguucaauaugauuauauauaaggcauuaacagagaaaaugaaacaacccgcauucguaggauugaaaacaaaucgggaaaaugaacuggaaaaagaaaccacaauaacagccuuuauagcaaugacacuaauagaacaauguaaaaugcuaauggaaauacuaaaucuacucacacaacagaaaacaacauaugcucuaaaaccaaucggugugucagcaucaagaucuacacuaggaaugaauauaacagguuuaagcgaauuuacaauaauaacucaaagugucacagguuuacaagaaaaagaaauaagaauuaucuga

SEQ ID NO: 5309 - RNA, 4026 nt, Artificial Sequence
  Cas9 variant
auguggggaucccgacuauucgaagaagcauccacagcccaagaccgcagagaacacagaagcaacagacgacgucuagaaagacgaaaauaucgucuggaccuguuagaagaacuauuuguagaagaaauaaacaaaauagauccagaauuuuucauuagacuaagggaaaguaaauuucauuucgaagauagaucacuuaaaaauacauuuauacuuuuuaacgacaaaauggaaggagguuacaacgacaaaguauucuuuucaaaauacccuacaauauaccacuuaagaagugcacuaaucaauggaaacaaagaagacgucagagcaguguuccuagccauucacaauauacucaaaaaccgaggacauuucuuacuagcuggaaacgauauaaacauuucacuaucccugaaugauacguuaacagauuuauucgaauaucuaaaaauacaccuaggaauagaaguagaguucgaaaauaaauuaaaagacaucgagaaaauagcccuagacaaaaaucuaucaaaaagcgauaaacagaagaaaauaguacaacuacuagaaacagacuauaagaaacaauuagcugauguauucaaacuaucauuaggucugacagcaaacauggaaaacauauuuggcaaagaaaacgaacaaggcuuagaauuuauaaaugccgaaaauaaaaucaagaaaauacaauucgacaguucauacgaagaaaauauugcagaauuugaucaauucuacggagaauauuucgaaauaauagacauuuguaagaaaauauaugaugcaauaucucucucucaaauccuaguagacgguaaaggccucucagaaagcaaaguguuaucguacgaaaaacacaaagaggacuuaaaacuacucaagaaagugcuaaagaacauagacaaagcguaugauaacaaaggagaagacagauuaguauacaaaguucuuaaagaagacaaagauaaaggaacgaacuacguaaauuacaguaaauuaucaaauaacggaacagcaacuacaaaagaagaguucuacaaauuccugucuaaaaaccuggaucuuaagaaauuuggaaaacuaaacaaagaagauauagaaaccuuagauuacauaaacucagaaauacuauuaggcagauuccuaccucuacaaaaagagaaaaucaacggaguaauaccauaucaauuacaaaugaaagaacuuacccaaauucuaaacaaugcaagcaaauaccuaccauucuuaaacaaaauagaagauggaaugacuguuaaagacaaaauaauaucuuuaauuaaauuccguauaccauacuaugucgguccgcucaacgaauauaacagaaucgaaaacggaaacgguuuugcauggauagagaaaaagaaaaaugagaaaaucuuucccuggaacuuuaacgacgucgucgauauagaaaaauccgcagaaaaauucauuaacaacuugacaaauaaauguaccuacauaaaagaagaaaccguucuacccaaaaacaguauaauauauucaaaauuuaugguucuuaaugaacucaacaauuuacaauacggaaacaagaaacuagacauagaacuaaaaaugaaaauguauacugaccuuuuucuugaaaagaaagacaauagaaaaguaacagagaaaagaauccuugaauauuucagaauaaacggcauaaacgauggaaaagaaaaacuaaccggacuaaacaacgaaauacaugcagacaugaaauccuaccgagacaugugugaaauaaugggagaaaacuucaacauaaaugucgcagaaaauauaaucaacuggauaaccguauuucacggugagaagaaaauacuuauuaauaaaaucaaaaauguauacggcaaaauguucaacgacgaacaaaucucaaaacuauccaaacuaaacuauagugauuggggacgacucagcaagaaacuacucacagacauaaaauguuauauagaugcagacgguauaaauuucccuguaucaauccuggaagcaauggaagucuccaacaaaaaccuaauggaguuacucucaaacaaauaugaguucauaucaugcaucgacgacauaaacaacaaauacuucggagauagggacauaucugcaagcgaacucaucgacgaacuauauguaucaccagcaguuaaacgagguauauggcaaucaguacgcauuuuagaggaaauaguaagcaucauaggacacaaccccaagaaaauauucauagagaugacccgacacaaugaagaaaaaguucagaaaucaucaaggcgucacaaucuugaggaacucuauaaagccauccgcaaagacccagaauacguagaacugaucaaagaauuugauagcacuacugacacagauucauucaaaauaaagaaauuauaucuauauuucaugcaacuugggaaaugugcauauucaaaagagaaaaucgacuucgacaaauuauuuacugauuccuacgacauugaccauaucuacccaagaucuaaaacaaaagacgacucuauacauaacaaucuaguuuuagucaaagcaaaauauaauagagagaaaacugauguauacccaaucgauauaaauauccagaaaaauaugaacucauuuuggaauuuccuuuacaccaagaaauucaucacagaagaaaaauauaaacgcuugauacguacaagcgaccuaacagaugaagaauuggcaaaauuuauaaguagacagcuaguagaaacgagccaaaguaccaaagcaacagccgaaguacugaaacaaauauauggagacagugacauuugcuacguuaaagcagaaaacguuucagauuuccgauauggaagcucccgucaaaaagauaaaaaugauauacaaaaacuauuuguuaaaugccgugaaguuaaccauuuccaucaugcgaaagacgcguauuuaaacauuguugucggaaacguguacgauguaaaauuuaccaaaaaccccgucaacuucaucaagaaaaacaaaaugggcaacaaaucgaauuauucucugaaccacauguuuuguuucgacguugaacgaaacggauacaaagcaugggauucuuccgaaaccauaaaaacaguaggcagaaugaugaaaucaaacgacgugagaauuacgaaacauguccacccaacaagaggagaacuguacgaugcaaccauauacaaagcaaaaauugcaaaaacuggcucauacaugccuuugaaaucaagcaaaaacaccccacugagcgauguaacaaaauauggaggauacacaaaaauaaaaaucgccuauuacuccguauauaaguacaaguucagugacaaaaaccucaucaaaaccgaaauaagacugauaccaaucccaauauaccuaagcaaaaacgacgaugacauaaaagaauacgucaaaaauuaccuaaacgacaggguuaauucaaaauuaauagacuucacaaaaaucuacgauaaauuauacguuaauucacuaauaaaaauaaauggauauuuauauuaccuuggcgguaaaacaaaugauagagucuggauagauaacgccguaucaauagucuuggaugacaagauagaguaccuaauaaaaaggauaucaaaugauauaaaauauggguacgaaauaaacgugagugaugacgaacuaauggacaucuaugaaucacucgcagaaaaagcgaacaaaaagauauuuuacaacagacuuucagacuucgaaaagauauucucaaauauggaugucaaaaagaaauucgucaagcuagagaaaaacgacaagugcaggguauuacuccaauuacuuaacguauuaacagacagccaaacaacauacaaacuggagaugguaggauugaaacauucaaggaguaacauaggaaugaaaaucucaaacuuagaagaguucaaaguaauaaauuccaguauaacaggacucuauucaaaugaaauagauauuuuaaauauauga

SEQ ID NO: 5310 - RNA, 4026 nt, Artificial Sequence
  Cas9 variant
auggaaaaagauuacuacuuaggacuggauaugggauccggaucagcgggaugggcagugacugacgaucaauaucacguacuaagagcucacggaaaagcaaugugggguacgcgcuuguucgaaagcgcuaauaccgcagaagaacgucgaauaaauagaacagcacgaagaagacuaaaacggagaaaccaaagaauagaaugguuacaagaaauauuugcggaagaaauuaacacaaaagacucuggguuuuuccggcgaaugaaagaaucgagauacugggcagaagauaaacgagacgaaaauggaaguugcccagaaaugccauacagccuauucauagaugaagacuuuacagauaaagaauaccaugaaaaauucccuacaauauaucauuuaagaaaauauuugaugacaacagaagaaacaccaggaauaagauuagucuacuuagccuuucaccacaugaugaaacauagaggacacuuuuuacuuaacggaaauauagaagaaauacgaaaauuucgaaaaaccuucgaucaauucuuagaaguagucagaaacgaagaaaugggauucgcaggcgaaauagaagaagaaacauauaagaaaauagaaaugacuuugaaagacguaaauuuaacucggucagccaagaaaacaacauuaauaaagagcuuaaaaguuacuagaguugaagaaaaagaacuacuagcauuaauaagcggauguacggucaaacuaucaaauauauuuaaugauaaauccuuagaugagacggaaagaccaaaaaucaguuuugcagacgcuggcuucgacgacuaugaagcagagauacaaaguaaccuuaacgaaaaauacuacaucauagaaagcgcaaaagcuguauacgauugggcugcauuagcagauauauugggggaauacaguuguauaagcgaagcgaaaguugcacuauacgaaaaacaucauaaagaccucaaaagauuaaaagaccuaguaaggaauaacaucucuucagaaguauauaaagaaauuuucgucgacgucaguggaaaauacaaaaauuauugcgccuacaucggaacuacaaacauuaauggcaagaagaaagauuucgaaggcaagaaaugcacaaaagaggauuucuacgccuaucucaagaaaucaguuauagaaugcauaaacgauagcgagaaaacagacuggcucaaacuggaauuagaaaaaggaaacuuccucccaaaacaauugaccggcgaaaauaguguaauacccuaccaaguucaccuuuaugaacucaacgcaauaauaacuaaccuccaagaaagaauaccauuacuuaaaagagacggagagaaaauucgacaaauauucacauuucguguaccauauuaugucggcccauuaaacggaauaagcauagaugggaagaaaacaaacuggguaaaacgaaaagaaggugugauuuacccuuggaacuuuucagacauaguggacgaagaaagcucagcugaaaguuucauaaggcgaaugacaaacaaauguacauaccuuauacacgaagacgugcuaccuaaauauucuuuacuauauagcagauucgaaguucucaacgaauuaaauaaugucagguuaaacggggaacuauuaaguguagagcuaaaacagaaaauauacgaggauguauuucaacguuauagaaaagucacgcagaaacgacuuaaacgauaccuccuaacagaaggaauaauagacgaaaacacaguuauaacaggccuagacggcgauuucaaagguaguuuaacugcauaucacgauuucaaagaaaaacucaccggauuaaaucuaacugaacgugaaaaagaagaaauaauuuuaaauaucacgcuauucggggaugcgaggagcuuauuaagaaaacggauaggaaaaauaugcagucaacuaucagacaaacaaaaagaaaaucuuagcaaacuuagcuaucaaggcugggguagauuguccaagaaauuuuuaaaugguauagcgaucagcguccaaggagaagaagaauggacaauuauuaaagcacucugggaaacucaagauaaccugagucaacucaugggugcaaaauauacauuuagaaacgcaguagaaaaagagaacggagaacucgaaaacagagaaauuaguuaugaaacaguaaaagacuuaucaauaagcccaucuguaaaaaggcaagucuggcaaucacuucuaauagugaaagaaauauguaaaauccagaagaaaccuccacgaaaaguauucguagaaguagcaaaagagaaaacuaacagugguaggacggaaaguaggaagaaaagacuucaagacuuuuauaaauauuguagcaaauacgaaaaagaacuauacgaugaaagcauccaaaauaaauuagaaaaaugcucagaaucagaucuaagauccgacaaacuauucuuauacuacaugcaaaugggacgauguauguauacugggcaacccaucgacuucgaugaacucuggaacaaccaaaaauaugauaucgaucauaucuacccacaaaguaaaaccauggaugauucaauagacaacagagucuuaguaaaaaggaucucaaaccaagagaaaacagauguguaucccauaagagcagauauccgagaaaagagaagagguuuuuggaaagaacucaaaaacguuggccuaauuagugaagaaaaguauaaacgacuaacaagagcuacugaauuugaaccagcagaacuagcaggcuucaucucaagacaauugguagaaaaccgacagaccacaaagguagucgcaagcauuuugaagcaagccaugccggacaccgaaaucguauaugugaaagcacgaaccguaucugaauuucggcacaaauucaacuucauaaaaguuagagaaaugaacgacuuccaccaugcaaaggaugcauaucucaacguuguagugggaaacacauaccuaguaaaauuuacaaaaucacccguaaauuuuauugagaaccacucaaaccguagcuacaaucuaaagaaaauguucacagauggaagaguagaacggaauggcgaaauagcauggauauccggagaaaaugguaccauaggcacaguaagaaacauaaugaagaaaaacaauauucucgucacgaggagagcacacgaggcgacaggcggguuuuucgaccaacaacuaaugaagaaaggaaaaggacaagugccuguaaaagguagugaugaaagacugcuagacauugaaaaguauggaggauauaacaaagaaacaggagcauacuucgucuuagucgagagcgacgagaagaaaggcaaaaagaaaagaacaauagaauauguaccgauaagacucaaaaagcaacuagaaaacaauagaaaagcacuagaaaacuacuuaugugaacaaagaggacuaacaaacccagucguauuaaucgacaagauaaaaauggauucuuuauuccguguagauggcuucuucauguggcuauccggaagaaccggaaaccaauuacuauucaaaugugcgaaucagcuagucuugucuaccgaagacgaggcgacauuaaagaaaauaguaaaauuuguaaaccgacgaaaagaaaauaaagagauaaaaauauacgaaagugauaaacuaaacgaagaaauguuaaacagacuauacaacacauuccuuuacaaacuucaaaauucaauauauggaaaccgguuaggcgagcaagcuaaaacacuaucuaguaagaaagaaaauuuugacaaacugcagauugaagaaaaaugccuaguccuauacgagauuuuacauauguuucaaugucaaagugcaaccuccgaccuacaacuaauagagggaccaggcaaagcaggaacacuaagguuaaauucgaauauaacuaaauacaaaaacaucaauaucaucaaccaaucaccaacgggaauauacgagcaaguaauagaccuacagaaaauauga

SEQ ID NO: 5311 - RNA, 4026 nt, Artificial Sequence
  Cas9 variant
augggcaaagguuauuacguaggccuagacauggguacuggaaguguaggaugggcaguaaccgaugaaucauaccaaauacugcgacgccacggaaaagccauguggggaguuagauuguuugaaagcgcaaaaaccgcugaagaaagaaggauguucagaacaggaagacgaagguuagacagaagagguuggcggauagaaauucuucaagaaauauuugcggaagaaauaucccgaguagauccaggcuucuuucuucgaaugaaagaaagcaaauacuacccagaagauaaaagagauauacaggggaacugucccgagcucccuuacacuuuauuugucgacaaaacuuucacggacaaggacuuccauaaaaaauaccccacaaucuaccauuuaagaaaaauguugauggaaacagaagacacaccagauaugagauuagucuaccuagcgcuccaccauaugaugaaacauagaggacacuuuuuauugagcggagauaucagccaaguaacagaauuuaaaaacaccuucaaccaguucauagaaaauauaagaaaugaagaaauggacuuugaaauugaauuagacgaaagcgccgugcagaugauagaggaaacauuaaaagauaaaaaccucacccgaucugccaaaaagucuaaauuaguuaaaggucucaaugcuaaaaauguccgagauaaagcauucuuaacgcuuuuaucaggaggaaccgugaaguuaucagaucuauucggaauggaagaacuaaacgaaggugaaaggcccaaaauaaguuucgcagacaaugguuacgaagaauaugccgcugugguagaaauggaguuaggagaauuauauuauauaguagaaucagcuaaagccguuuacgacugggccaucuugucagauauccuaggaggcucaacaucaguaagugacgccaaaguccgagcauaugaaaaacacaaagcagauuugaaauacuuaaaagcaguaguuaaagaauauuuuccuaaggaaguguauaaugcaguauuuguagaaucauccgauaaacugaauaauuauccggcguauaucggaaugacaaaaaaaaauggaaaaaaagucagccuagaaggaaaaagaugcucuagggaagaguucauggauuuucugaaaaaaaacauugugguuaaauuaccagaugaggaggcaaaaauguaucugcaaagugagcucgaaaaagauaguuuccuacccaaacaaguaaacaaagauaacggaguaauaccauaccaaguacauaaauaugaauuaaaaaaaauacuagauaacuuaggggauaaaauucccuuccuaaaagagaaugcagaaaaaauagagaaauuguuuaguuuuagaauaccguauuacgugggaccacuaagaacagguaauggagaaaauuccaaauuugcaugggcagaacgaaaaucaacagaaaagauauauccguggaacuuugaaaacguuauugacguugaacaaucagccgaaaacuucauaagaagaaugacaaacaaauguaccuacuuaauaggugaagauguucuaccgaaagauagucuacucuacagcaaguuuaugguauuaaacgaauuaaauaauuuaagacuugacggacaaaaaauaucagucgagcuaaaacaaaaaauauauagagauguauuuuguagaucacgaaaaguaacacaaaaaaaguuaaaaucguacuuaauaagggaagggaucgcuggaaaaaauguagaacuaacugggauagacggagacuuuaaaggaucgcuaacggcauaucaugauuuuaaagaaaaacuaauagacguugaacugacccagaaagaaaaagaagagauaauauuaaacauuguguuguuuggagacgacaaaaaacuccugaaacaaaggcuuaaaaaaaaauucccacaauuaacggaaaagcaaaucaauacaguaacagccuuaucauacaaaggaugggggagacuuucaaagaaacuucuggaagaagucacuguaccugcucccgagacuggagaaguauggaacauaauaacggcauuaugggaaacuaaugacaauuuuaugcaacuacuuagcaaagaauaccaauuuagugauagaauagaagaguuuaacgaagaaaaagcagauccugaaguaucauaucagacgaucgaagaucuuuauguaaguccagcaguuaagcgacaaauuuggcaaacguuacaaauaauucaagaaauagaaaaaguuaugggugagaagccaaagcguguuuuuguugaaauggcccgcgaaaaacaggaaaacaaaagaacagaaaguagaaaaaagacgcuaucagaucuauauacaaaauguaagaaggaagaaccagaauggauagaagccuuauguacaucucuagaaaaacaugaagaacaucaauugagaagcgacaaacuauauuuauauuauacacaaaaggggagaugcauguacucaggggaaccgauagaucuagaagacuuaugggacaauacaaaauaugauauugaucauauauacccccagucgaaaaccauggaugacucucuaaaaaacagaguucuaguaaaaaaagaauauaacgcaaagaaaucggacacauacccgauagcggccgauauacagaaaaaaaugaugcccuucuggaaguccuuacuaacuggagguuucauuccuaaggaaaaauacgaucgauuggucaggaauaauccacuagaugcaaacgaacuagcaggauucauagagcgacaaaucguugaaacgagacaaagcacaaaagcuguagcagaaauauuaaaaaaaauacuacccgauacagaaauaguauaugucaaagcgaaaacaguaucaaaauuuagacaagacuucgauuucauaaaagugcgagacaugaacgaucugcaccaugcaaaagaugccuaccuaaauaucgucguaggaaauguauacuuuguaaaauucacuaagaaugcagcuugguucgugaaagaaaauccaggcaggacauacaaccucgaaaaaauguuuauaugggacguagcuagagacggagaaauagcauggaaggcuggaaaaaguggaaguauuguacaaguaagagcaaugauggaaaaaaaucacauccuaguuacacgucgaaguuacgaaguaaagggagggcuauuugaucaacaaauauuaaaaaaaggaaagggacaaguaccagugaaggaaucagaugagcgacucagagacauaggaaaauacggaggcuacaacaaagcugccggcguauacuuuaugcuaguaaguaguaaagauaaaaaggggaaagaacaacgaaccaucgaauuuguaccaauauacuugaaagauagagucgaaaaagauauggaaagugcaagaaauuauuugauggaagaaaggggauuacgagaaccuaagauucuuauuaagaagauaaaaauagauacauuauucaaaguugacggauucuauauguggcuaaguggaagaacauccaaucaauuaauuuuuaaaggcgcaaaucaacuuauuuuaaguaaagaagauaugaaaacauugaaaaaaguuguaaaguacauacaaagacaaaaagaagacaaaaauguaaaaauaaguaugcgagacggaauaacugaagaagaauuauuaaaacuuuacgaaacguuucuagauaaaauaagacauagcauauacggagcaagacuaucuucacaggaaaaaacacugguaaacggaaaagaaaaguuuauagacuuaucaguagaagcaaaaugucaaguauuauacgaaauacuccauuuauuccagugccaaagcggagccgcaaaucuaaagaugauuggaggacccgcaucagcaggaauuuuaguaaugaauaauaauauuaguaaauguaaaaacaucaguauaguaaaucaaagcccaacaggaauauaugagaaagagauagaucuacuaagaguauga

SEQ ID NO: 5312 - RNA, 4026 nt, Artificial Sequence
  Cas9 variant
augacacaaaaagugauaccuuauaauauuggacuugauauaggcacaaauuccguuggcugggccguaacggacaacgaaaacaaauuguugcauauaaaagggcacaacgggauaggcguacgucucuucaaagaaggccagagugcggccgaaagaugcggcuucagaacaacaagaagacgucucaguagaagaaaauggcgauuaagguuacuuaaugaaauauuugccgacaaaauagcaaaaguagaccccagcuucuuugcaagacuuaaacaaagcaauguuucaccaaaagaucccaacaaaacaauguuuggaaauauucuauuugauaaugggaaccuuaacgacaaaucuuuucacgaugaauauaaaacgauauaucauuuaagacaaucaauaauugaccacccagaaaagaaauuugacauaagacucauuuaucuagcaaugcaucauauaauaaaauacaggggacauuuucucaaccaagccaauguacaagauuucaaaggcggaaaaauagaccuagaagaaucauucaaagaucuuaauagcaucuuugaaaaccagggccgagaucuaaggcuagucacagaagaugcaaauaaauacguaaaagaauuaucagacaacucuaaaacucgaaacgaucgacaaaaagagcuaucaaaagucuuguacauuccuauagacaaaaacuccgacaaaaauaauaagaaagucacuacagaaauaauaaaagcaauacuuggaaugaaagcaaaauucgauguaaucuucggcauugaugccgagaacgcuaaagaauggagucuaaccuuuaacucagaugauuuugacgacaaaauagaaggcuugucugcgcaaaugacagaugaagccggagaaauucuauuaauccuuaaagaacuauacuucgcauuaaaucuaagcgacaucuuaaacaacucagugacugauaaaaaugcaaaaacccuaucugaagccaugauuaauagauaugaugaccacaaagaacaguuaacaauguuaaaacaagugaucgauaauucagacaagaaacaugcuaaagcacucaaagcugcuuacuccgcauacauugauggagaaaauaauaagaaaauuagcuuugaggaucuccgaaaacgaauccagaaaaauuuagauaauucagaaacaucaaagaaaaucaacgaccuccuagaacacgauuacuuucuuccuaaacaaagauccaaagaaaacggcgccauaccacaccaacuccaacaacaagagcucgauaaaauaaucgaaucacaaaaacauuauuaucccuuucucgcugagcucaauccuaacgagaaaagaucaagacaagcuaaauacaaacuugacgaacucguagcguuucgcguuccauacuaugucggacccaugguaaaagcaacagaaaacaaccaaagcaauaacggaaaauuugcuuggaugauuaaaaaugacaacauaucagauaaauuaaagaaagaagaaauaacuccauggaacuuugacaagaaaguagaccguacggaaacagcaacaaaauucauaacccgaaugacgacaacagacacauaccuuauaggagaaccaguacuucccaaaaacucccugcucuaccaaaaauuuguaguauuaaaugaacuaaauaacuuaaaaauaaacaaacaaccaauaacaccagaacaaaaacaauacguauacgaacacguuaugaaacaaaccaaaagaguaagucugaagaaaauugcagaugcacucguuauuaaaggagacuaucccuacgcaccagaaauaacgggaaccaccgaucagaaaaacaugaauaacggauuaaguacauauauagaccucgcaaaaauuuucggagacgaauuagaugauaucgacagaaaagaagacuucgagaaaauuaucgaauggucuaccauuuuugaagaccaacacauauucgcgcuaaaacucaaagaaaucaaauggcucacugaagaucaaagaaaacaaguugucaaacuaagauaucaaggcuggggaaaacuaaguaagaaauuacuagccgauuuaguggacgauaacggucaacgcauaaucgaccuacuuugggacucaaaacaagauuucaugcaaauuguaaaccaaaauagcuucaaacaagcaauagcagaacacaauggagcacaucuugaagaaaaagaucuaaaagauaucauaaauaaccuauacacauccccucaaaauaagaaagcuauacgacaaguuauacucguaguagacgacauaauccgagcaguagguuacgaaccgguaaauauaaugauggaguucgcacgagaagacaguaaagaccacaggcuaacaaauaguagaucacgccaauuagaaaaagucuauaaagauauaacuaauucaugguucgacgaugauaacguaaaagacgaacuuaaagacaaaaucaaagauaaagccaaauuuacugacagauuauacuuauacuucacacaaggggguaaagaccuauauacaggagaaccccuagacauagacaauuuauccaacuaccaaauagaucauauacuuccacaaucguuuauacuagacaauucgcuagacaaccgagugcuaaccucuaaaauaaauaaucaaauaaagaaagacaaucuaccaggcgaauuuuucgggucaaaaaugcauaacuucuggaaacacuuaaaagaacuucaccuaaucucuaacaagaaauacuacaaucuaacgcuaacacccaacaguauaucuaaauucaauaaucaagguagauuuauuaaccgacaacucguagaaacucgacaaguuauaaaacuagcagcagaaauccuccacaauagauacucagaagaaaauggcacaaacaucgucacaguuaaagcgaaccucacacaccauaugagagaaaaauucaacuuuuacaaaaauagaaacgucaacgauuaccaucaugccuuugacgccuaccucgcagcauuuguagguaauuggcuauuacaacaauacccaaaacucaaacccuacuucguauauggugacuucgcuaaaacagaaauugauaaccuaaaauccuuuaacuuaauauacaaauuugaacaagcacaucaacuuaacgaagaagacgguaaaauugccaaagauacagaugcacuccuaggcuacaugaaaaacgucuaccauuuuaagaaaaugcuuguaacaaaagaacuggaaaccaaucacgguaacuuauucaaacaaacccuauacccgagccaugguaaaaugaaaaaccucaucaacccaaaagaaaaccgcucaucugacauauaugggggcuacucaagcgaaacaggcgccuauguuucacuaauuaaagucuuuaagaaaaacaaaauagaaaacaaaauaauaaaaauaccacuacuauacaucgauaaacugaaccgccaagcaaacgcaaaacaauuuauacgcaauuucauaauaaaagacgacuccaacaaauucgacauauuaagcgagaaaauauuuuuaaaucagcuaguaauagacggagaugaacucuucacuauauccggaucaggagaucgacaaaaugcacaacaacuaauacuaucagacaaaucucuuaaaauucuauccaaaaacauaaacguaauauccaaaaaugaucuuauaauaauauucaacgaaauuaucgaugauauauguaaauacaugaaaauguacgaaguagaaaacucagacgaaacuaaagcaaaauucgaagaaaucaacgauaaagaccgaauguuaaaaauaaucaaugaccucuuauuaggccuucaugccaaugccucaagaucaaaccuuucguccauaggauugucuccaucauucggcagauuuuucucaggaaacgcaggaauaaaauuauccgaaaacgccaaauuuauuuaccaaagcccaacaggauuauuuucucgaaaagugaaaauaucagaccuuuga

SEQ ID NO: 5313 - RNA, 4032 nt, Artificial Sequence
  Cas9 variant
augacauauuauuuaggauuagacaugggaacaucgucaguagguugggcagugacugacgaaaauuacaauuuaauacacaggcaucggaaggaucuauggggaauaagggaguucgaagaagcuaagacagcaguagaacgacguacacaaagaauaucaagaagacgaagacagagagaaguagcgcgaauaggacuauuaaaagauuacuuucaugacgagauacaaaaaguagauccaaauuuuuaccaacgacuagacaauaguaaauacuucccggaagauaaagaagagguagucaaaggcaaaaauggaauauucgcagaugaaaacuacacugacagagacuauuucgcagaauauccaacgauauuccauuuaaggagggaauuguugaauagcaaagagccgcaugauguaagauuauuauaccucgccuuacucaauauguauaaacacagagggcacuuuuuaaauaccacacuagguaccgacggagaaaacagaaaacuuucagauguauacagagauuuuguggucaaaacugaggaaguucucggacuuacauucccacaggaaacugauaacggaaaaaugcaagagauaauguguucgagagaguucucgagaaagagaaaagcagaauuacuaugcgcgcuacuagaaauagauaaaaagcaaaaacaacaaguagcauuaauugaaugcguauuaggauuagauaagucaguuaaacaaauguacgguacagcagucccugaugauuuugacaaaagcguaaaagucaauuuuuccgacaguucauucgaagaaaaagucagugaaguugaagaacugcucgaugaggagaaauaugaauuaauuuuguguaugaaagaacuguacgauacagcagucuuaaaucaaauaaugggagauuguaauuaucucagcgaagccaggguacaagaauaugagaaacauaaagaggaccugaaauugcugaagaggacaguaaagaaauauggaacugcagaagaauaccaauuucuuuucagaagcucagagaaggcuuccuacaacgcauauguccauucuguaaauucaggcgaaaagauuagacgaaacauggauggaagauccagagacgaucucuauacaguacucaagaaaaugcucaaaaauuauccacaggaagaugccgacuguaaauauauucuagaagaaauagaaaaagaacaauuuuuaccaaaacaauuagucuccgauaacggcguuauuccgaaccaaauacacuauaaagaaaugaagaaaaucuuagaaaacgccgaacaauacuuacauuucuuacgagaaaaagacgaaaguggcuacacugucgccgaacgaauauuaaaauuauuugcuuuucaaauuccauacuacauaggacccaccagcgaaaaaucagggaaaaacgguggaaacgguuggguaguaagaaaagaacaaggucaaguuuuaccauggaauaucgaagagaaaauugauaugaaagcaacuucagaaaccuucauaucaagaaugguaaggcguuguacauaucucagugacgagauggucuuaccaaaagccucauuggaauacgaaucauucuguguguugaaugagcuaaauaaccuaagaauaagaggaguaaaacuaccaauaacaguaaaacaagacauauauaaagauuuauuugagagagggaaaagaguaaccagaaaacaaauaguaaacuaucuuaaagguguaggaauuuuacaagaaggugaagaagacgaacuuaccgguaugauggacaccuuuaacucaucacuagcuucauacgguaaauucaaaucaauacuaggcgagaaaauacaagaagacaguugcaaaagaaugguugaacaaaucauauuuugguguacaauauauggcgacgcaaagaaauuccuaaaagaacaacuugaagaaaaauauggagauguccuaaccagagaacaaauaaaaagaauuuuaggauuuaaacuaaaagacuggggaaaccuuucuaagaaauuucuagaacuaaauggaugcgaccgaaauacaggugaaguaaugucacuaauacgaaugcuaugggaaagcgacgacaacuuaauggagcuuuuaaaagacucaagcuauacauaucgagccgaauuagaagaacaacaagaaaaacuuaccaaaacucucacagaaauauguccagaagaccuagaagguuauuauuuuucagcacccgucaaacggaugauauggcaaacacuauugauucugaaagaagucgaaaaaguuaugggagagcccccgaaaagaguauuuguugaaaugacgcgggaacaugaugaacgcagggaaaugaaagauucgagagggaagaaauuccaagaauuguacaaaaacauaaaagaugaagaacacaacuggaaagcggaaauagaagaugccgagaaagacggaaggaucagaagcaagaaaauguauuuauaucuaacucagagagggcgaugcauguacacaggaaauccuauagaucuagaagaauuauucacaaccaaauacgacauagaccauauuuacccacgacacuucguuaaagacgacaauuuagacaauaauuuaguacuuguggagaaagagaaaaaugcacacaaaucagaccaauauccucuaggcgaugacauauacacgggucgauugagcugguggaaagaauuacacagagaaaaauuaaucaacgacgaaaaauauaaacgccuuacagggagagcaccauuuucagaugaacaaaaagcaggauuuauugcaagacagcuaguagaaacaucacaaggaaccaaaggagucgcaucaauacuuaaagaaguauuaccagaaacgacaacaauagucuacgcuaaagcaagaaacguaucugauuucagaaacaccaacgaauuacuaaaagcgcgaucaguaaaugauuuccaucacgcacaagacgcauauuuaaacauagugguagguaacgucuauuauguaaaauuuacaaauaacccucucaauuuuguaagaagcggugaaggauacaaucuagaugguguauuucgcaaaaaugucauaagaggccaagaaaaugcauggauaguaaaaccagagaaaggagagaaaaugacacuggaaacugucaaaagagugauggcuaaaaauacgcccuuauuaacuaggcuaucguuugaaggacguggaggauuagcaaaccaaacacucuacucagcaaaagaagcagcaggcgaagguuacguaccauuaaaaaguagugauucaagacuacaagacguaacuaaauacggaggauuuacuucggugacuaccgcauacuuuauucuaguagagcaugauaugaaaaagaaacgcgucagaacuauagaaagcguucccauacuuuggaaagagcggauagaaaaagaaucuggccaacuagaaauuuauugccgagaggcauuaggccuaguaaacccagacauaaggguucgaaaaauacugauucaaucauuaguaaagaaagauggauuuuacaugcaccuaagcggaaaaacagguaaccgauucauaaugagaaacgcgguagaauuauguuugaaacaagaauggauaaacuauaguaaaaagcuagaaaaagaaggaugugaugagucaaucacaaaagagaaaaacgaagaauuauaugaaauuuugaaggagaaacauauuaacggaauauacagaaaaaggccaaacccaaugggagagaaacugcacauaagacaagaaacguuuagaauguuaacuuuagaggaacaaaagaaaguacuacucaguuuacucaaucuaacaaaaauaggaccugucgaagccaaccuggaauugauaggggaaucagcacacaccggcaaaaugcuaauaagcaaaaacauaacagaaguaaaggaauuuuacuuaauucaucaaaguguuacaggcauauaugaaaagcaaguaaaccuacuaacgguauga

SEQ ID NO: 5314 - RNA, 4032 nt, Artificial Sequence
  Cas9 variant
auggcuaccaaaaaggaauacaacauaggucucgauaucggaacuacuucuguuggcuggaguguaguagaaacagacaaucaaaaaguaaugagaaaaggaaauaaggcauuauggggaguaagacuauuugaggaagccacaacugcagagucaagaagaaugcaacgaagcacaaggcggagguaugauagacgaagagaacgcauuaaacuacuucaagaggaauuuucggaagaaauaaacaaagucgacaagaacuucuuucaaaaacucaaggagaguaaguauguagaaaaugauaaaauaaauaaaaaaaucguacuaacaaaagaagaaaaacaggaauuaaaggacuaucaaaauaaauauaaaacaaucuaucaccuaagagaugaacucauaaacaauccugaaaaaaaagacauuaggcucguauaccuagcaauacaucauauaaucaaauauagaggaaacuuucucuaucaaaaugccaacuuuaauauagacaaccuagacauaaaggacaagcuaaaugaacuauuuuccauccuaagcaacaacauacaagaauuagaaauaccagaagacuacauaaacauuauugacuucgacgaacuagaagcugacuuacuaaaggacaccaagaacgaugucaaggcucuacucauagauaaucuaaccgaauuaacuaauaaaagcagcgcgacagaauucgguaaauuaaugguaggaaauaaaggaaauauaaacaaauuauuaaugcuagaaacagacaacaaaaucgagauaucauuuucaggcacagacuacgaugacaaauacgaagaauaccaagaagcacuaggagaaaauauagaaaucuuagauauauugaaacaaauauaugacuguauuuuccucaagaaaauauucaaaggaaacaaaaacacuagcauaaguucacuaaugguaaaaucauuugaacagcacaagaaagauuuaaacuuccuuaaagaacuauuuaaagacaacagggaacuguacaacgaaauauucagaacaaaaaaggaucuauguuuauacgaaaaauauaucacgaauaaaauagauugcgaugaauucagaaaggaaauaaacaaauugcuagaaucacuguucagugacgaaaacauaaaacaaaaucuccucgaugaauacaaccuugaagucaaagaacgaauagaaaacgguacuuucuuaccuagaauaacuacaaccgauaauggcaaauaccccuaccaacucaacaaaucagagcuaauaaaaauaauagaaaaccaaggcaaauacuauccauuccuacuaaauaaacuaaaugacaacaagacuuauaaaauaguaaaauuacuggaauucagaauacccuacuacgugggaccacuaguuucagaaaaaagaucagaaaauagcuggcuagaaagaaaaaucaauaacguaaaaauaaccccauauaauuucgaugacguaguagacaaagaaaaaacagcagaaaaguuuauuaagagaaugauaagucacuguacguaccuucuagacgaauacgcauuggcaaacaacagcauauuauacagcgaauucaaaguaaugaacgaauugaaacaaauaagaguaaacgacagaaaauuagaacuaaaauuccaacaacaaauacuagaagacuucuuuaaaaagacauccgguacaauaacugaacggaaauucaaaaacuauuuaaucagcacaggggaauacucaauggaagguggcaacuucagaauaacaggcuacucagcugacggaaaauucgcaaauaacaugcaaucauauguagauuuuuucggugaaaacggaauauucgcggauacagacuauaaccuagaaaaugcagaagaaauuauagaguggauaacaauauucgaagacaaagacauacuugaaaaaaaagucagagacaacuacucaaaacuaaacgaaaaucaaauuaaaaaagugcuagcaaagaaauacucaggauggggaucacucucaaaaaaauuauugaaaacuaaauacuauaaagauaaagcaacagaacuauauaaaaguauuuuagaucucauguacgagaccgacaaaaauuucaugcaaauaauaaacgacgacaaauauaacuuccaagaaaugaucaaaaaauuuaacaacaaggaggaaaauaaaaaacuaaacuacuccauugucgaagaacucgcaacaaguccagcuacgaaaagagguauuuaccaagcauuaaaaguaguagaagaauugguagacuacauaggauacgaaccaaaaaauauaucaauagaaauggcaagaucagaagaagaaaaaguuagaaaagauagcagaaaagacuauauaaauaaucuauacaaagguugcaaagauucuauagaaaacuauaaaaagcuuaagcaugagcuagacagucaugagaucacaucacagcgauuauuucuauacuucauccaggaaggaaaaugcuuauauacagggacaccacugaacauugaggacaucgaaaaccaaucauuauacgaaauagaccacauaauaccaagaucucuuauaaaagaugacucuauagacaacaaagcuuuaguacuuaaagaauguaaucaagauaaaaaggcaucauauguauugccaucaaaauuuaggaacagcaaacaaaaaaccugguggaaacauuugaaggacaacggauuaaugucggcaaaaaaauuucauaaucugauaagagaaaaauacaacgaggaagacauaaacggguuuaucaacagacaauuaguagaaacaagacaaauaacuaagcauguagcgaauauacucaauaaucuauacaaagauacuaacguaauauaucugaaagcagauuuaucgcacaacuacagagaaaaauacgacuuauucaaauucagagauauaaaugacuaccaccacgcacacgacgccuaucuggcggccguacuuggagaauacaaagaacgcuucaugaagagaaaaauaaacuucgacaugguaaaggaauugaacaguaaaauaguagaaauggaugaaggaaaaaggagaaaccuucguuucggcuacgucaucaauagucuagaugaaaacuuaaacgauauaguccuuaaaaucucagaaaaccucguagauaaugaaaccggagaaguccucuuugaugcacacgaauuuaacaaacgaguugaagacacccuauacagaaaugacauacuaauaucacgaaaaacagaaauucguacaggccaguuuuauaaagaaacaauauauaaaaaagguaaggggacaauaccaauaaaauucggaaugccuacagacauauauggcggcuacucaaauacuaaugcaaggaaacucaugcuaauagaauauaaugagucuaaaaugaaaauuauaggacuaccgauggcacuugcgguuagaaacaacgaugcagaaauaaacgacuacaucaagacacaaaucaaccuuaagaaaaacaguaccuuuaagauuaaaaaauguagcaucccuuucgaaacagaaauaauuuacaacaaucaaaauguauucauaaaagguuacagcauuggucacaaaaauugcgaaaucucaaaugcaauacaacuuaaaauagccaaagauaaaaugaaacauuggaaauaugcacuacaauaccuauuaaacgacaaaaaacaauacaucgacuucgcagagaaauauguaaaugaaauauacgacuuccuaauaaaccuagaucuauucccgcuauucaauaaagaauuagacaaaauuaaaaacaaagugaacuuugaagaucuagcacucgaccaacaaaaaaaaauuacuaaagaacuauuuaaaaugcuacauugcaacucaguaaacgcgaaccucucagaauucggccuuggagacagaaugggacgacucucaggauacaacauuacagauggaaucauuaucucaaaaucaguaacaggaauaagggaauccagauacgaguucuga

SEQ ID NO: 5315 - RNA, 4035 nt, Artificial Sequence
  Cas9 variant
augagccaaaacaacaauaaaauuuacaauauaggacucgauauaggagacgccagugugggaugggcaguaguugaugaacacuacaaccucuuaaaacgucauggaaaacacauguggggcagccggcuauuuacacaggccaacacugcuguggaacgaagaucaucaagaagcacucgacgaagauauaauaaacgaagagaaagaauccgacuguuacgagaaauaauggaagauaugguuuuagaugucgacccaacuuucuucauaagauuagcaaacguaucauuuuuagaucaagaagacaagaaagauuaucuuaaagaaaauuaccacaguaauuauaaucuauuuauugacaaagauuucaacgacaaaacuuauuacgauaaauauccaacaauauaccacuuaagaaaacauuuaugcgaaaguaaagaaaaagaagacccaagacuaaucuaucuagcccuacaccauauaguaaaauaucggggaaauuuucuuuacgaaggucaaaaauucucaauggacguaucuaacauagaagauaaaaugauagacguacuccgacaauucaacgaaauuaaccuauuugaauacgucgaagauagaaagaaaauagacgaaguauuaaacguuuuaaaagaaccacuaaguaagaaacacaaagcagaaaaagcauucgcucuauucgacacgacgaaagauaauaaagcugcauauaaagaacugugcgcagcacuagcaggcaacaaauucaacguaacgaaaaugcuaaaagaagcagaacuccacgaugaagaugaaaaagauaucagcuuuaaauucagcgacgcaacguucgacgaugcauuuguagaaaaacaaccacuuuuaggcgauugcguagaauuuauagaucuauuacaugacauauacaguugggucgaacugcaaaacauacuaggaagcgcacacacaagcgaaccaagcauaagcgcugcaaugauccagcgauacgaagaccacaaaaacgauuuaaaacugcuaaaagacguaauacgaaaauaccucccaaagaaauacuucgaaguguuuagagaugaaaaauccaagaaaaauaauuacugcaacuacaucaaccauccgucuaaaacaccaguugacgaguucuauaaauauaucaagaaacuaauagagaaaauagaugaccccgacguuaaaacaauauugaauaaaaucgaacuggaaaguuuuaugcuuaaacaaaauucgcgaacaaacggagcugucccauaucaaaugcagcuagaugaauugaacaaaauacuagaaaaucaaagcguauauuauucagaucuaaaagauaacgaagacaaaauaagaucaauauuaacguucagaauaccauauuauuucgguccauuaaauauaacaaaagaccgacaauucgauuggauuaucaagaaagaagguaaagaaaaugaaagaauacuaccauggaaugcaaaugaaauaguagacgucgacaaaacugcugaugaguucauuaaaagaaugagaaacuucuguacauacuuccccgacgaaccaguaauggcuaaaaauaguuuaacaguaagcaaauaugaaguacuuaacgaaauuaacaaacucaggaucaacgaucaucucauaaaacgugacaugaaagacaaaaugcuucauacucuuuuuauggaucauaaaaguauaucagcaaaugcaaugaagaaauggcuagucaaaaaccaauauuuuucuaacacagaugacauuaaaauugaaggauuucaaaaagaaaaugcaugcucaacaagucuaaccccauggauagauuucacuaaaaucuuuggaaaaauaaacgaaaguaauuaugacuuuauagagaaaauuaucuacgacguuacgguauucgaagacaagaaaauacuacgaagaagacucaagaaagaauacgauuuggacgaagagaaaaucaagaaaauucuaaaauugaaauacagcggguggagccgacuuagcaagaaacuacugagcggaaucaaaacaaaauacaaagauaguacuagaacucccgaaacaguauuagaaguaauggaaagaacaaauaugaaccucaugcaaguaaucaacgacgaaaaacuuggauucaagaaaacaaucgaugacgccaacucaacaucaguaucagguaaauucucauaugcagaaguacaagaauuagcaggcucuccagcaauuaaaagaggaaucuggcaagcacuacuaauaguugacgaaauaaagaaaauaaugaaacacgaacccgcacacguauauauagaauuugcaagaaaugaagaugaaaaagaaagaaaagauaguuucgucaaccaaaugcugaaacuauacaaagacuacgauuucgaagaugaaacugaaaaagaagcgaauaaacauuuaaaaggcgaagaugcuaaauccaaaauuagaagcgaaaggcuuaaacuauacuacacacaaaugggaaaaugcauguacacaggaaaaaguuuagacaucgaucgacuggacacauaccaaguagaucacauaguaccccaaucccuauuaaaagacgauucaauagacaauaaagugcuaguacuaucuagugaaaaucaaagaaaacuagaugacuuaguaauuccaagcagcauaagaaacaaaauguauggcuucugggaaaaacuauuuaauaacaaaaucaucucgcccaagaaauuuuauucacuaauaaaaaccgaguucaacgaaaaagaucaagaaagauucauaaauagacagauuguagaaacaagacaaauaacaaagcauguagcacaaauaauagauaaccacuaugaaaacacaaaagucguaacaguacgggcagacuuaagucaucaguucagagaacgcuaucauauauacaaaaaccgcgacauaaacgacuuccaccacgcccacgaugcauauauagcaacaauacucggaacauauauaggacaccgcuuugaaucguuagacgccaaguacauuuauggagaauauaaaagaauuuuuaggaaccagaaaaauaagggcaaagagaugaagaaaaacaaugacggauuuauacuaaacucaaugagaaacaucuaugccgacaaagacacgggugaaaucgucugggauccuaauuauauugacagaauaaagaaauguuucuacuacaaagauugcuucguaaccaagaaacuagaagagaauaaugguacauucuuuaaugugacaguccugccaaaugauacuaacucagacaaagauaauacauuagcaacagucccaguuaacaaauaccgcucaaacguaaauaaauacggcggauuuucaggugucaacucauucaucgucgcaaucaaaggcaaaaagaagaaaggcaagaaagucaucgaaguaaauaaauuaacaggcauuccauuaauguacaaaaacgcugaugaagaaauaaaaaucaacuaucuaaaacaagcagaagacuuagaagaaguacaaaucggaaaagagauccuaaagaaucaauuaauagaaaaagacggaggcuuauauuacauaguagcgccaacagaaauuauaaaugcgaaacaacuaauauuaaaugaaucccaaacaaaauuaguaugugaaaucuacaaagcaaugaaauauaaaaacuacgauaauuuagauucagagaaaauuauagauuuauauagauuacuaauaaacaaaauggagcuauacuacccagaauaucgaaaacaacucgucaaaaaguuugaggauagauaugaacaacuaaaaguaauaucaauagaagaaaaaugcaauauaaucaagcaaauacuugcaacacuacacuguaacagcucaaucgggaaaauaauguacucagauuucaagauuaguaccacaauaggaagauuaaaugguaggaccauuaguuuagacgacauaaguuuuauagcagaaagcccaaccgggauguacagcaagaaauauaaacuauga

SEQ ID NO: 5316 - RNA, 4035 nt, Artificial Sequence
  Cas9 variant
augaagaaaacaaacccauacauacuaucacuugacauuggaacagcuuccauaggguacgcaugcauggaccuagacuucaauauauuaaaauaccacgacaaagacgcaaucggcguucuaacauucgaaggagcugauacagcagcagaaagaagagguuuuagaacgaguagacgaaggaaaaacagacgaauaaaaaggcuaggacuauugcaagaaguucuugcuccauuagucaaaaacccaaacuacuaucaacuacuaaaccuucauaaauggaaaaacuccaacgaagacuucaaacacagaucacugagugaaguucucaaaauacuggguaaaaacccaaaaacguauccgacaauauaucaccuacaacaagacauacaaaaucacccagagaagaaauucgaaccggaacuaauauuuuuagcauuguaccauuuagugaaauacagagggcacuucuuauucaacaaucuauccuucgauaaaggaaaaacaguagacaaugaagcccaacuuucugaacuccuagagcaauaccaaucuauaaauccguacgaagauucaauaucaaauaaagauauuaacgugaucguggacacccuuaaagacgaccaacuaacacgaaacgacaaaaguaaagaacuuaaaaggaauguuaguaaaacccaugcagaacuguuuaaaaugcucguagggcuaaaauucaaacaaagcauacuauucgaaaacauggaaaaugcugaagauauaaaagaaucagcaacaggguccgaugccauaucacuaagcgacgacuacuaugaaaaucuaucagaguucuuaacagacgaacaacuuaauuucauagaauccgcaaauacauucuuuaugggaauaaugcuagaucguauccuuaaaggagcaaccagcauauccgcagcuaaaguacgagacuacaaaauauuuaaaaaccaacuaaaaauuaucaaagacauaguauaccaaaacaaauacgacaaauaucacgaauuuuucguuacauccaaagaagacaugagagcauaucaagaaaauccggacgcaaaaaccuuuggaaaauuaaguaaauuugaccaauaucuuauacacccuaaagaucaauacgcaaaacuaaugaaagaucuaaaaggaaucgugcccaagaaauauacggaagugcuaaauuuaaucgacgagcagaaauuucuuguaguacaaaauacaacagauaaugcaagcauacccuaucaaaauaacguauucgaagccgaaaauaucuugaggaaucaacaaaaauacuauccagagauaacugaagaaaugaucgggaaaguaaucaaucuaaucaguuuccgaauaccuuacuauguaggaccccugacaaacaaaaacggacaaagugacuucgcauggaugauaagaaaaagugacgaacaaacacuaccauggaacuucgauaaaguaaucgacaaaucaaaaucugcagaaaaauucauaagacgaaugaccucaaaaugcacauauuuauuagaagaagacguucuaccgaaacacagccuccucuaucaagaaauggaaguacuaaacgaauuaaauaauguacaauuacggggcgagaacgagcccaaacaucgaauacaccgucuagaucccaaaguaaaacaauuuauauaucacaaucuauuucagaaaaagaaaaauguuacacacaaagaccucaucacguuauuacaaaauucagaacacagaaacacucuuaacaaaacuucgggacaaaaauuaaaagucuucggaacacaaaaugauucaaaauuugccucaaaauugaguacuuacaaugauaugaaagccauauucgguucaguugaaaacaaaagacaaaugauagaagaacuuguacuauggauaaccauuuucgaggacaaagcaauucuaaaacagaaaauaggagaaaaauacccaaauauaacagaaaaacaacuaaaucaaauaguaaaacuaaauuacagcggauggggucgcuuaagcgaaaaacuauuaaccaaagaaguaaauggacgaucguuaaucgaccuaauguacuccacagaaaacaacuucauggaaauaaucaccgauaaaacuuuaggauucgauugcuucaucaaaaacagcaauaaagucaaaaacgcgaaaauuucuuacaaagacguagcagaauugagaacaucgccagcucucaagaaaggaaucuggaaugccauaaaaaugguacgcgaaauaagcgauuuauucggagcaccagagaaaauaauaauugaauuugccacagaagaccaaguaaaaggaaaaagacaaaaaucccgaucugaacucugggacgaccuugucaagaaaaauaacuuaaaacgaaacaagaaauucaaaggcuuauuugaagaacuuaaagccuacccagaccuagauuuuucuaauccaaaauuauggcuauacauacaccaaaaugguaagugcauguauaccaagaaaccuauagauuuagaacgguuaaugucagauacaaacaaucagcuauaugaaauagaccauauccuaccacggacuuuuguaaaagacgauucaauaaauaauaaaguacucguaauccaaagcgcaaaccagaagaaaucaggagacaaaaugccucucgaaauauucgauaaccacgugcuaguacccuuuuggaaaauguuauaugaaaacgaucuaauaucauccuccaaacugucuaaacuuaugaagaaagaguucaaugaccuagacaaagaaggauuuauucaaagacagcuaguggagacacgacaaauaauuucacacguaagugacuucuuaacagaagaguacccaaguacaacgguuguacccaugaaggcuaacguaguuucugaauuaagaaggaaauuugacaucccaaaaaucagacaacuaaacgauuggcaucaugcgguugaugccuaccugaacggauucguauaccaagcagcaagagucuucuacccaaagguaaaccuauuugaguucaauuucaaaugggagaaagucagagaaaaauggcgccaacuaggagaguucaccgaaaauaacaagaaaagagaguucuuccuauucaaaagaauggaaaauuauguaaacgaacacggagaagggaugauuuccaaauuaauuuucgaccuugauaauuucaaguucaacuacucaagaaaaguggaaagcacugaaucggcuuucuacaaacaaucggcauuuagccccaaaaacacaacagcacaauacgauucggacaaaaauaaaacagcaauauauaaagaaaugaaaaacaaaagaggaaucguaguauccuacacauacguaaagaaagaccaagaacuaauaggauacggaguuuuuaacgaaacuguauucgaauaugucaacaacgcagacguagacaugaauacaagagcauuaaagauaguacgaaaggcuuuuccaaaauuagacauaaagaaagcacaauacuuauuuucgauuaacaaaggagacgcauuacucguaaacggacauccauuucuguuuguaucagcaaaagaacgaauuaacggaaagcaacuagaguuugacauaaauaugcaaagaaggcucaagaaagccuugcgaccauauaacaaaaugaccgaacaagaaaaaguaggaguuuauaaucaauuugcagaaaaaguuguccaagaauaugaaaacagccuuggugcaaaaacaagaaacgaaaaauuagaauuaauacgaaaucaauucaacgagagugacaaaucuaaugaagcacucauccaguguauucuugaaguccucaagaugaccaaagucucugcagaacgaucaguuaaacuaaaaauaagaugggggucacaaacaccuaauacacuaauagacauaaacaauaaagcaaaaauaauguauaauagcauaaccggccucaagcaaacacgacuaaaaucaauauauaagcuagccgaaagcaaaaacgaacuuuga

SEQ ID NO: 5317 - RNA, 4035 nt, Artificial Sequence
  Cas9 variant
augaauaaaaauuacuacauuggacuagacauggguacaaauucaguugguugggcuguaacagaucaagaauacaaccuaauuaaauuaaaaggaacucaugcauggggagcuagaauauuucaagaagcaaaagacaaaaaagguaccagagcaauccgaucuagccguaggagaauggacaggagaaaauaccgcauacacuuacuuaaucaacuauucgcacaagagauacaagccaucgacaguaccuucuucauaagacucgcauauuccgcauauugggaagucgacaaaaaagacaaaggaaucggacgaaauauacuguuuaaaacaaaacaagaagaaucucaauucuacaagaaauacccuacaauauggcaccuacgaaaaagccuucuugaaaaccagccagaugcuuucucugaucuuagauacgucuaucucgccuuccaccacaucaugaaauacaggggcaacuuucuccaugaaggggagauuaaaacaaaugaacuacagguacagcaaaucgaacaacucaaucaauuuuuaauaaacaaauauaaagagauauacgacaaugauguagaagaaagaacuuucauagcaaaccaccagauagaugcacuaaaagaaauacuauuaaacaaaaacacaaauaaaacuacaaaagagaaagaaauuaaaaaacuauucgacuacgcagauugugaaagcuuagaaccauauaucucguguuucagcaaacucgccguuggaggaaaauuugaucuuuccaaacugggauaugaaggcaauauucaauucucagacccgucauuugaagagaaagccucaauccuucaagacgauuuccgucuaauugcuauagcaaaagaaauguacgauuuugucauacuaaacgauuuauugaaggaucaacccaaucuaucaacugccaugguacacguguacgagacucaccgacaagaccucaaaaaauuaaaagacauaauaauugauauugacgcuaacaaaggucuccaaaacaaugaucguugguauuuuaaacuauucaaagauaaaaacgcaccuaaaaacuauuccgcauucauucacaaaaacaguaaucaaaaacgaccaagcauagaugaauucaacgacgaaaucaaaaaaauacucaucgaacacagaaacgacguaucacuugaaaaacaagaugacuuaaaaauguuauuugaaaaaguagaaaauaagacucucuuaaaaacaauagccauacaaaguacaucaguuauaccccaccaacuacaccucgaugaacuugaaaaaaucauagauaacgcaucuaccaaauacccauuucuaucaaacauaagagacaaacucguauuguuauuuacauucaggguaccauauuauuaugguccacuaaaugauaaaagccccuauucaaauguagagagaaaacaguucgccacaguuacgccauggaacuucgacgagauauuugaugaaaacaaaacacgagaaaaauucaugaaaaaacucacuaacaacugcaccuacuuaagcggcgaaacugucaugccaaaaaaggcccuagccuacgaagauuaccuaauauacgauagacuaaauguccuacuaguaaacggagaauaccuaucucuacaagaaaaagaaaaaauauaccacuaccucauaucaagacccaaaaccacacucgaccaauugaaaaaagaacuagcuaaauggcacaaccaaucaccaauugacaucaucuucagcaacauacacgaagaaauuccauucgaagcaucaucgcacgcacaccucaugaaaucauuugaucucgaaaagcaaaaagaagaauuagaaagguacauaacucuagccacuauauacgcagaugacaaaaagucccucaaagaacuacucaaaaacgaaucuuuacucgacgagaaccaaaagaauguaaucuuaacccucccaacuaaaaagugggcaccacuaaguuauaaacuacuccagaauaucguauacacagacgacuaugguguaguucacucaauccucgacauaaugaaagaaacaaaccaaaauuuccaaaugguacuccauaacgagcaauaccacuuuaaagaacuaauugaacaggaaaaccagaaauucacacaagaaaaaacgaucgaagaccuaauagaagaaaaauuagaaucaauaccuucucuaacccaacgcaguaucagacaaacacuacucaucauagacgauauaaucaaagccagccaccaaaaaguaccagagaaaauauuuauagaagucaccagaaacaacgaugauaaacgaaaaggucaagacgguaaucaauuagcacgcgauaaagaauugaaccguuuuuuaacaaacuuacucaaagacgaaaaagcaaaccaauucugcgacgucucacaacuauuaaaggacuuagaagaagucgauaaaguaaaauuaaaaggaaagcacauauaucucuacuuuaaacaauuaggcauagauuuguauaccggaaaaaaaauaguccuaaaccaacuccuaaccucuacaaaauacgacacagaccacauaauaccccagucuuuaauaaaagacgauucucuagacaaccuaguuuuaguagaaagagagguuaaccuaaaaguaaaaggaaaucacuaucccguuccaucacgaauccaggaugaacaaaaaaaacucuggcacuuccuucuccaaaaaaaggcgauaagcgagaaaaaauacggaaaucucacuagaacaucaaaaauuaagcucgaagaagucgaagacuucgucgcuagacaaauuaacgucaucaauuauuccaacguuauaauaagagacauacucaaacuaaaauacccacacaccgacauaauauucucaaagucccaauacccaucauucauaagaaagcaccuuaaaaucgucaaaaauagagacguaaacgacgcacaccaugcagucgacgccuaucuaaacguaguaucaggaaaucuauuaucaacaacuuuuucaaaagcuuauaucagaaaaaaauauauccaaauacaggauggcgaaaaagaaacauucaacauggagacaauucucgaaaauuacuuuaaaaacaaugaaaaccaacuaaagauaaaaacaaauugccuuagacgagacgcuuuaauaaccuuuaagguagacuacuucagcggugaguuuuacggacaaacaagacuaccaaaaggaaaugaaaaucugauacccauaacacuaaacgaagauaaccccaugucagacacuucaaaauauggugguuauaccaacuuagcgcaagcuuaccuauuugcaguuucguaucaagaagacggagaaaugaaaaaagcaauacuaagaguaccauaucuauaugacacacuauacaaaaaugauucggauaaacuacuuucaaaaguucuugacaaucccaaagcaacaaacauucaaauccucagaaagauacaccuaaaccaaaaaauccguuuuaacgaugguauauauuuauuauauacaaaugaaaaagacagaaacaaauauaaaauggcguaucaaaacuauauagacaacgauuacuuauacuaccuccacugggcaaacaaacauuuagaagaacuuuuagauaaucaggagaaacaaaccuuuauauauaacuccaaaaacgaucaauuugaaguaucaaaagcaaaaaacaaagaaaucuuucaauaccuucuccaaaaaacaaaggcuaaagucuaugacacaugcaacuauauaguaaaagcacgagaaacuaacauagaaaucuucgagcaauuaacauuaaaagaacaaauaacgaugaucaaccaauggauuaagaugaugucuagagacugcgaaaagguuaaauucgaugcaagguuuacuaauuuuucaaacugccuucuacgccucucaaauaacauaaacccaaaagacagcauaaccauuauuuaugaaucaccuaccggauuauucaagcacgaaguaaaaauauga

SEQ ID NO: 5318 - RNA, 4035 nt, Artificial Sequence
  Cas9 variant
augaagaaaaccaauccauauauauuaucauuagacauaggaacagccaguauuggcuacgcauguauggaccuagacuucaacauauuaaaauaucacgacaaagaugcaauagguguacuaacauucgaaggagcagacacagcagcagaaagaagagguuucagaacgagcagacgaaggaaaaaucgaagaauaaaacgccucggcuuauuacaagaaguacuugccccacuggucaaaaauccaaacuacuaucaacuacuaaaccuacacaaauggaaaaacuccaacgaagacuuuaaacaccgcucacucucggaaguacucaaaaccuugggcaaaaacccaaaaacauacccaaccauauaucaucugcaacaagauauacaaaaucacccggagaagaaauucgaaccagaauugauauuccuagcgcuuuaucaccuaguaaaauauagaggccacuuuuuauuuaauaaucuuucauucgacaaaggaaaaaccguagacaaugaagcucaacuuuccgaauuacuugaacaauaccaaucaauaaacccauacgaaggaucaauauuuaacaaagacaucaaaguuauaguagauacauuaaaagacgaucaacucacgagaaaugauaaaagcaaagaacugaaacgaaauguuaguaaaacucaugcugaacuauucaaaauguuagucggucuuaaguucaaacaaucaauacuauucgaaaauauggaaaacguagaagacauuaaagaaagugccaccggaagcgacgcaauaagucucucagacgacuauuaugaaaacuuaucagaauuucucacagacgaacaauuaaauuuuauagaaucagccaacaccuucuuuaugggaauaauguuagaccgcauccuaaaaggcgcuaccagcauaucagcagcuaaaguacgggauuacaaaauuuucaaaaaccaauuaaaacucaucaaagacauaguauaucaaaauaaauacgacaaauaucacgaguucuuuguaacaagcaaagaagauaugcgagccuaccaagaaaauccagacgcaaaaacauuuggaaaacuaucaaaauucgaccaauaucucauucacccaaaagaucaauaugcaaaacucaugaaagacuuaaaaggaaucguucccaagaaauauaccgaaguucuuaaucuaauugacgagcaaaaauuccuuguaguacaaaauacaacagacaaugcaucaauacccuaucaaaacaauguauucgaagcagaaaauauucugagaaaucaacaaaaauauuacccugaaauuacagaagaaaugaucggaaaaguaauaaaccuuauuuccuuccgcauuccuuauuacguagggccccucacuaauaaaaauggccaaucagauuuugcauggaugauacgcaaaucggaugaacaagcacuacccuggaauuuugacaaaguaauagauaaaagcaaaucagcugaaaaauucaucagacgaaugacaagcaaaugcacauaccuuuuagaagaagacgucuuaccaaaacacucauuacuuuaccaagaaauggaaguacuaaacgaacuaaauaacguucaauuacguggggaaaacgaaccaaaacacaggauucaccgccucgacccaaaaguaaaacaauuuaucuaccacaaucuauuccagaaaaagaaaaacguaacacacaaagaccuuauuacacuacugcaaaacucagagcauagaaauacacuaaacaaaacguccggacagaaacugaaagucuuuggaacccaaaacgauucaaaauucgcaucaaaacuauccacauauaaugauaugaaagcaauuuucggaucaguugaaaauaaaagacaaaugauagaagaacucguucuauggguaaccaucuuugaagacaaagcaauacucaaacagaaaauaggcgaaaaauauccuaacauaaccgaaaaacaacucaaccaaaucgugaaauuaaacuacucaggauggggaagauuaucugaaaaauuacuaacgaaagaaguaaauggccgcuccuuaauagaccuaauguauuccaccgaaaauaacuucauggaaauaauaacagauaaaaccuuaggauucgacuguuuuaucaaaaacucaaauaaagucaaaaacgcgaaaauaucuuauaaagauguugcagaacuccgaaccaguccggcauuaaagaaaggaauauggaaugcaauuaaaaugguccgcgaaauaagcaauuuauucggagccccagagaaaauaauaauagaauuugcaacugaagaccaaguaaaaggaaaaagacagaaaucacguagugaacuuugggaugaccucgucaagaaaaauaaucucaaacggaacaaagaguucaaaggauuauuugaagaaaucaaggcuuauccagaucuggauuuuuccaacccgaaauuauggcucuacauucaucaaaacggcaaauguauguacaccaagaaaccaauugacuuagaacgacuacuuucugacacgaauaaccaacuauacgaaauagaccauaucuuaccuagaaccuucguuaaggacgauuccauaaauaacaaagucuuagucauacaaucugccaaccagaagaaaucaggagacaaaaugccccuugaaauauucgauaaucauguccuugucccauucuggaaaaugcuuuacgagaaugauuuaauauccucuagcaaacucucuaaacuaaugaagaaagaguucaacgaucuugauaaagaaggauuuauucaacgccagcuaguagaaacuagacaaauaaucucacacguaucagacuuccuaacagaagaauauccuucuacgaccgucguacccaugaaagccaacguaguguccgaacucagaaggaaauucgacauaccuaaaauacgacaauuaaaugauuggcaccaugccguagaugccuaccuaaacggauuuguauaccaggcagcacgaguuuucuacccaaagguaaaccuauuugaauuuaauuuuaaaugggagaaaguacgagagaaauggagacaacuaggagaguucacugaaaacaacaagaaaagagaguucuuuuuauuuaaaagaauggaaaacuacguuaacgaacauggugaaggaaugauaagcaaacuaaucuucgaccuugacaacuuuaaauucaauuacaguagaaaaguagaauccacggaaucagccuucuacaaacaaagcgcauucucuccgaaaaauacgacugcccaauaugacucugacaaaaauaaaacggcgauauacaaagaaaugaaaaauaaacgcggcauagugguuaguuacacauacgucaagaaagaucaagaacuuauaggcuacggcguauucaacgaaacaguauuugaguacguaaacaaugcagacguagacaugaacacgagagcccucaaaauaguaaggaaggccuuucccaaacuugacauaaagaaaguacaguacuuauucucgaucaacaaaggcgacacgcuccuaguaaacggacaccccuuccuauucguaagcgcauaugaaagaauaaacggcaaacaguuagaauuugacauagcuaugcaaagaaaaauaaaacaagccuuaaguccauacaacaauaugacagaacaagaaaaaguugaauuuuacaaccaauucgcggaaaaaguuauagaagaauuuagaaauuccauuggacuacaaaguagagaccggaaaguuaaucugaucaaaaaccuuuucaacaauacagaaaaauccaacgauuccaugacccaaagcaucuuagaaguauuaaaaaugacgaaagucucggcagaaaggucaaaagaacucaaaauaagauggaacggacaaaccccgaacacuuucauugacacuaaaaacaacgcggaaauacaauauaaaucaaucacuggacugaaaacaacaaaaccaaagaguauauucaaacuagccgaaagcaaaaacgagcuuuga

SEQ ID NO: 5319 - RNA, 4038 nt, Artificial Sequence
  Cas9 variant
augaaaaaaccauauagcaucgguuuggacauaggcacaaacucgguaggaugggcuguaguaacagacgacuauaaaguacccgccaagaaaaugaaaguacuaggaaacacugacaaaucacauauaaaaaagaaucuacuaggagcucuauuauucgauucuggaaauacagccgaagaccgccgacugaaaagaacagcaaggaggcgauacacaagaagaagaaauagaauccuauaccuacaagaaaucuuuuccgaagaaaugggaaaaguagacgacucauucuuccauagacuugaagauucauuuuugguaacagaagauaaacgcggcgaacggcacccaaucuucggaaaucuagaagaggaagucaaauaucaugaaaauuucccaacaauauaccaccuacgacaguacuuagcagauaaucccgaaaaaaccgacuuaagguuaguauaucuggcgcucgcacacauaauaaaauucggaggacauuuuuuaauagaagguaaauuugacacaagaaauaaugacguacaaagauuauuccaagaauucuuagcaguauacgacaacacauucgaaaacagcucacuacaagaacaaaacguccaaguggaagaaauacucacugacaaaauaucaaaaagcgcaaaaaaagacagaguacuaaaacuauucccuaaugaaaagucaaacggaagauucgcagaguuccuuaaacugauagucgguaaucaggcagacuucaagaaacacuucgaauuagaagaaaaagcaccacuacaauucuccaaagauauauacgaagaagaacucgaaguauuacucgcccaaauuggagacaacuacgcagaauuguucuuaucugccaaaaaauuauaugacuccauacuucuuaguggaauucucacagugacggacguaucuaccaaagcaccacuaagcgcgagcaugauacaacgcuauaaugaacaucaaauggacuuagcacaacucaaacaguuuauacgccaaaaauuaagcgauaaauauaacgaaguuuuuucugacguuucuaaagauggauaugcaggauacaucgauggcaaaacaaaccaagaagccuucuauaaauaccuuaaaggacuacuaaauaaaaucgaagguagugguuacuucuuagauaaaauagaacgggaagauuucuugagaaaacaacguacauucgacaacgggagcaucccccaccaaauacauuuacaggaaaugagagcaaucauucgccgacaagcagaauuuuacccauuucucgcagauaaucaagacagaauagaaaaaauccuaacguuuagaauaccauauuacguaggccccuuagcuagaggcaaauccgacuucgcauggcugucaagaaaaucagcagauaaaaucaccccauggaauuucgaugaaauaguugauaaagaaucaaguguagaagcauuuauuaaucgaaugacaaacuacgaccuauacuugccaaaccagaaaguacuuccaaaacacucccugcucuaugaaaaauuuacuguuuauaaugaacucacuaaagugaaguacaaaacagaacaaggcaaaaccgcauucuucgaugccaacaugaaacaagaaauauuugauggaguauucaaaguauaucgcaaagucaccaaagacaaacuuauggauuucuuagaaaaggaguucgacgaauuucgaauagucgaucuaacaggucuugauaaagaaaauaaagcguuuaacgcuuccuauggaacuuaccacgaucuacgaaaaauauuagauaaagauuucuuagacaacagcaaaaacgaaaaaauacuggaagacaucguacuuacucuaacucucuucgaggacagagaaaugauaagaaagagauuaaaaaacuacucugacuuacuaacaaaggaacaacucaaaaaacuugaacgaagacacuacacagguugggguagacucuccgcagaacugauacacgguauuagaaacaaagaaucaagaaaaacgauuuuagauuaucuaaucgacgauggaaauucaaacagaaauuuuaugcaacucauuaaugacgaugcacucuccuuuaaagaagaaauagcuaaagcacaaguuauaggagaaaccgauaaucuaaaucaagucgugucugacaucgcugguuccccagcaauuaaaaaaggaauacuacaaucgcuaaaaauaguagacgaacucguuaagauaaugggacaccaaccagagaacauaguaguagagauggccagagaaaaucaguucacaaaucaaggcagaagaaacucacagcaacgauugaaaggauuaacugacucaauaaaagaauucggaagucaaauacucaaagaacaccccguagaaaauucucagcuccaaaacgauagacucuuucuuuacuaccuacagaacggccgcgauauguacacaggagaagaacuagauaucgacuaccugucucaauaugacaucgaccacauaauuccgcaagcauucauuaaagauaacagcauagacaauagaguacuaaccucuuccaaggagaacagaggaaaaucagacgacguaccgucuaaaaauguaguuagaaaaaugaaaaguuauuggucuaaguuacuaagcgcaaaacuaaucacccaaagaaaauucgacaauuuaaccaaagccgaacgaggaggauuaacagaugacgacaaggcaggguucauaaaaagacaauuaguagaaacaagacaaauuacaaagcacguggcacgaauauuagaugaacgcuuccauacagaaaccgaugagaacaacaaaaaaauccgccaaguaaaaauagugacacugaaauccaaccucguuagcaacuuccgaaaagaauuugagcuauacaaagugagagaaauaaaugacuaucaccaugcccaugacgccuacuuaaacgcaguaauaggaaaagcacuacuaggugucuauccacaauuagaaccagaguuugucuauggagacuauccacacuuccauggccauaaagaaaauaaggcuacagccaaaaaauuuuuuuacucaaacaucaugaacuucuucaaaaaagaugauguuaggaccgacaaaaacggugaaaucauauggaaaaaagaugaacacauaucaaacauaaagaagguauuaucuuacccacaagucaacauaguaaaaaaagucgaagaacaaaccggcggauucaguaaagaaucgauacucccaaaagggaacagugauaaacuaauaccacgaaaaaccaaaaaauuuuauugggauacuaagaaauacggaggauuugacaguccaauugucgccuauucaaucuuaguuauagccgacauagaaaaggguaaauccaaaaaauugaaaaccguaaaagcauuaguaggaguaacgauaauggagaaaaugaccuuugaaagagauccaguugcauuccuugagagaaaaggauauagaaacguacaagaggagaacauaauuaaacuuccgaaauacaguuuauucaaacuagaaaacggaagaaaaagauuacucgcaagcgcacgagaacuucagaaaggaaaugagauaguguuaccuaaccauuuaggaaccuuauuguaccacgccaaaaauauccauaaaguagacgaacccaaacauuuagauuacgucgacaaacacaaggacgaauuuaaagaacuguuagacguagucaguaauuuuaguaaaaaauauacacuugcggaaggcaacuuggaaaaaauaaaagaacuuuacgcacaaaacaauggcgaagaccuaaaagaguuagcaucaucguucauaaauuuacuaacauucacagcuaucggugcaccugcuacauuuaaauuuuuugacaaaaacauugauagaaaacgauacacaucaacaaccgaaauuuuaaacgcaacacuaauacaucaaagcauuacaggucuauacgaaacaagaauagacuuaaguaaauuaggaggcgacuga

SEQ ID NO: 5320 - RNA, 4038 nt, Artificial Sequence
  Cas9 variant
auggaaaauuacaacauuggacuggacauaggaaccacaaguguaggcugggcuguagugaacgaugcaacuaacaaaguaaugagaaaaggcgguaaagcacucuggggaguacgauuauuugacccagccguaacugccgaagauagacgagcaaaaagaggcacaaggcgaagguacgauagacgccgagaacgaauaaaacuauuacaagacgaauuuaaagacgaaaucaacaaaguugacucaaacuucuuucuaaaacuggaagaaagcaaauauacauccaaagacauuaaaaauaaaacaguacuaauaagcauggaagaagaaaaggccauaaagaaauauaaccaagaauacccaacaauauaccaccuaagacaaaaauuaaugaacuccaacgaacaaauggauaucagacugguguaucucgcaauacaucacauaauuaaauacagaggaaacuuuauauaugaagguaacuccuuuucgguaaauaacuuaaacauagacaauaaauugaaagaaauauuuuuaucgcuaucggaagacguagaugaacucgauauaucugaagaauguauuaacaauauaaacuacaaacaauuagcaaacauauuuaacgaacaaaguaaaaacgaucuaaaaguaaaauuaacaagugaauuaacuagcuauucacugaauaaaaauuucauauccgaguucuguaaacuaauaauagguaacaaauucucggcuaagaaauuauucaaucuugaaacagacaacgauguuucacuuucauuugacggaaccgauuuugaagacaaagcaggagaccuugaaucacuacucaaugacuaucuagaaguauuagaacaacuaaaagaacuauacgauaugguuuucuuaaagaaaauauucggaggcucaaaagaaacaacaauauccggacuaaugguagaaagauacaaccagcauaagaaagacuuaaaacuccuaaaagauacguucaguucugauaggaaaauauauaauaaaauauuuagaaguaagaaagacaucaaagaugauaaagauaugugccucuacgaccuauacauacacaauaaacuagaaacaacagacuuccuuaaagaaauuaagaaauacguaaacaccgauaauuucaucauaacagaugaagacuuccuaaaaagacuagaaaacaaugaaguacuaccaagaauaacaucaaaagaaaacgguaaauaucccuaucaacuuaauaaagacgaacucguaucaauaauagaacaucaaggaaaacacuaccccuuucuacuuaacaaaacagacgacggcauauauaaauuaguucgccuuuuagaauuuagaauacccuauuucguaggaccccuaguaucaaaagauaugagugaaaaugcuuggaugcucagaaacgaagguaugcaaggaguacauauaacgccauacaacuuuaagaaaguaauaaauuuagauaaaacugcggaaaucuuuauaaaaagaaugauaagccauuguacauaucuacuugaugaagaagcacuaccaaauaacucaauccuauauucggaguucaaaguuuugaaugaacugaaacaaaucaaaguaaauggcgaacaccuuacgaaagacgaacaacacaaaauaauagaagaauuauucaugaaaacaucgggaacgaucaccgaaaauaaauucagagaauuucuacuuaacacacuagacuacaacuuuuacgaaaacgaacucaaaaucaccgguuauucagccgacuguaaauucgcaaauaacaugcaaaguuacauagacuucuucggagaaaacggaaucuucgaaggaacaucauauaauacaaaugacgcagagaaaaucauugaauggauaacuauauucgaugauaaagauauccucaaacguaaaguagaaaacgaauauccagaacuaaaaaguaaucaagugaaaaacaucuuaaacaagaaauauucaggcuggggaagguuaagcagaaaauuacuauuagaucuaagaguauuagacaaagaaacugauauaccaaaaucaaucauggaccucauguacgaaacugaugagaauuucaugcaaauaauaaacaaugacaaauauaacuuccaaaaacuaauugcuaaagaaaacaaaauugagaauacaagcaacgacuuaucguacgacguaguagaaaaucuagccaccagcccggcaacaaaaagagguaucuaccaggcguuaaaaguugucaaagaaaucacaacauauaugggcuacgaaccuaaaaacauaaugguagaaauggcuagaggagaugaaaagaaaauccgcaaagacgauagaaagaaauaucuacaaaaauuauacgacaacauaaaagacgaaguagauucaaacuacaaaaaucucaagaaagagcucgcgaaagaagagaaaauagauaccgacaaacucuauuuauauuauuuacaggaaggcaaauguuuauauugcgggaaaccaauaaacguagaugaccuaaauaccaaaaacucacuauacgaaauagaucacauauuaccaagaacauugaucaaagauaacagcugggacaacagagugcuagugugccgaggcugcaaccagaagaaagcggccagucuaguacucccaaaagaguuccgaaacgauuauaccaaaucaauauggauaagacuuaaaaacaacaaacuaaugaguaacaagaaauucuacaaccucacgagaaaaaguuauagcgaagaagauauaaaaggauuuauaaauaggcaacuugucgaaacgagacaaauaacaaaacauguagccaacauacucaauugcuucuacccaaaaaccaaaauagucuaccucaaagcuaauauaucgcauucauacagagauaaauacgaccuauucaaauucagagacauaaaugacuaucaccacgcacaugaugcguacuuagcagccacacucgguaguuaucaagaaaaauaccuacauuaugaccuggacuacaauaaaauuaaugaguucaaugaaaaauugauuaaaaaugaagacuacaaacgguuacauuaugggauaguaguuaacagccuugaugaagaauuucagucagccuuugcagaaauugcaccacguuugauuaacgaagaaacaggugaauuacuauucaaugccaagaaauuuaaugaucucgucgaagacacucuauauagaaaugacauuuuaauaagcaggaaaacagaaaucagaaccggcaaacuauacaaagaaacaauauacaaaagggguaaagguaacauaaaaauaaaagaaaauaugcccacugaaacauaugguggcuacucaaacauggaaacaucauauuuaacgcuagugaaauaugguaauaaaacaaaacugauaggaauaccaaugucaauagcaaacaacaaagauguaaaaguuaaacuagauuuuaucaaagaacaccuagaccucaagucccucgacaacauagugauuuuaaaagauaauauaccguaugacgucucuauaaauuacaaaaaccaagacguuuacgucaaaggauacucaacagccaacaaaaacugugaacuuuccaaugcacaccagcuuaaaauaaagaaagauaugaugaagaaaugcaaauacgugcuuaacaaaguauauaaaaacaaauacgaugauauaacaaacauggacauagaaaacgcuauaaccuucauaaacuacuuauuugaaauaaaaauagaguucccacucuucagcaaagaaauaacuaaaauacaagacaacaucaauuuaacagaauguuccuucgaacaacuagccaacaucauuaaacaacugcucauaaucuaccacugcaauagcaaaaacggaaaucuaaaagaauuuggacugagugauagaaucgguaggcuuucaggagcuaacguaacaggcggggacuucauauucacuucagugacaggacucaaagagaaaacugcauccuacgauggagaauga

SEQ ID NO: 5321 - RNA, 4038 nt, Artificial Sequence
  Cas9 variant
auggucgaaaaauauggaauaggacuugauaucggaaccucaacacucggauggacgagcguagacgaaaacgguaaaauacaaagacuaaaaggacaaacagcacucggaacaagauuguuuaacgagggccaaacagcagaagagagaaggggcuuucguacaacaaggcguaggauucaaagacgaagauggagauuacgauuauugagagaaauauucgacgaaccaauugguaguguagaugcaggauucuuugcuagacagaaaaugagcucuuugucaccccaagaugaucgauucgaagacacuuacagauuauuuaacaaccaaaccgacaaggcuuuccaugacgaguaccccacgacauaucaccuacgacaagcucuaaugaacucagaccgucaauuugauauuagagaaaucuacuuagcuauccaccacauaguaaaauacagagguaauuucuuaagaucaggaaaacccgccgacuuuaaaacaggcaaauuagaccuuaaagaaaaauucgaagaaauaaaugccgacuggcaaacauuaauaagugaagacgcuccacaacuuccaguugaugauuuaacgacaauaaaagcaguauuagucgaugguucgcguagucguagcgaucgacaaagaggucuuguaaaacucuggauggccaacgaaacugucgagaaaaacuggaaaccagucaugacugaauuagcaaaagcaauacuaggcuuaaaaacaaaauuauaucugcuaacaggacuagaucuaccaaaagaagaccaaaaagcauggacauucucacuggauacacuugaagaucaccaaggcgacauagacucauuuuucgaugaccaugcccaacaacuaauagauagacuagcugaacuaagagcuaugauacaauuaacggaaauuaucccaagcggauuaaauuuuucacaaagcaugguucaacguuacgaagcacauagaagucaccuggaaauguacaaacaauacgcucuagaucaaacagaucccaaacgcacaaaagcucuacgugcugcauacaacgcauacauagaucaacacgaaauagcagacgauuuuuacacagccguuaaacgaguuaccaaagacgaucaaucagaaacggcugaagaaauuaauagauuaauagggcuugaacaauucaugccuaaacaaaggacaaaagaaaacggcguaauucccuaucaaguacaucaacaagaacuagaucaaauuauagcucaccaaaagaaauacuacccuuuccuagggacagaaaacccaguaauagaccauagagagagccaacccuauauguuggaugagcuuguaucauuuagaguaccauacuacgugggaccuaugguugcagcaaauccagaacuaaaaacaacugaaaauccguucgcauggaugauaagaaaagcucaaggugagauaacgccuuggaacuucgaugaaaaaguagacagaaaagggucagcaacagcguucauagaacgaaugaaaacaaccgacacauauuuauuaggggaagauguauuaccucaacaaagucugcuuuaucaaagauuuaugguauuaaaugaauuaaauaauauaagaauagacgacgaacuauuaacaaccaaccaaaaacaauggguauucgacagaguauucaaagggaagggaacgauauccgcuaaacauuugcaagacgcacuaaaacaccauggugaaacugacgggcuuccgaaaaucucaggucuagcggauccaacaaaguuuaauucagcacuuacaaguuaccgagauuuucaaaagugguuacccaaugacauagacagaaaggaucguacagcugacauugaaaccauaauaaauuggaguacugucuuugaagacacucacauauuuguagaaaaacuaaaagaaauagaauggcuaacagcugaucaaagaagacguauagcuagcaacagauaccgaggcugggggagacucucuaaacaucuacuuaccgaaauaaaagaugagcagggacuaucaauaauggaccaacuuuggagaacccagcacaacuucaugcaaauaguacacgaaccagacuacgcaaaacaaauagaggcugcaaauacagucggcauggccaaacaagauauuggaacaguaauaaaugaucuauauaccucuccacaaaauaagaaagcaauuaggcaaguuuuagccguagucaaagauauccaaaacgcccaucacggaguugcgccgaguuggauauuuauggaagcagcgcgcggagcagaucaaaauccacaacgaagcagacaaagacaacgacaauuacaagaucuauacgccaaaacugcagccgaucucgucgacacagaaguacaacaggaauuaacugauaaaaucaaggauaaagcaaacuuuacggacagacuaauguuauacuucuuacaaaauggacaggacauguauucgaaagaaaaauuaaauauagacagauuaucagaauaugauauagaccacauacuuccucaagcacuaauuaaagaugacagucucgacaaccgcguauugguacaucaaaguauuaaucguaacaaaucugauacauucgcaucagaaaaauacggagcaaaaaugcaaggggccuggcaucaauggcgagcagcaggucuaauuucugcaagaaaauuacgaaauuuggagaugagaccugaugaaaucagcaaauaugcaacggguuuuauucguagacaauuaguagaaacacgacaagucauaaaacuuguuacugaaauacuaucccaucaauauaauccagaagaaaccaaacucgugucaguuaaagcuggguuaagucaugaguuaagaagagaagcaggcuuacccaaacuacgagauuuaaacgacuaucaucacgccauugaugcauauuuagcggcaagaauaggaacauauuuacugaaacgauauccacgauuagagagauucuuuguauacggacaauuucaaacgucaaggcuagacuuaagacguuuuaacuucauacaugauuuaguuaaaagcaaacaaggugucauuguugauagcgauacaggugaaaucuuaugggauagacaaaaagauauagauuauaucaaacaccucaugggucucaaacacuuacuuguaacucaugaaguauaugacucagcagcggaaauguacgcccaaacaauauucaaggccucggauaaugacucaaaaguacucauuccgacgaaaaaugauagaccgacagccauuuacgguggauacacaaagaggagaaauggcuaccuagcuauacuuaaaauaacugagaagaaagccgaaacguacagaguagucgguguuccaacauuguacaugucucaacuagcaaccgcuagaucucacucaguggaagcugaaaaagcacuucuaaagagcuugauggcaccugagauucucuccgaaaguaaaguugucucauucgaagucguagucucacauguccaucuuaaucaacucguaagagauaccguuuucggucccgcacauuauuucggacuuggcccauucagauacgucagaaauuuucaucagcuaguucuaccauuuaaagaucaagaaaucuugguuaaaagaacaccuacagaugaagaacuaaauaccguauucgaagacauauguuggcaagucgaaaauuacuucgcaguuuuugauauaaacggauucagaaaugcauuaaagaaaaguauagacaaauucgaacaguuaccaaucgaaaauguguuuaaagauaagaaauuagucacucaaggcaagaaagaaguacuagcuuuugugaugcaaggacuacaugcaaacgcuaguuaccgaaaccuuaaagucucacucgguauaaaaacaccccuaggacaauuacaauuaacaaaauucauguuaucaagagaugcagaauuaauagaugaaucaccaaccggauuauuucgacgaauuagacgccuaaaagacuuauga

SEQ ID NO: 5322 - RNA, 4038 nt, Artificial Sequence
  Cas9 variant
auggguaauaaacuaaggaauguagacgacuacuauuuaggccuagauauaggaacagaaagcguaggaugggcugugacagauaaauauuacguaauuccaaaauucaaaggaaacgccauguggggagugcaucucuucgacgaaggggaaacuucagucaaacgaagaggcuucagaagcgcaagaaggagaacacaacgaaaaagagaaagacucgcacuccucgaagccuuauuugaugaggaaauuugcaagaaagacugcacguuuuucagaagauuacaugaauccgaccuauggcccgaagacaaaaguggagacgacaaauacgcagucuucgcagaugagaauuacaccgacaaagauuuucacaaagaauauccaacaauuuaucacuuacgcuacgaauuaauuaaaaacaaggaaccacacgacguaaaacuuguguucuuagcccuacaucauaucauaaagaauagaggacauuuucuauucgauagucucaguucagcagaagacuuuaacagugcauacgagacgaugugcagcuacuuaucagacaaugaaauacaacuaaauugcagcgauauagaacaguuuaaagcgauucuaaaagauagaagacaaggaaaaauagaaaagaccaaaaaucuagcgucauuauucggaauaacaaagaaauccgauccggucucauacgcaguuauggcuguacuuagcggaucgacaguuaaaaugugugaucuuuuuggagaugaugaauuaaaaacgguagagaaaaacaauauaucauuugcuucaggauacgaagaaaaugaagaaauauacgccagcguauuaggcgacagguucgaauuaguaaaaauccuuaaagccguauaugacugggcuguauuagcagauaucuuagauggaaagaaauauaucagcgaagcaaaaguagcagucuacgaaaaacauaaaaacgaccuaaaaacuuugaagaaauauguaaaaacuuauuuaccugaaaaauacaaugaaauauuuaaaauaucagauggaaagaaagacaacuacguugcauacagcggacauauaaaagaaucuggaaaaaccggagaacuaaagaaaaccugcaacucagaaaacuuuugcgcauauuugaagaaaacucuagguaaaaaugccgaccuaucauauaaagaaauguucgacgaaauugaaaauaaaacuuucaugccgaaacaagucacaaaaucaaauggaguaguaccuaugcaaguaaacgaagaagaacuaaaagcuauuuuagauaacgcaaaagauuaucucucuuuccuaaacaguugugaugaaaauggagugaguguguaugauaaaaucaucaaaauauuugaauacagaauaccauauuaugucggaccucuaaauacacacacugaaaacagcugguuaaaaagaaaagacgguguuaaaauauauccauggaacuucgacgauguggucgauauagacucaucagcagaaaaauucauuaauaaccuaacaucaaaauguacuuaucucccugaaugugaugucauaccaaaaugcaguuuauuauauucaaaauuuacgguucuuaacgaaauaaacaauuuaaaacuuaauggagaagacauaccaguugaauugaaacagggaaucuauaaagaucucuuuaugacaagaagaaaaguaaccguaaaacagauaaaagauuaccuaaaggcuagaggaugcuacgacaauaacgacguccucucagguaucgauacaacuguuaaaucgucucucaaaagcuacuuugauuucaaaggcuucgaaucucuaaccuuugaugacaaagagucaauuauugcaucaagcguaauauucggggaugacaagaaacuccuaaagaaaagacucaagaaacuuuuuccugagaaauuaacugaugaggauaucaagaaaauaugcaaacuaaaauauacaggauggucaaggcuaucuaaagaauuucugugugauguugaauuuacuuacaagaaaacaggagaaguaaugaacguaauaaccgccuuaugggaaacaaauuacaaccuuaugcaaaucuuguauagcgaagauuucuguugcgauggagaugaaaagaaaaaccuaaacgacaaauuagacgaauuaucauauaccggagaccaacauagcuuaagaaaagcuguugaugcacuauauguaucaccaaaaguaaaacgaccgauucuaagagccuuauuaauugcuaaagaaauagagaaaauacaagaaagaccacccaagaaaauauuugucgaagucgcuagaggaauugacaaucgagaagaaaggcacagggauucuaggaaaaaccgacuaauggaacuauacaaaaauuguaagaaagaagcagaaaaauucugccccuacuuugaugcccuaucaaagaaauuaucagacgaagacgaaucaaaacuccgccgagauaaacuuuacuucuauuacauacaauuggguaaaugcauguauacaggagaagaaauaagccuaggagaacuaaugaacggaaacgguagauuugauauagaccauaucuacccaagaucaaaaauuaaagaugacagccuuaccaauaaagucuuaguaaauaaaacuguaaacaacaacaaaacaaacguauacccaauagacgcagcaauacaaucaaaaaugagcccauauuggcaaauguuacgaagcagcgggcuaauaagcgaagaaacauauaaaagacuuacucgaaaaacaccuuuaacagaugacgaauuaagugcauucguaucacgacaacuuaccgaaacccaacaaucaacuaaagcuguagcucacauucuagaacaacuauacccaaaaccaaaaacagagauuguauauguaaaagcagcccucguacacgcauucaggcagucgaaugacauguuaaaaugccgugaaguuaaugacuuacaccaugcgaaagacgcuuaccucaacauaguaguaggaaacgcauauaauguaaaagucacgcauaacaaagugaacuuuauuaaaggucuacaaaacaacgauaaaggcuauacggucaauccagaaaaauuuuucucucaugauauaccaggugccuggucaguuaaagauucaaugaauacuguacgaagauuuaugaauaaaaacaauaucagguauacaagauuuccaaggaagaaacaaggcggauuauuuaaaauuaacccccucaagaaaggaaauggacaagucccauuaaaggcuucuggagcacguagcugcauugaaaaauauggcggauacgacaaagcaacaucagcauauuuuaguuaugucgaauauacagauaagaaaggaaaagcaguaaggcaaauguucccaguaaaccuauacgaaguaaaagaguaugaagcggauaugcaagguuucgugaccucuagaauagcugaagcaaguaacguuaaaaucuugauuccauguguaaaauaugaugccugcauaucauuugacgguugucgaauguucauaaccaagaaaaccggaaauagaauuggauacaaaccuggaaugcaacucguucuaggcuacaaauaugaaaaauauauccguaacaucgaaaacuacuugacuaaacauaaagacagagaaaucauaccacgagacaacauaagcgcagaagaaaauauugaacucuaugauauccuaaccggaaaaaugcuaaacaccguauuaucaguaaaauuuucuggaauugggaagaaacuagagaaaagaagggaaaaauucguguuauguagcccugaagaacaaugcugcguauuaaacgaaauauuaaaaauccuacaugcaaacguacuaagcggugaccucagccugauuggagaaaguccuaacaccggcacaaugaaaacgaacgcaaaauucucagaaauaaaagauguacauagcauuaaacuaauaaaucaaucaguaacugguuuauuugaacaagaaaucgacuuauuaaaauga

SEQ ID NO: 5323 - RNA, 4038 nt, Artificial Sequence
  Cas9 variant
augggcaaaccauauaguauaggcuuggacauagggacuaacagcguugguugggcaguaguaacagaugauuacaaagugccagccaagaaaaugaaaguacucggcaacacagauaaacaaaguaucaagaaaaaccuauuaggagcauuacuuuuugauucgggagaaacagcagaagcaacuagacuuaaaagaacagcaagacgaagauacacaagaaggaaaaaccgucuaagauauuuacaagaaauauucaccggagaaaugaauaaaguagaugaaaauuucuuucaacgacuugaugacuccuuuuuaguugacgaagacaaaagaggagaacaccaccccauauuuggcaauaucgcagccgagguaaaguaccacgacgacuuuccaaccauuuaccauuuaaggcgucaccuugcagacacauccaagaaagcagacuuaagguuaguauacuuggcauuagcacauaugauaaaauucagaggccacuuucuauacgaaggagauuuaaaagcugaaaauacggacgugcaagccuuauuuaaagacuucguggaagaauacgacaaaacaauugaagaaagccacuuaagcgaaauaaccguagaugcauuaucuaucuugacagaaaaaguaucaaaaucauccagacuggaaaacuuaaucgcccauuacccgacagaaaagaaaaauacucucuuugguaacuuaaucgcacucagcuuagaucuacauccaaacuuuaaaacaaacuuucaacuuucggaagacgcaaaauuacaauucucuaaagacacauacgaagaagaccuagaaggauuuuuaggcgaaguaggugacgaauacgcagauuuauuugcuagcgccaaaaaccuuuaugaugcaauccuauugucaggaauacuaacgguggacgacaauaguaccaaagcaccacuauccgcaucuaugguaaaaagguacgaagaacaccaaaaagaccugaagaaacuaaaagauuucauaaaaguaaacgcccccgaccaauacaaugccauauuuaaagauaaaaauaagaaagguuaugcuuccuacauagaauccggaguaaaacaagaugaauuuuacaaauauuuaaaaggaauauuacuuaaaauaaaugguagcggagauuuccuagauaaaauagacagagaagacuuccuaagaaaacaacguacuuuugacaauggaucgauaccccaucaaauccaucuccaagaaaugcacgcaauacuacgaagacaaggagaacacuauccauuccuaaaagagaaccaagacaaaauagagaaaauacuuaccuuuagaauacccuauuacgucggcccucuugcaagaaaaggcuccagauuugcaugggccgaauauaaagcggacgagaaaauaacucccuggaacuucgaugacaucuuggauaaagagaaaagugcagaaaaauuuauaacaagaaugacacuuaaugaucuauaucuuccagaagaaaaaguauuaccaaaacauagcccguuauacgaagcauuuacagucuauaaugaacucacaaaaguaaaauacgucaacgaacaaggagaagccaaauucuuugauaccaauaugaaacaagaaauauucgaccacguauuuaaagaaaaucgaaaaguaacgaaagacaaacuuuuaaacuaucuaaacaaagaauuugaagaauuuagaauuguuaaucuaacuggccucgacaaagaaaacaaagccuucaacucaucucuaggcacauaccaugacuuaaggaaaaucuuagacaaaucauucuuagaugauaaagccaacgagaaaacaauagaagacauaauacaaacacuaacauuauucgaagacagagaaaugauaagacaaagacuacaaaaauauucagauauauucacaaaagcacagcuuaagaaacuagaacgacgucauuacacaggauggggaagauuaucuuacaaauuaauaaacggaauuagaaacaaagaaaacaagaaaacaauucuagacuauuuaauugacgacggauaugcaaacagaaacuucaugcaacuaauaaacgacgacgcccuaucauuuaaagaagaaauagcacgugcacaaauaaucgaugauguggaugacauagcaaaugucguccacgaucucccaggaucaccagcaaucaagaaaggaauacuccaaagcguuaaaaucguagaugaauuaguaaaaguaaugggacacaaucccgcaaacaucauuauagaaauggcucgagaaaaccaaaccaccgauaaaggaagacggaacucacaacaacgacucaaacuacuccaagacucacuuaaaaaccuagauaaucccgucaacaucaaaaacguagaaaaccaacagcuucaaaaugaucgacuauuuuuauacuacauucaaaauggaaaagacauguauacaggugaaacguuagacauuaauaaccucucgcaauaugauauugaucacauaauuccgcaggcuuuuauaaaagauaacucauuagauaacagaguuuuaaccagaagugacaaaaacaggggaaaaagcgacgacguaccaaguauagaaguaguacacgaaaugaaaucauuuuggaguaaacuguuaucugugaaauuaaucacacaaagaaaauucgauaaccuaacgaaagccgaacgaggcggacuaacagaagaagauaaagcugguuucaucaaaagacaauuaguagaaacaagacaaauaacaaaacacguggcacaaauucuagacgaaagauucaacacagaauuugauggaaacaaacgaagaauacgaaacguaaaaaucauaacacuaaaaucgaaucuugugagcaacuucagaaaagaguucgaauuauauaaaguaagagaaauaaaugacuaucaucacgcacacgaugccuaucuaaacgccguuguaggaaaugcauuauuauuaaaauauccacagcucgaaccagaauuuguauacggagaguacccuaaauauaacucuuaccgaagucgaaaaucugcaacagaaaaauuuuuauuuuauucuaacauacucagauuuuucaagaaagaagacauacaaacaaacgaagauggggaaauugccuggaacaaagaaaaacauauaaaaauacuuagaaaaguccuuucauacccacaaguaaacaucgucaagaaaacggaagaacaaacaggaggcuuuucaaaagagucaauacugcccaaaggggaaagcgauaaacucaucccacguaaaaccaaaaauucauauugggaccccaagaaauauggaggauuugacucaccggugguugcuuauucaauacuugucuucgcagaugucgaaaaagguaaaagcaagaaacuccguaaaguacaagacauggugggaaucacaauaauggagaagaaaagauucgagaaaaaucccguagacuuccuggaacaaaggggauaccgaaauguuaggcuagagaaaauaauaaaauuaccaaaauauagcuuauucgaauuagaaaacaaaaggcgaagacuacuagccucagcuaaagaauuacaaaaaggaaacgaacucguaaucccacaaagauucacuacccuacuauaucauucauauagaauugaaaaagauuacgaaccugaacauagggaauauguagaaaaacacaaagacgaguucaaagaauuacuggaguacauaucagucuuuagcagaaaauacguccuagcugauaauaacuuaacaaaaauagaaaugcuauuuaguaaaaacaaagaugcggagguaucuagcuuagcaaaauccuuuauuuccuuacuaacuuuuacugcauucggcgcucccgccgcauuuaauuucuucggagaaaacauagacagaaaaagauauacuagcguuacagaaugccucaaugcaaccuuaauacaucaauccauaacuggcuuauaugagaccaggauugaccuaucaaagcuaggcgaggauuga

SEQ ID NO: 5324 - RNA, 4038 nt, Artificial Sequence
  Cas9 variant
auggaucaaaaauacagcauaggcuuagauauagguaccaauucaguaggcugggcuguaguuacagaugacuacaaagugccagccaagaaaaugaaagucuuaggaaacacagauaaacaaagcaucaagaaaaauuuacuaggagcucugcuauucgauagcggagaaacagcagaagcaacuagacuaaaaagaacagcacgaaggcgcuauacaagacgucgaaaucgacuaagauauuuacaagaaauauuugcagaagaaaugaauaaaguggacgaaaacuucuuucaaagacuagaugacucauuucuagucgacgaagauaaacgaggggaacgccacccaauauucggaaauauagcagcagaaguaaaauaccacgacgauuucccaaccauauaucacuuaagaaaacaucuagcagacauaucacaaaaagcagaccuaaggcuaguauacuuagcauuagcacauaugauaaaguuuagaggccacuuccuaauagaaggacaauuaaaagcagaaaauaccaacguacaagcauuauuuaaagacuucgucgaaguauaugacaaaaccguagaagaaucccauuuaagcgaaaugaccguagaugcacuuucuauucuaacagaaaaaguaucaaagucaagacgacuagaaaaccuaauagcacacuacccagcagagaagaaaaauacauuauuuggaaaucuuauugcauuaucauugggcuugcaaccuaacuucaaaaccaacuuucaauugucagaagaugcuaaacugcaauuuucaaaagauacuuacgaagaagaccuggaaggauuacuuggugaaauaggagaugaauacgcugaccuauucgcaagcgcuaaaaauuuauacgaugcgauacuucuaucagggauacuaacaguagaugacaacaguacgaaagcaccacuuucagcuagcaugguaaaaagauaugaagaacaccaaaaggaucuaaagaagcucaaggacuucauuaaagugaacgcaccugaucaauacaaugcaauuuucaaagacaaaaauaagaaaggguacgccggauauauugaaaauggagugaagcaagacgaauuuuacaaauaucuaaaaggaauacuauuacaaauuaacggaucaggagauuuucuugauaagauagaccgagaagauuucuugcgaaaacaaagaacauucgacaacggaucuauaccacaccaaauucacuuacaagaaaugcaugcaauccuuagacgccaagaagaacacuacccauucuuaaaagaaaaucaagacaagaucgagaaaauucucacauuccgaaucccuuacuacguagggccauuagcuagaaaaggaucacguuucgcaugggcggaauauaaagcagacgagaaaauuacaccauggaauuucgacgauauacuagacaaagagaaaagcgccgaaaaauuuauaacuagaaugacacuaaaugaccuauaucucccagaagaaaaagugcuaccaaagcacuccuuauuauaugaaacauucacaguauacaacgaacuaaccaaagugaaauaugucaaugaacaaggagaagcaaaauuuuucgaugcaaauaugaaacaagaaauauucgaucacguauucaaagaaaauaggaaggucacaaaagauaaauuacuuaauuaccuaaacaaagaauuugaagaauuuagaauuguaaacuuaacaggccuugauaaagaaaauaaggcauuuaacuccaguuuggguaccuaucacgaccucagaaaaauacucgauaaaucauuucuugaugauaaggcaaacgagaaaacaauugaagacauuauacaaacccuuacccuauuugaagaucgagaaaugauaagacaacgauugcaaaaauauucagacauauucacaaaagcucagcucaagaaauuagaaagacgacacuauaccggcuggggacgauuaucauacaaguuaauuaauggcauccggaauaaagaaaacaagaaaacaauccucgauuaucuaauugaugacggauaugcgaauagaaauuuuaugcaguuaaucaaugacgaugcacucucauuuaaagaagaaauagcaagggcucaaauuauuggggacgucgacgacauugcaaacguaguacacgacuuaccaggcucgccagcgaucaagaaagguauacugcagucaguaaaaauagucgaugaacuuguaaaagugaugggacacaaucccgcaaacauaauaauagaaauggcucgagaaaaccaaaugacagauaaaggaagaaggaacagccagcaaagacuaaaacuauuacaagacagccucaaaaaucuugauaauccaguaaauauuaaaaauguugaaaaccagcaacugcaaaacgaccgauuauuuuuauauuacauucaaaauggaaaagacauguacacgggugaaacgcucgacauaaauaaucuaucgcaauaugacauagaucacauuauaccacaggcuuuuauaaaagauaauucacuagacaaccgcgucuuaacaagauccgauaaaaauaggggaaaaucagaugacguaccaucaauagaaguaguacaugaaaugaaaaguuucugguccaaacuguuaucaguaaaauuaauaacucagagaaaauucgacaaccuaacuaaagcagaaagaggaggccucacagaagaagacaaagccggcuucauuaaacgacagcuuguggaaacacgacaaauaacuaaacauguagcacaaauauuagacgaacgcuuuaauacugaguucgauggaaacaaacgccgaauacgaaauguaaaaauaauuacacucaaauccaauuuggucuccaacuuccgcaaagaguucgaacuuuauaaagucagagaaaucaaugacuaccaccacgcacaugacgcauacuuaaaugcuguaguuggaaaugcucuacuacuaaaauacccacaacuugaaccugaguucguuuauggcgaauauccaaaauauaauucauauagaagccgcaaaucagcaacagaaaaauuccuguuuuauucaaauauccuuagauucuucaagaaagaagauauacaaacgaacgaagauggagaaaucgcauggaauaaagaaaaacauauuaagauauuaagaaaaguacucucauacccacaaguaaacaucgucaagaaaaccgaagaacaaaccggaggauuuaguaaggaaucaauacuuccaaaaggagaaagugacaaauuaaucccaagaaaaaccaaaaacucauacuggaauccuaagaaauacggcggauuugacagccccgucguagcauauucaauccuaguuuucgcagauguagaaaaaggcaaaucaaagaaauuaagaaaaguccaagauaugguaggaauuacaauaauggagaagaaaagauuugaaaaacacccaguagacuuuuuagaacaacguggauacagaaacguaagacuagagaaaauaauaaaacugccaaaauacagucuguuugaacuagaaaacaaacgacgacgccuccuagcuucugcacgagaacuccaaaaaggcaacgaauuagucaucccacaaagauuuacaacucuacuauaccauuccuaccagauugagaaaaauuacgaacccgaacaucgagaauauguagaaaaacacaaagaugaguucaaggaauuacuagaauacaucaguguauuuagcagaaaauacgucuuagcagacaacaaccuuacaaaaauagaaaugcuauuuuccaagaauaaagacgcagaaguuuccucucuagcuaaauccuucaucagcuuauuaacuuucacugcauucggagcuccagcugcauuuaauuucuucggagaaaacauagacagaaaacgcuacacaucagucacggaauguuuaaacgcaacacuaauacaccaauccauaacuggacuauaugaaaccagaauagacuuaucgaaauuaggggaagauuga

SEQ ID NO: 5325 - RNA, 4038 nt, Artificial Sequence
  Cas9 variant
augaagaaagaauacucaauagggcuagauauaggaacaaauucaguaggaugggcaguaauaaccgacgauuauaaaguuccagcgaagaaaaugaaaguuuuaggcaacacagacaaacaaaguaucaagaaaaaccuacuaggagcccuacuauuugacagcggugaaacagcagaagcaacccgccuaaaacggacugcaaggcguagauauacgaggaggaaaaacagacugcguuaucuucaggaaaucuuuaccgaggaaaugaacaaaguugacgaaaacuucuuccaaagacuagacgauucauuucuaguugaagaagauaaacaaggcucaaaauacccaauauucgguacguuaaaagaagaaaaggaauaucacaagaaauucaaaacaauauaccaccuccgagaagaacuagccaauagcaaagaaaaagcagauuugcgucucguauaucuugcacuugcucacaugauaaaauucagagggcauuuucucuacgaaggugacuuaaaagccgaaaacacggauguacaagcucuauucaaagauuucguagaagaauacgauaaaacaauagaagaaucacauuuaucagaaauaacuguagacgcauuaagcauauuaacagaaaaaguaaguaaauccuccagacucgaaaaucuaauagcacauuacccaacagagaagaaaaacacccuauuuggaaaccuaauugcacuaucccuaggcuuacaaccaaacuucaaaaccaauuuccaacuauccgaagacgcaaaauuacaauuuagcaaagauaccuacgaagaagauuuagaagaacuccuaggagaaauuggggaugaauacgcagaccucuuugcgagugcuaaaaaccucuaugaugccauacugcuauccggcauauuagcaguagacgacaacacuaccaaagcaccacuaagcgcaagcaugguaaaacgcuacgaagaacaucaaaaagaucucaagaaauuaaaagauuucauaaaagucaacgcccccgaucaauacaacgcaaucuuuaaagauaaaaacaagaaaggauaugcaggauauauugaaucgggaguagaacaagacgaauuuuacaaauaccuaaaagggauucuacuaaaaauaaauggaaguggugacuuuuuagacaaaaucgauugcgaagacuuccuacgcaaacaacgaacauuugacaacgguagcauaccacaccaaauucaucuucaagaaaugcaugcaauauuacgacgccaaggggaacauuauccuuuucuaaaagaaaaccaagauaaaauagagaaaauauuaacauucagaauacccuauuacguagguccuuuagcccgaaaaggaucacgauucgcaugggcagaauauaaagccgacgaaaagaucaccccuuggaacuuugaugacauucucgauaaagaaaaaucagccgaaaaauucauaacaagaaugacccuuaacgaucucuaccuaccagaagaaaaaguuuuacccaaacauagcccacucuacgaaacuuuuacagucuauaaugaauuaacaaaagucaaauauguuaacgaacaaggcgaagccaaauucuuugacacuaacaugaaacaagaaaucuuugaccacguuuuuaaagaaaaccgaaaagucaccaaggauaaacuauugaacuauuuaaacaaggaauuugaagaauuuagaauaguuaaucugaccggccuugacaaagaaaauaaagcguucaacaguucauuaggcacauaccaugaccuaagaaaaaucuuagacaaauccuuuuuagacgauaaagcgaaugagaaaaccauagaagacauaauacaaacucuaacacuauuugaagacagagaaaugauucgacaaagacuacaaaaauauagcgauauauucacaaaagcacaacuaaagaaacuagaacgaagacacuauacaggguggggacgcuuaagcuauaaauuaaucaauggcauacgcaauaaagaaaacaaaaagacaauccuagauuauuuaauagacgauggauacgcaaaccgaaauuuuaugcaacuaauuaaugacgacgcucuaucauucaaggaagaaauagccagagcacaaauaaucggcgacguagacgauauagcaaauguaguacaugaccuaccaggaucaccagcgaucaagaaaggaauccuacaaucaguuaaaaucguggacgagcuaguaaaagucaugggacacaaucccgccaauauaauuaucgaaauggcaagggaaaaccaaacuacagacaaaggcagaagaaauucacaacaaagauuaaaguuauuacaagacucucucaaaaacuuagauaauccaguuaauaucaaaaacguugaaaaccaacaacuccaaaaugacagacucuucuuguacuacauacagaauggaaaagacauguauacaggugaaacucuagauaucaauaaucuaucacaauacgacauagaccauauuauuccacaagccuuuauaaaagauaauucucuagacaauagaguacuuacuagaucugauaaaaacagagguaaaucggaugauguuccaucaauagaaguaguacacgaaaugaaauccuuuuggagcaaauuacuaagcguuaaauuaauuacgcaaagaaaauucgauaaucucacaaaagcugaaagaggcggccugacagaggaagacaaagcuggauucauaaaaagacagcuaguugaaaccagacaaauuacgaaacacguugcacaaauccuagacgaaagauuuaauacugaguuugacggagcccaacgacgaauaagaaacgucaagauaaucacccuuaaaucaaaccuugucucaaauuuccgcaaagaguuugaguuauacaaaguacgagaaauaaacgacuaucaccacgcccaugaugccuaccucaaugcgguaguaggaaacgcacuauuacuuaaauacccacaauuagaaccagaguucguauauggagaauaucccaaauauaacagcuauagaaguagaaaaucagccacagaaaaauuucuuuucuacucaaauauacucagguucuuuaagaaagaagacauacagacaaacgaagacggcgaaauagcauggaauaaagagaagcauaucaaaauucuuagaaaagucuuaucauauccgcaaguuaacauugucaagaaaacggaggaacaaacagggggcuucucaaaggaaucgauucucccuaaaggcgaauccgacaaacuuaucccaagaaaaaccaaaaauuccuacuggaacccaaagaaauacggcggauucgacucucccguaguggcauauucaauccuaguauucgcagauguagaaaaaggaaaaagcaagaaacucagaaaaguucaggacaugguuggcauaacaauaauggaaaagaaacgauucgagaaaaaccccgucgauuuccuagaacaaagaggauacagaaacguuagacuagagaaaauaauaaaacuaccaaaauauucacuauuugaacuagaaaacaaaagacgaagacuacucgcaagugcacgagaauuacaaaaagguaacgaacuggugauaccacaacguuucacaacacuauuauaccacucauaccaaauagagaaaaacuacgaaccagaacacagagaauacguagaaaaacauaaagacgaguucaaagaacucuuagaauacauaaguguauuuucuagaaaauauguucucgccgacaauaacuuaacaaaaauagaaauguuauuuucaaagaauaaagaugcugaaguaaguagccuugcaaaaucauucauaucgcugcucacauuuacggcuuucggagcaccagcggcguucaacuucuuuggugaaaacaucgaccguaaaagauacaccuccgucacagaaugccuaaaugccacauuaauacaucaaucaauaacaggguuauacgaaacccgaauugaccuuagcaaacucggagaagauuga

SEQ ID NO: 5326 - RNA, 4041 nt, Artificial Sequence
  Cas9 variant
augaaucaaaccaaaaacuaugacauaggccuagauauuggcguaggaagcguuggcuggacaauaaccgacucccaaucucaaaaaguacucaaaguaaaggggaaacaagguauuggcguacaccuguucaacgaaggccaaacagcagaagaacgacgucaauuuagaacaaacaggagaaggcucaagagaagaaaauggcggcuccgacuacuucgagaacuauucgaugaacccauauccucaaucgacccagaauuuuucgcucgucuuaaauacuuuaacgaaucaagcaaagaccccaaaaauaaggguuaucagccacagcuacacgacgacuuaaaagauguggacuuuuacagacaauaucccacaauauaucaccuacgacacgcauuaaugacccaaaaagaaaaauucgauauaagagacauauaucuagcaauacaccacaucgucaaauaucgcggccacuucuuaaugaacggacauagcaguaguuuuucuguugcccaaacagauuggaaagcggaccucacuaaacuauuugaacuaauccaagaaaccagaacuaacuuagacuuuucguucgaccuaacagaaauagacaccauaaaaucccuacuauuugacaagaaccuaucgagaaaugacagacagaaagaaauaguaggacugaucaacaauaauucccagcuagacaagaaagacaaagcacugacuaaacagcuaguagaaucagucgucaaaggaauuguuggaaugaaaacuagaacugacauacuccuaggcuacgaaguugauaacaaagaacaaucaaaggcuuggaacuucucaaucgaugaacuagacgaccaaauggcaacuauugacccagcccuuagccaaaauucacaagcacaugauauaaucacauugauccaaaaacuauauaugacaguacaauuagcgcaaauaguacccgaaggccaaucuguuucagaaaugaugaucaauagauacaaccuauacgccgaacaacuacagcaacucaaagauuacaagaaaauaaacuuagaaacaggccuauuacuaagagaagcauacgacgaauugaugaccaaagccuugacugcugcuccuggaaaaacgauacacgauacguuuuauaacaaagucaagaaaauccucaaagaucaagauaacaaacaagcucuaucaauaaaacaagccauagaagacucuaauuaucuaaucccccuccgaauuaaaaguaauggcgucauuccauaucaauugcaccaaagagaauuagacgcaaucauagaaaaccaaaaagaauuuuauccauuucuugcaacccccaacccuguagauggacaucaagaagccuuacccuacaaauuagaugaauuaaucggcuuuaaaguacccuauuacguaggaccaaugguagacccugaaguagacuccgaccaaaauuucgcuuggaugguacguaaagagaaaggcgaaauaacucccuggaauuuucauaacaaaguagacauaacacaauccgcagacaauuuuauaaaacgaaugaaaacgacagauacauauuuaauuggcaaagacguccuaccucaaaauucacuuuuauaucaaagauauaccguauuaaaugaauuaaauggcauaaaagucgcaaauaagaaacuaaccauagaacaaaaacaacgacuuuacgaccaacucuuuaaaaagaagaaaacugucaagaaacaagauaucuuaaacaaccucgucgcagcaggagaaauacacgaagaugacaauuuaacaggacuguccaacgguacaacauuuaacaacaaucuuggauccuauauagacuacugcaaaauuaucggacaagauaaacuagaagaugcaaguaaacaagcagauauugaaagaauaauugaaugguccacgacauuugaagacgcaaauauauuucugacaaaacuagcggaaaucaacugguuaacagaagaucagcgccaaaaacuaucgcaaauaagauaccgcggauggggccaauucucuaaaacccuuuuaacagacaucaaagauaacaaagacaauagcaucauugacaaccuaaugucaacuaagaaaguauucaugcaaauuauaaacgacacaacaauaaaacagaaaauugaugacuauaaccaauaucaccuaaaucacgcagaccuaaaagauacaaucgcuaacuuguuuaccucgccacaaaauaaaagagcaauaaaccaaacacuauuagucauugaagacauaaucaaugcagucggacacaaaccaaaucguaucuucauagaaucagcuaaagacaauagaaacgccaaaaaucaacuaacacaaucaagacuaaaacgcauaguaaaacaauucgaagacaauaaacagcacguugaucaaucaguauaugaggagcuuaaacaacuagacgacggaucacaugcauccaucgacgaccgauuauugcucuacuuucuacaaaacggcaaagauauguauacaggacagcccauugacauuagucaacuaucaacaagucaauaccacauugaucauauacuaccccaagcaaaaguaauggauaaugcacuagacaauagaguuuugguaucuagcaaagcaaacaccgaaaaaucagacagauucuuaagcgaaauaccucaauuccaacaacguucucuaugggcagaacuugaaagaaugggcuuccuaacgaaagcaaagaaagaacgacuucuaaugaccucagaugaauuuaaacaaaacucaguccgauucaucgccagacaacuuguagaaacacgucaaauaauuaagcucgucaaccaacuaauuauacaagaacaccccgagguaaagcuaguaaacaucaaagccgaccugacaaacgccuuuagaaagaaauuuaauuucgugaaaaacagaaacgcgaacgacuaucaucacgccuuugacgccuaccucacaaguuuaauaggaucacaccuauugaaaucgcaucccaaaugggaaccacuauucguuuauagcgauuaugauaaaauaaaauucgauaacgccccacaaggaguaaauauaaugaaagaguucgaacaaucaaaacuugcggacgaaaauggagaaauaaucuggaacaaagaugaaaugauggcauacuuggaacgacuauauaacucacgccaaauacuuauaacaaagaaagucuacgcacgacauggcaaccuauucaaacaaacuaucuuuaaagcuggcgaaagugacaaccucauaccagucaaaaauaaucguuccgacauagccauauacggggguuacaaaucaaaacaaguuuccuacuaugcucucauaucacuacauaacaagaaaagacagaaacgccuaguagcaguauauuugauagacauacaaaaauuacaaaacuuaaacgaaucagacuauuucaaaacacugcauacuaucauaaaagaacgacacaacaucaaaccagaauuugacauacuagcagauaaaauauaccaaaaccaacuaauaauagauaauaaaaacggcuccaacagaccauuccgaaucgaaggagacuucaaaaaugaucgacaacuguauuugccccuucaauaccaaagauggcuagccucaaaagaaccaacugacgaaaaacuaaauagaauauucgaucacaucugcgaacaacucgccgauuauuuuccauuauuugccggaaaugcaugcgacaaacuucucgacaauagagauaaauuuuaccaacuaucaauaaaaagcgaguucaacgacaaaggcaaacuaauagcagaaggaaaacuaucaguaauagauaaauuacucguagcaaugcacgcagacucgcgaaauaguaaucuagcagugauuggacuaaguaguucauggggcagauucaaacuucacggaggaaaugaagcuauaggcacaucugugcaauuaauacaccaaaguccaaccggcuuauucaaacgaauacaacgauucaacuga

SEQ ID NO: 5327 - RNA, 4041 nt, Artificial Sequence
  Cas9 variant
auguuaucagcagggguaauguuaggugaugucucagcacucaagucaaguagaaauucacuguuucaaaaaucuaagaaauuaauagaaaauucaucaucugaccucacuaaagucgauuauagcaaaaugcgagaaauacuauuaucaauucguaacauagccauaagauucuucaauaaugaagauuuuaaagaaagcgauuauuauaaagaguucccaaccauauggcauuugaggaaaaaccuaauggaaucugauaaaaaggcugacauaagauuaguauaccuagcacugcauaauauagucaaauaccgaggaaacuuuuuacaggaaaauaauaaagaccuaagagcagcuaacgcaaacgcuggugcagcagcaauagacuuaucuaaugcacuagaagaauacuucucacugcaugaagaugaaucugcauugaccuguguacccaauguagcagacuuacaaaugaccuuagaacaaccaggacuaagaaacggagaacgauuagauagaauagucgcagcacuaaauaugccagacagagcuagagcaaaauuauucgcuaaggcuuguauaggucaaaaaguugaauuuagcaaauuggcccuuggaauggagaaacaagaaggcacgaaugcauacauaugggaugacgauaaauacgacgaauuaguagcucuaugcccagaagacuucuucccaguacucgaaacacuuaaaaacgcuuacagugccuauguuuuaagcgacuuauuagcaggaaaacuaucgauaucugcuucguuaauagauucuuacgagcaacaccaaaaugacuugaaaaucguaaaagagcuaguuagagaauacuuaggacaaaaggaauacggacguuuauucagaggaccgaaauuugcaaacggagacuacaauuucaauaaagucgcaaagccaucauacacaagcuacauacuaggcgaaucacugugcaacaaacagggaacaacaagagaagaauuagucaaagaacugaaacguguauucgaugauuguagcgcgauacaagcagauaaaagauaccagaaaauaaaacaacgcuuagaagaugauccaaaauuccugaucaaacagaaaacuagggcaaacggagcuauuccuuaucaauuacaccuagaagaaaugcaucaaauaauagaaaaacaaggaaaauauuauccauuucugguagaacaacaagaucuuauagaaaaacuuguuagcucucggauacccuauuauguaggcccauuaaacggaggacaugauccaaaucaucccuauccuaccaauccaauagaccccaaacggaaauucgccuggucaguccgaaaaccagguauggaacacgaaaaggcuuacccauggaauguagaugaggucauagacuccgaagaaacagcggaacgcuuuauuagaaggaugacaggaacuuguacauaucucuauggggagccuguaguaccccgauguucauuauuauacgaagaauuuugcguauuaaaugaauuaaauggugcaagauggggagagggaaauggcgacacucauagauuugauaguagcgauagaacagaaauauuggaacaacuauuuaagaaacgaaaaagaguaacacacaaagcaauagcuacauggcuagagauuaaucacgguguaacaaauguaaaaauuucugguacacaagcugaaaaugcauuugaaagcaaacuuagcucauauaacgauuucuguaauuugcugggaguugacggucuagaagauguuugcccauuaacaaaagaugauauagaacaaauaauacuauggguaacugucuuugaggauaagaaauuauuauuacaaaaacuucaaagagcauuuggagauaaauugucagaaaaacaaauagcaucaauaaugcgcaaaccuuaugcaggguggggacggcuaucuucaaaauuauugacagguauuaaaagagaaaccccauucgguagaauauccauucuagacguuaugagggacggcgacccacgaccuggccaccauuuggaugcgaugaauuuuauggaaauacuaagagaaaaagacuucggauuucaggauagaauagaugaaauaaauaaagagagaacuaaggaaagugggcuccuccugucaguagaggaucuaccaggaagcccugcauuacgaagaagcguuaaucaggcaaugcacauauugaaagaaaucguaucaauugcuggcaaagaaccaagccgcauaguaauagaaguuacgagagacccagacgaagagaaaaggggacaucgcacugauacaagauauaaacaauuaagcgaagcauuagcagcgaucaaaacggacauaguacaauuugacucaucacuacuagcagaacucaaggaaagaaaggacagucuggauucagaacguuuaaugcucuauuuucagcaaugcggaaaaucucuauauagugggaaaccacuagacauaaaccgauuaagugaauaccaggucgaucacauuaucccacaauguuacauaaaagacgauaguuuagacaauaaagcccuuguauuugcaagcgaaaaucagauaaaauuggauagcuuguuacuagacaaaucaauaauuagaucucaaaaagggagauggcaggaacuccacagggcaggcuuaauaucaaacaagaaauuucgaaacuuaaccugcacugaaauaucagacagaaugaugaaaggauucauaaacaggcaguugguagaaacaucacaaauaguaaaauuugugcgacaaaugugugaacaacgcuaugaauccuccgaagugaucucacugagagccagucugagccauaaccuaagagacagauguggcuucauaaaauguagagagcugaaugauuaucaucacgcacacgaugccuaccuagcuugucaaauugcaagauucaucggaauuagauaucccagauggcaggacggaauaucaagagaauuuauaaauaaguacaucaaacaauuagucaagaaaggaaaaagcucaggcaaauucuuugcaggaaaaucuggauuuauaauagauucauucaugcaugacggcuuugaucgagaaaccggcgaaauauuucgugauggaugggacgcaacuuucgaaauaacgagaaugcgaaggguauuaggauauaaagauugcuucauaacaagaaugccagaagaacagacaggagccuacugggaagaaacaauauacucaccauuggacgcgaaaaacgggaaaaacuugcaaauacccuuaaaacagucaggaaaggaaggauauuuggauccaaagaaauacggaggaacaaacaccgcuuuuaaugcauauuucuuugcauuugucgcaaaagaugcaaggggaagggacaaauauuucuuugaagguguaccgguuuauuuagcaaaacaauugaacgaacaaccacaaauauuaguugauuuugcuaauagcauagcugcgacuaagaaaugcagcacagcaaaaauacuaaggucuaaaguuccuuuaaggcaaaaauuccucuuagaugguacaaguuucuauuuaggcggacgaacuggcaauaaaaaugugauacuaagcggcguagaguuugcaugcgguauugacauggcaaaaaugauagauacugcgauaaaacacccggaggaauuaucucaaaaagaauuaauaucuauaauacaaauguuagcagacacaauugaaagaaauucggauagacaagcaagccuuauaaauuuuagaagguuugacgauaaauuaagaaauaucgaugcaaucgcugcauccagaauaauaaagaaucuacucaauucuaugaaugggguuaaacagagcugcgaucuaucagauuuaggagguagcaaacaaucagguuuuaugcaaaguaauauagcaacucuauucgaaagaauuacaugguguuauucaaguauuacaggaauguucgaacaacgagugaguuucgaagaucugaaaaacggaaucuga

SEQ ID NO: 5328 - RNA, 4041 nt, Artificial Sequence
  Cas9 variant
augaaaaaaagaaacagagaggaauacuacguaggacuggauauaggaacgucaucaguaggcugggccguggcaacaccagacuaucguauaccgaaauuccgcggucacaaaauguggggaucaagacuuuuugccgaaggaaaacgcgcagcagaacgaagacaauuuaggacaaacagaagaaggcuagcaagaagacgagaucgacuccaaauucuggaagaauuauuugcugaagaaauggcuaaaguugauaauacauuuuucaugagguuaaaagaaaguaaauucuucuuagaagacaaaacagucaaagagaaacauaucuuauucucaacugacaaguucgacgcagaucguuuuuacaaagacaaucccaccauauaucacgucagaaaaagacucauggaagaggaaccucaagauauacgagaauuauuucuugcaguucaccacauauugaaguacagaggccacuuucuguucgcagggaguuuagaacaaaauggugauaguauugaagaacucgugagaacacuauucgguaaacaaggccuagccauucuugacgauacaauagacucuaacgaaaugguaaauauauuaaaaaauaacgaaaaaacaaaaucagauagaaaaaaggcaguacaggagcuauggaacccccuuaaagacaaaguuaaaaaagcucaagcugcugaaauggccggcguaguuuuagggcuaaacuccgacaucucgaaauuguuugacaauuccgauuauaaagacuugaaaauaaacuucaguucaggagacuacgacgagaaaagagacgacuaugcuaacucuauaggagaugacauuguguugcuagauaccaugaaagcacuuuacgacacacuaauacuaucccagauauuacaaggaaagcaauccauaucagaagcuaaaguggaagauuauaacacccauaaagaacaacucagggcauuaaaagcaauucucaaaccacauaaaagguuauauaaugaaauguucagagaaaauaauaaaaaagaccuaucuaauuacguagcuuacauaagcucauacuccgaaggaaaaaggguaaauagagaaggguuuuauaaauauguacaagcagucuuaaaacaaguagacgauagcgacucaaaacaagcgauauuagaagcgauacgacuagaaaccuuccucccucuacuucgaguaaaggauaacgccguuauaccacaccaaauucaucaagcagagcuugaagcgauacucgagacagcuagaaagaaauauaaauuccucaacgauguuucagaagguguaagcgucaaagauaaaaucauccagcuauuuaccuuuagaauucccuacuacguaggaccucugaauccacacaguggagagacaguggcagacagaaaacaagguaccggcuggguaguuagaaaacaaagaggaaaagucuacccauggaacuuugcugauaugguagacguaaaggcaucagcugaagcuuuuauaacuaaccuaacaaacaaaugcacauacuuaaucggcgaagacguauuaccaaaacgaucauuacuauacucugaauuuauguuacuaaacgaacuaaauaugauaaaauaugacggacaugaacugccuguugaaaucaaacgacuauauauagaacaagucuucaaacaagaacacaaaaagcaaacaaaaggaagaguacuagauuuccuuaaacggaauggauuaaucacaggauccgcaaccgcagucaucaccggaauggacgauucaauaaaaggcgaucuccagucguacagagauaugguacgaauauuugguaccggguucgaccacucaauggccgaaagaauaauaagguggguaacacuguucggugaagcaaaagacauauuagaaaauaagauaagagaaguauauggcaauagcauuuccgauucacaaaugagagcuauuaaaaaacucaaauacgccgacuggggaagacuaagucaagcauucuuuauaaaaauaauaggaugcgacaaaucaggaguagaacgaaacauaauaaccugucugagagaaaguucccagaauuuaauggaaauauuaucagaccagggaaccuauauaaaacaaauaaaagcauggaaucaucagcauacaacaaacaugauggauacucuagacuaucaauuagucgaugacuuguacguugccccauccguuaaaaggucaauuuggcagucacuauguauaguugaagaauuaguaaaaauaaugggucaagccccaaaaaaaauauucguagaaguaacuagaacaaaccaagcagaaaaaaccaagaaagacagucgcaaaaaaagacuaguagaacuauacaccgcaaucggcaaagaaggagcagcuuggaaaaaagaaauagaaaagcaccaagcaggugauuuucgaagaaaaaaauuauaccuauauuacacucaaaugggacgauguauguauucacaugaaccaauugcuauggacgcacuuuucacgucagaauacgacauagaccacauauacccacaaagccucacuaaagacgauucaugggacaaccuagugcuaguaaaaagucagcucaauaaagaaaaaucugaccaauacccccucaggccggcaauacgagaaaagaacaaagcauauuggcaauaucucugcagggcagguuuuauaagugagaaaaaauaugaaagauuaaugaggacgacagaacugacagcugaagaacuaagugguuucaucgcacgacaguuaguugaaacaagucaagcuaccaaagcaguaauuggacugcuugaaagaaucuacaaacauacggacauaugcuucgugaaagcugaaacaguaucccaauuucgacaucaacacaacuuuauaaaaauaagagaacuaaauaacuaccaucaugcuaaagaugcguaucucaacauagucguaggcaacguauaccacgaaaaauuuacaaaaaauccaagagaauuuauugcaagaucaaccgaacgaagaccauacaaucucaacagaauguacgacuucgacuuacucaaacaaggcagagugauauggcaggucccaaaaucccuggagaccguacaagccaugaugaaaucaaaugacguuagaauaacaaaaaagcuuuuaguccagaagggcgaacucuacgaugcaacaauuacaaaagcacauaaaacuaaagaaggaauguacuucccacugaaaggggcugaugcaagacuacgcgauguucauagauacggaggauacgagaaaauaaagauagcauauuacucaguauucagcugcugugagaaagccagcgauacgauacauacacucauuauccccauaccaguauaugcagccggauuacuacagacagaagcagauuuaacagccuacgcuuggcagacgaagcaaaaaacaaaaccaauaaaagauaucuauucuaugauaacaccaauauacaagaaacuuuguauaaacacaguuguuaaaauugacggauuuaaauauuuucuagguggaagaacagaagacuauauaugcuuauacccagcuauuccagucguacuugaugaacaagcggcagcauaucuaaaagcaguaagcaaaguagguagagcugacgauguagagaacaccgcucaagcaauagaccuaauaacugcugaagcgaaugaagcauucuacgacguacuacuaaaaaaaauggaagcaaaaauuuuuguuaaagccuaccaggaaagaguagaaaaauuagcaagcgaaacggcucgagaacgguuucggaagcucuccauaggagcgcagugcagcugccucuuagaaauacuaaacuugcuagcaaauaacaaaacaacuuccaacuuaaaaaaauggcuugggguuacuaugagcagaagaaaacaaccaauggacuuaacaaaacucgaagaguguauaguauaugaaacauccauuacaggauuauacgagaaagcggugucauuacuauga

SEQ ID NO: 5329 - RNA, 4041 nt, Artificial Sequence
  Cas9 variant
auggucgaacacuacgcaauagguuuugacauaggaacuggaaguaccggcuuugcgggcguagaucccaauggaaaauugguacguaugcgagguaaaaacguauauggaguauauagguucaaaggaggcgaagccgcggcagaccgaagaggauuuaggacaaccagaagacgcauuaaaagacgaaaauggcgacuaagauuucuaaaaucuuucuuugaaccauauauugcaccuaucgaccccgaguuuuuccuacgucaaaaauauucggcugacucaccacuagacccgaaaggaauacgggccgauaaaggacuguuaucagacaugucagaucaagaguuccaugcuaaauauccaacaauuuaccaucuaagauaccaacuaaugcacgagaaaagacaauucgacguacgcgaaauuuaucuagcaaugcaccacaucauaaaauacagaggacauuuccuuauagaagacggcgcagauaauuucgaugcaaaacaaauugacuucuuugaccaguuccaaagaauggcagcgguuacagcaggacucccagaacuagaaacuuuaguaguuccagacgaaacucagucagaugcuuucaaacguguacucuuugacgaaagccaaacuaaauccgauagacaaaaaguacuagccagccaacuauuagacauacaagacaaccaaucaaaagcaaucaaagauuuuauagcagcacuaacuaaagcggucgucgguaugaaagcaaaucuugccacccucacuuccacagccauagaaaguacagauaaaaacgauuggacaaaaccgcuaggacaauuagacgauuuccuacucaaacaugaagaagacuuagacgaagacggauacgcuuuaauugaugcugcaaaucaaauguacagugcugcaguacuugcagcacucgucccugaagggaugggauuuucagaagccaugauggcuagguacgcccagcacaagaaacaauuagcacuauacaaacaaguaauagcgagucuaccugacaaaacucaaagacacgagcuaaaagacgcauaugcugauuauauagagcacgcagcucaaaauccacgcgaugcuuucuauaaaagaguaacuaaagucuuggaagguguagacucagcagacgcccgcacaguaaugacagcaauuagccacgacgaauuucuucuaaaacaaagaacacuaucaaaugggaaaaucccauaccaaaugcaacaacacgaauuugaugcuauuauagaaaaucaaaaagcauacuauccauggcuggcaacacccaauccagucgaagcagacgcaaaacgauugcccuacuaccuugacgaauuaauaggauuuagaguaccauauuaugucggcccgaugguuacugaaaaacaaucacaauuugcuuggaugaucagaaaagcagacggagaauuaacaccauggaacuucuucgauguaguagacagagagaaaaccgcuaauagauucauccagagaaugcaaacaacagauaaauacauucuaggcgaagaugugcuaccaaaacacagcauucuauaccaacaauucgaagucuuaaaugaacuaaauaacauucgaguggaaaaacacccauuaacaaccgaacaaaaacaauuuaucuaucaaagauuauucguugaccaacagagaaaaacaauaaccaagaaaaaucuacaagauacccuuguagcuaugggugaguucgacaaagcgccugauauaggcggacuagcuaaagaagauguaaugaugucuagcuuagcuacauuugcagacuauucuaaaauacuucccgaagccauuucagacccuacuagacaaaacgacauagaagauaucaucgccuggucaacaauauuugaagauacacagauauucuuugauaaacugaaaaccguugacuggcuaacaacucaacaacguaaaagauuagccucaauuagauacacuggauggggaaaacuuucaaaacgccuauugcaacaaauuccuacaucuaaacacacaaauguaauggcagcauuaugggcaacaucagauaauuuuaugcagauucuucaagaugaacaauuucaagaagggcuguacgacgcaaacagauuaccagaagaaacacucacucccgacgaacaggucgagaaaauacucgaugaagccuaccuaagcccagcagacaagaaaggagcacgcaaagugauaaaagucaugaacgacauuguaagggcuaaucauggaguacuccccgaacaaguuuuucucgaaucagcagacgauccacagaaaaauaaaaggagaagcguuagucgaucaaaacaauuagaagaaaaauaucgucaagcagcccaaucauucauugacgaagccgugaaagaagaauuaaacgcacaaauagucaauucagcugaauuuaacgacagauuaguauuauacuuuacucaaaaugguagagacauguauacaggaaaaagacucgacauagaaaaucucgguucuuaccaaauugaucacauauuaccucaauccuuaguaaaagaugacucccuagauaauagagcgcuaacagcacgugauaucaacgcagaaaugucuaaccaauuugugucugaaagauuuggauuaggcccaagagcauuuuggcaacaacuuaaaaauaauggacuaauaucuggcagaaaauuucgaaaucuaguuaugcaacgcgaugaaauugacaaauacgcacccgguuucauuaaucgccaacuggucgaaacaaggcaaauuauaaaaacagucgaacaaauuauucaucgcuuauggccugauauccaaaucgugacaauaaaagcaaaucuuacacaucagguacguucugaauuaggguucccuaaaguaagggagcuaaacgacuaccaccaugcguucgacgcccucuuagccgcaagaauuggucaauacuugcuagagcacuacgcaggucuuaaaccauucuucacuuacggggaauuuaaaagaggcgacacuaagaaauacggaacaacaaacuucuugagaagauuaacaaaagacaauaaagacaagaaaggagaacuuuugcccgaaguaagcgacuggauagacagcauagauaguauuuacaauuacaagaaaauaccaguaguaugggaaaacacaacaaacaugagugcacuguuugaccaaacuauauauccgagaccagaccgcgacacaacaaaaagaaaacuuauaccuacaaaauuagacaaaccuacugacauauauggcggauacaguucugccaaaacagcauauauggcaguaaugcgaguacaaacuaagaaaggaacugaauacccaguauuuaauauccccguuucuauagcgagucaacuaaaucgcauaacagaccaaacaaugcucaaacaacaagugaaacaguucauaaucaaugcggaacaaucugcuaguaaaaagaaacuuuacgaaucaggagacguuauacuaucaagaguagcauugggacaaagauucacagauaaaaacuacggagaaguauucuuaauauccaauauggaaguacagaauccccagucuuuaugguuaggucgcgcuucacaacaacgucuaacacgagaacccgaagguaacgaaaaaccagaaaccucucuugcagacaucuaucagcaaauacuaaaacaagucgauagguauuuucuugcauucaacauacgacaacaaagacaaaaacuauuagguacucuugaucaauuuacaucgcuuccaguaggaagaguuaacgagcaaaccagaaccgaucaaaaccaaagaucuaucaucgcacgaguaaugauaguacuaggcaaagguucaagggaagagaaauuuccagaauuuggacuuucagcuuuaggucgauuagucagaacaggcggaauuacacuguccgaagacgcacaaaucaucuaccaaucaccaacaggcuuauuugaacgacgcguagccuugaaagaucuguga

SEQ ID NO: 5330 - RNA, 4041 nt, Artificial Sequence
  Cas9 variant
auggcaaaaauauuaggacuggaccuaggaaccaauucaauaggaugggcgguuguugacauagaaaacaauaacgaauuuacacuuauagaaaaaggagucagaauauuucaagaaggaguaaaaauagaaaaaggaauagaaggaagcaaagcagcagaacgaacaacuuauagauccgcacgaagaauaaaauaucgaagaaaacugcgaaaaauacaacuauuaggcgucuuauccgaaaacggauacuguccguucuuguccaaagacgaauuagacucauggagauacaagaaaguauaucccacaaauaaaucuuuucuaaauuggcagaaaaccaaugaaauacaacuagaaaacccguauuuuuacagagcccuuuuaguagagaagaaacuaaaccugaauauagaagaagaccguuuuaaaauagggagagccuucuaucaccuagcucaaagaagagguuucuuaagcaauaggauggaaggaacuaaagaaaacgauggaacuguaauaaaaucaauaacagaaaucucaacagcaaaaggagacaaaacacuaggucaauauuucuacgaacgauacaagaaaggagagaaaauaagagauacauacacacacagggaagaacacuaucuagaagaguucguccguauuugugaauuucaacaacuggacaacaaauucgcggaaaaaguaagaaaagcuauauuuuaucaaagaccccugaaaucucaaaaaggacuaauaggcaaaugcguauucgaaccuaagaaaucucgcugcaguguaagucgaccagaauuugaagaauaucgaaugcuaugcuuccuuaauaacauaaaaauuaaaacaccaucagacgaaaauuuaagauuuuugacagacaacgaaaaagaaaaacuuaaaccucaauucuuucgaaaaucaaaagaucacuuugacuucgaagacuuaguaaaacaacuagcgccaaagaaucaauucaaguuuuacaaaucaagagacauauugccagguaacuggcuauuuaacuacagcaugaacacuacgguauccggauguccaaucucggcaagacugaaagaucucuucggugaaaauuucauggauauaaaauucgacuauaucagagaaaaagaugggaaaaagucaguaaucgacauacaugacauuuggcacguccucuucaccuacgacucugaagaaaaauuaaaagaauuugcccggaacagauuaaaccuagacgauauaaaaauaaaagaguuccaaaggauucaacucaagaaagaauaugcagcguuaucgcuuaaagcaauaagaaaaauucuaccauuccuacgagaaggacucauauauucacaugcuguauucaucgcaaacauggaaacagcaauucccucagaaaucuggaauaauuauaccaacaggaacauuaucaaaaacgaaauauacaacauaaucucaaaucaaacugaagauaaacaaguaguugacaucguuaacggaauaauuaaaaguaguagaauagaaaauagcguaugguccaacgaagcuguagaauuuuucaagaaagaucuaaacaguaaaauuaagaauuacuauggaauaaagacauacaacgacuuuccagaagaaaagaaaaucagaauagaaaccuacgcguucaaucuauuuaaacaacagaugaugaaaaacuuuggaaggggagaauuugcagcgguucaaagaauagacgaacgccuuaaauuauuuuuaacagacaacuucaacauagaccccauacuacucaagaaaauuuaccaucccagcgccauagaagucuaccaaccacccguaaggaaaaacgacggcaaauuauacuugggaucuccuauggugaguuccauaagaaacccaauggccaugcgugcccuccaucaauuaagaaaauugauaaaugaacuuauaagaaaagaauugaucgauucuaauacaaagguuaacauagaaauggcacgagaacuaaugaacgcuaaugaaagaaaggcuuaccaaaacuggcaaaacgaccgcgagaaaauaagaaaagaauacgcacugaaaauaaaacaacaucuagacgucgacaaagaaccauccgacguagacauccuuaaauaccaauuaugggaagaacaaaaccacaaaugcauauauacaggaaaagaaaucaacauaagcgacuuccuugggagcaacccuaaauucgacauagaacauacaauaccucgcucaaucaguuuugauaacucucaauccaacaaaacauuaugugaaaacuacuucaacagaucaguaaagaaaaaucgaauaccagcugcacuaccaaaccauggcgaaauaauugaaagacuagaaaacuggaaacugaaauaugaagaauuagaaaaacaaauacaauacgcaguacgacaagcaaaaggagcaggcgauaaggauucuaaagauagagccauacagaaaagacauaaacuuaaauucgaauaugauuacuggaaaaacaaauacgacagauuuguuauggaagacgucccagaaggauucaaaaacucacaauugguugauacugggauaauuacaaaauacucaaggauguaccuaaauacguuauuugacaaaguauacacaguaaaagguaacacaguagccgacuuccggaaguuguggggcauucaagacgaauaugaaaagaaagcucguguaaaccauucacaucacuguguugaugccauaacaauugccugcauaacgaaaaguaauuaugaaaauuuagccaaauuuuaccaugauugggaagaauuacacguaaagggaauugaccaacuaccaccaaugaacaaaccauggaaaaccuuuacagaagacaucaaagcaauacaauacgagauccuaguaagccauuauacacccgacaaccuuccaaaacaaucaaagaaaauacuucguaagaaagggagaauacagaaaaaugagaacggaaacccaauauaccucaaaggagacacugucagaggaucacuucaccaacaaacauuuuauggcgccaucgagaaaaccgaagugaauaagaaaggagaacccgaaaaaguaaucaaauacguuguucgaaagagccucgacguacucgacgacuccucaguuaaaaacauaguugacgauaucguaaaagaaauaguccaaaacgccaggauaaaagaaaaagauuuuauaaaagagcuugaaauacaaaaacgaaaacuagcaaaagcagaagaaaacaagguaguccaaauacaagccgaaauagacaaacuaaacaaacaagucgcggaucuguauacuaugccuaauaaaaacggaaauccaauaccuaucaagaaaguaaggauauuccagacuucaguaacaaauccaauccaucucaaacaacaaagagacaaaagccagaaaacuucgaaaccacauaaagaguucuacuacgcugcaaacgacucaaacuacaugauggcaaucuacgaaggcaaagacgaaaaaggaaaaguuaaaagagacuucaaacuauugaacaaucuagaagcaggagaguucuuuaaauacagcguacacaaagaucuaaaagagaaaaauuuagaaaauauaagaaauguuauaccagacaagguaagcgcaggaaaaaucgaaaucccauuaaaagccauaauaaaaacaggcacaaugguaauacucugggaaaauagcccagaugaagugugggaucucaccauauccgaaguagauaaaagauuauacaaaguaguaggaaugucagucaacaggaucaaaucagauguaaaaacauucgaguucggaaacaucguacuacgucauaacaaagaagcaagucccgcuacuuugcuuaaaauacaggacggagaguucaaaucagacgaaaacuacauagcacaaagaaaacuaucucacaaccaauucaacgcucuagucgaaggaguugauuuuucguuaaguguacuaggugaaaucaaacgacucaaauga

SEQ ID NO: 5331 - RNA, 4044 nt, Artificial Sequence
  Cas9 variant
augggagaagaugggaagccaguacguguaaaaggaaaaacagcuauaggugcacgccuguuucaagaaggacaugucgcagccgauaggcgaauguucagaacaaccagaaggagacuaaacagaagaaaauggcgacuaaaauuauuagaugagauauuugacccauacauaaccccaguagacaguacauuuuucgccagacuuaagcaaagcaacuuaucaccgaaagacucuaggaaagaauucaaggggucaauguuauuuccagaucuaacagacaaacaauaccaugaagacuacccuacuauauaucaucuacguagagcuuuaaugacagaagacaagaaauuugauaucagaaugguguacuuggcaauucaccauauugucaaauaccgaggaaauuuucuaaacagugcaacgguagauaccuuuaaagcgucgaaaguagauuucaaaaaauccuuuaaccaacugaacgagcuuuauucagccaucaacccugaagacgcauuccaaguagauaugaauaaaagugaugaaacuggucgucuauucuuagacucgucaauccggaaguuugacaaacaaaaacaaauaucaaaguuaauaccaguagugguagaagauaaagaagcaaaaaagcuaaacggcaaaaucgcacuagaaauaacaaaagcaauucuagguuacaaaucgaaacuaaauguuguaacacaaacagaaccagaagacccaaaaaaaugggccguaaaauuugaugacgaagauaucgacucgaaacuuaaugauauucucccagaaauggacgaaaaccaacaauccauagucgaaauuauacaagaucuauauucacaagugacucugaaucaaaucguccccaacggaaugucauuaucugacaguaugauaaaaaaauauaacgaccaccacgaacaucugaaacucuacaaaaaacuuauagacaauauaagugauaccaaaaaacgcucugcgcucaaaacagcguacgauaaauacguaggugaugauggaaagacaauagaacaagaugaauuuuacaguaacgucaaaaaaaauuuagaugacagugaucuaaguaaacaaauagcagauuuaauagaagccgagaaauuuaugcccaaacagcgcacaagccaaaacggaguaauaccgcaucaacugcaccaaagggaauuagaugaaauaauagaacaccaaucaaaauauuaucccugguucgcggaagcaaauccaaacaaacaugaccuccaccuagcgaaauacaaaauagaagaauugguugcauuccgcaucccauacuauguuggcccaaugauaacuccagaagaccaagaaaagucuucacaaacuauauuugccuggaugaagagaaaggaaccagggcaaauuaccccauggaauuucgacgaaaaaguagacagaauggaaagugcaaaucgguuuauaaaacguaugacaacaaaagacacauaccuaauuggcgaggacguacuaccagaucaaucacuacuuuaugaaaaauuuaagguacuaaacgaacuaaauaugguaagaguaaacgaccacccuuuaaaagucucugaaaaacaagcgauuuauagagauuuauucgaaaaucaaaaaagaauaucaguuaaaaaucuucaaaauuauguaaaaaguaaaagcggauuaccaacgggacccaagauaucgggacucagcgacccggaccacuuuaauucuagccucggcacuuauaaugauuucaaaaaaauguuuggagacaaaguggaugacccagaucuucaagacgacuucgaaaaaaugauagaauggucgacaauauucgaagacaaaaaaauacucagagcuaaacuagacgaaguagcauggcuaagcgauacgcaaaaaaacgaauucaaagaaauuagauaucaaggauggggcagacuaaguaaaaaauuacuuacaggaauagucgauggaaauggacagcgaaucauagacgaacuauggaacacaaauaaaaauuucaugcaaauccaaucggaugauucuuuugcaaaacggauacacgaagcgaacgcuaaucaaaugaaggcaacagacgucgaagacguccuagccgaugcuuauaccuccccacaaaauaaaaaagcaauaagacaaguaguaaaaguagucgaugauauucaaaaagcuaugggcggaguugcucccaaauucauaaguauagaauucacacgaagcgaagaucgaaacccaagaagaaccauaucgagacaaagacaacuagaaaauacccucaaggacacagcacaagcacuugucaaaucaauaaacccggauauacugagugaauuagauaaugcauccaaaucaaaaaaaggguuaacggacagauuauacuuauacuuuacacaauuaggaaaagauauguauaccggaaaacccauaaauaucgacgagaucaguaacuaugauaucgaccauauauucccccaagcauuuauaaaagacgacucacuaaauaauaggguacuagucagcaaagcaggaaauaacgguaaaucggccaacguaccacuaaagcuauucggagcuaaaaugggugguuauuggaaacaacuagcagacgcaggucuaauaggacaaagaaaauuaaaaaauuuacaaacaaacccagacacaauaaguaaauuugcuaugcacggauucauaagacgccaacuaguugaaaccagccaaguaaucaaauuaguggcaaacauacuaggugacaaauacagaaacgacgacacaaaaauaauagaaauaacagcuagaaugaaccaucaaaugcgugaugaauucggcuucauaaaaaacagagaaauuaaugacuaccaccaugcuuucgaugcauaccuaacugccuuuuuaggccauuacuuauaucaccgauacauuaaacuccgaccauacuucguauauggcgauuucaaaaaauucagagaagacaaaguaacuaugagaaauuucaacuucuuacacgaccuaacggacgauaaacaagaacgcauagcagauacugagacuggagaaguaaucugggaucgcaaaaggaguauucagcaauuaagagauguauaccacuacaaauuuaugcuaauaucacaagaagucuuuucacucaacaaagaaauguucaaacaaaaacuauuccccgcaacacuagcuaaaaagagcaaauuaauccaaauaaaaaaggauaaacccguugauauuuacggaggauacuccaauaauaccgacgcauaccuaaccguuguuaaacuuaaaggaucaaaagaagauaaauacaaaauuguaggaguaccaaugagggcacuagauaacuuaaaacacgcugagaaagagucaccccaaucauauacagcugaacuccguaaagcauuagaaccacaauucacaaagauaaaaaaaaacagaaaaacaggugaagugucaaaaguuguuacgaacuuugacauuguauuaggacgacucuucuaccggcaaaugguuauugacggaagcgaaaaaucacuaauagccucuagcguguaccaauacaaugccaagcaacuaguccuuucagaucaagcaaucagaacaauaucagaucaggaaggaauagacgaauuugaauuaaguucgcaauacgacaaaguuuacgacgaaauaguacagaaaguugaaaaacuacuucccauauuucaacaccgacauuuucaggagcgcuuaaauaacggcaaaucucuauucguaaauuugccaguacacgauguuuacgaaggaaauaagcucgaacaagucgggaaaaaacauauaauuaauucaauacuaggaggaauccacgccaaugccgaccgaccagauauugacuuauuuggcauaaaaaauuuaggacaguuuucaucuaccagcggaauaaaccuaucaucugaugcgaucauauguuaccaaaguccgacuggacuauuugaaagaagaguuguucuaaaagacuuauga

SEQ ID NO: 5332 - RNA, 4044 nt, Artificial Sequence
  Cas9 variant
augacaaagcgcgaagaacccuacaauguaggauuagauaucggaucaagcucaguagggugggccgucguagacaacaauuaccaucugcuaaauauaaagaaaaauaauuuguggggagcaagacuauucaaagaagcugaaacagcacaaguuacccguggacaccgcucaaugcgaagacgauauagacgucgaagaaacagauugaacuggcucgacgaacuauucgcagaugaauuagcgaagaucgacccauccuucuuacuaaggaugaaaaacucaugggucaguaaaaaagaaucuacccgcaaaagagacccauacaaucuauucauagaugaaaaauacaaugacgucgauuauuucaaccaauacccaacaauuuuccaucucagaaaagaacuaauaacugaagacaaaaaaguagacaucagacucaucuaccuagcaauacauaauauaauaaaguacagagguaacuuuacccuagaaaaccaaaauuucgauaucucgcaauugucuucgaacuucucccaacaaauaucugacuucuucgcccuauuuucagacuuuggagucauaaugccagaagauuuugauccugacaagauaucugacauucuacugaauccaaaccuaucaccgucaggaaaaguaucagaagcaaucgcaacaaucucaccaaaaaccaacguaaaagcaaaaauaaagaucauacuauuauuauuggucggaaacaauggugaccuuaaaaaacuguuugaccucgaaaccacugaaaaaaucgcuguaaaacuuucaucucggcauauagauucagaacucccaauaauacuauccgaacuuaacgaacaacaagaaaauaucaucacaauugccaauucaauauuuggcucaauaauauuaaaagauuuccuuggugacgaaacaucaauauccgcugcaaaaguuauaucguucgaagaucauaaacaagaucuacagaaauuaaaaacaauguggagagaaacauccaacaaagaagcuguaaaagcgggaaaaaaagcauaugaagacuauauaggccacgaagauagcgaaacauucuauaaaaaaaucaaaaaguuucuugaaaaagcacaaccuguagaucucgccaacaaagcacucgccgagauagaauuggaaaacuaccuccccaaacagcggaaccgaaacaacaccgucauuccauaccaacuaaacgaaaacgaacuaauagcuauacuugaucaucaagaaaaauauuaccccuuuuuaaaggaaaaucgugauaaaauacucucacuuuuaacauuuagaauucccuauuacguaggcccguuacaggacucuaacaacaacagauucucuuggaugacccgaaaagcuaguggagcuaucagacccuggaauuucucagaaaaagucaacguagaacaaaguagcaacgacuucaucaaacgaaugaggucaacagauacauauuuaauuggagaaccggugcuaccaaaaaaaucauuaauauaccaguguuacgaaguacucagcgaguuaaauaacacaagaguaaaagacgggucuagcaacccaaaacggcuagacguaacaauaaaacaaagaauauacaaugaaauauuuaaaaaucaaaaaucaguauccguuaaaguucuucaaaauuggcuaauaaaagagucuuacuucaaaucaccagaaaucucaggacuagcugauaaaaaaaaauauuuaagcagucuaucgaccuacauagacuuuaaaaaaauauuuggacaacgcuuugucgacgauccaguaaacuccccccaauuagaagaacuagcagaaugguuaacucuauuugaagauaaaaaaauacugcucauaaaacuucaaaacucaaaauauaguuaugaccaagcaacaaucaauaagcucucaacaaugcgauaucaaggaacaggaaaacuuagcaaaaaauuguuaguugauuuaaaaacuacaaaaaaaaguauuggaaaauccggcgccgaaucccuaucaauacuagaucucauguggagcaccaaggacaacuucaugcaaaucauucacgacgcagacuacaccuucgaacaacaaauaaaagaauuuaacuacgauacagaagacgaacuaacaccucuagaaaaaguagcaaaucugcauggaucgccagcccuaaaaagaggacucaaucaaucaaucaagguaguagcagauauaguaaaauucaugggacaugauccagaaaaaaucuuuauagaauuuacccgaagcgaugauuuuuccaaauuaacaauaagcagauaccgucguaucaaaaaacaauaccucgaaauugcaaaagcaaucaagaaaaucccagccgaauuuaaggacauaaaagaguaccaaacacaacuagaagaaaacaaggguaaauuagcaagugaacgguuaauguuguacuuccuacaauguggacacucgcuauauucaaauaaaccaauugacuuaaacaugauuaacucaucaaaauaucacguagaccacaucuuaccacaaucauacauaaaagacgauucauuagaaaauaaagcauugguauuggcgagugaaaaugaaaacaaaauagacaacaugcucauuucccaugacauaauagccaccaaucuaccuagauggcaagcguuaaaagaucaaaaccuuaugggaagcaaaaaguucgccgaccucacucguacaacaguaacugaaaaccaaaaaaaaggauuuauacagagacaacuaguacaaacuagccagauugucaaaaacauaacacuuaucuuaaaugauuuauacaagaacacaucauguauagagacaagagcaacucucuccucagaauuuagaaaagcuuucucuaacuucgacgaaacaaccuaccauuaccaauucccagaauucguuaaaaacagagacgucaacgauuuccaucacgcacaagaugcauuccuugcuuguguaaucggugaauaccaauuaaaaaaauauccgaaagauaaucuaagacuaguuuaugaucaauacaguaaguuucucgauucauugaaaaaagacaccagaaagaaaaacggcagaaugccaagauacacccaaaacggauuuauuauuggaucaauguuuaacggcaaaacauaugucgacgauaacggcgaaauaauuugggaccaaaaaaucaaagaauccauuagaaaaacuuucaacuaucaccaauuuaacguaguacgucaaaccaucgaacaacauggcaaauuauuuaacgauacuauacaaccgcauucagaucgcuacaaacuaauacccuuaaaaacuaacagagacccggcuauauacggagguuauaauaacgacaacaaugccuauucugucguccuggacguugacggaaaaaaaaagaucaacggaauuccuauaagaauugcaaaccaguuaaaaucagaugaauuagaccuuuccucaugguuagaaaacaauauuaagcauaaaaaaccaaugacuauccucaucgauaaaguuccaaaauaucagcguauaauaaacgaagaaaccggugaccuacuuauaaccagcgcaaaugaaguuauaaauaacguucaauuguuccuaccauccauguacacugcacuuaucucacuacuagacagcacaaaaacagaaauguauucaaaguuacuauccaauuacgaagcaaacauacucauagauauuuaugacuauuuauuaacaaaacugaaaaacaacuauccccucuaucgcaaagaaugggcuaaauuagcagaacacagagaugauuucauagaaucagaccuagugacacaggcgagcacucuacaacaacucauaaaauuuaugcacgccgaccccucaaaugucaaccuuaaauucgggaacuucaaaggaaaucgcuuuggccgaaaaaacggaaauauaaaacucagcaaaacagacuucauauacgaaagcccaacuggcuuguucaaauccauaaaacauauagauuga

SEQ ID NO: 5333 - RNA, 4044 nt, Artificial Sequence
  Cas9 variant
augaaaagcgaaaagaaauacuauaucggucucgauguagguacuaacucuguagggugggcuguaaccgaugaauuuuauaauauccugagagcuaaagggaaagauuuauggggugucagguuauucgaaaaagccaaaacagcggcugacacaagaaccuuccgcagcgguagaagaagaaaugaccgaaaagguaugcgcuuacaaaucuuaagagaaauuuuugaagaugaaaucaaaaaagucgacaaagauuuuuaugacagacuagaugaaucaaaauuuugggccgaagacaaaaaaguuucaggcaaauacagccuauucaacgacaaaaacuuuagugauaaacaauacuucgaaaaauucccaacaauauuucaccuaagaaaauaucucauggaagaacacgguaaagucgacauacguuacuauuuccuugcaauaaaccaaaugaugaaaagacgaggucacuucuuaaucgacggccaaauaagucacguaacagacgacaaaccacuaaaagaacaacucauacuacugauuaaugaucuacuaaaaauagaauuagaagaagaauuaauggauaguauauucgaaauacuagcugauguuaacgaaaaacgcaccgacaaaaaaaacaacuuaaaagaauuaauaaaaggucaagauuucaacaaacaagaaggaaacauacuuaauucaaucuucgaaucuauagugaccggaaaagcaaaaauaaaaaauauaaucagugaugaagacauacuagagaaaaucaaagaagauaauaaagaagauuucguacuuaccggcgauaguuacgaagaaaauuuacaauauuucgaagaaguccuucaagaaaacauaacacuauuuaacacccuaaaauccaccuaugauuucguuauauuacaauccauccuaaagggaaaaaguacauuaucugacgcacaaguugagagauacgacgaacacaaaaaagaccuagaaauacuaaaaaaaguaaucaaaaaauaugacgaagauggaaaacucuucaagcaaguauucaaagaagacaaugguaaugguuacgucuccuacaucggauacuaucucaacaaaaacaagaagauaacagcuaaaaaaaaaauaucaaauauagaauuuacuaaauauguaaaaggaauacuagaaaaacaaugugacugugaagacgaagccguaaaauaccucuuaggaaaaaucgaacaagaaaacuuccuauuaaaacaaauaucaucaauaaauaguguaauaccacaucaaauucauuuauucgaacuggauaaaauacuagaaaaccuugcaaaaaauuaccccagcuucaauaauaaaaaggaagaauucacgaagauagaaaaaaucagaaagacuuuuaccuuuagaauaccguauuauguagguccgcuuaaugauuaucacaagaacaacggcgguaaugcauggauauucaggaauaaaggggaaaaaauucgaccauggaacuuugaaaaaauaguugaccuacacaaaucagaagaggaauucaucaaacgaaugcuaaaucaaugcacuuaucucccagaagaaaccguccuaccaaaauccagcauccucuacucggaauacauggucuuaaacgaguuaaacaaccuaagaauaaaaggcaaaccacuagacacagacgugaaauuaaaacuaauagaagaacuauucaagaaaaaaacaaaaguaaccuuaaaaagcauaagggacuacaugauucgaaacaacuucgcagauaaagaagacuuugacaacagugaaaaaaaucuagaaauaguuuccaauaugaaaaguuacauagacuucaacaauauccugggagacaaauucgaacuagaaauggucgaagaccucauugaaaaaauaacaauacauacaggaaacaaaacucuccuuaaaaaguacauagaagaaacauaucccgaccucucauccucacaaauccaaaagaucauuaaucucaaguauaaagacuggggccgacugagucguaaauuacuugacgggauaaaaggccguaacaaaacugacgacguaaacaccguaaucaacuuuaugagaaacucuagcgacaaucucaugcaaauaaucgaaggaaaaaauuacuccuuuaacgaguauauugacaaccuaaggaagaaauacauaccacaagaaauaagcuacgaaguuguggaaaaucuauacguaucaccauccguaaaaaaaaugauuuggcaaguaauuagaguaacagaagaaauaacaaaaguaaugggcuacgacccagauaaaauauuuauugaaauggccaaaucagaagaagagaaaaaaacuacuauuucacgaaaaaauaaacucuuagaccuauauaaagcaauaaaaaaagaugaaagagauucacaauaugaaaaacuacuaacuggauuaaacaaauuagacgaaucagaauugcguaguaaaaaacuauaccuauauuauacucagaugggaagggauauguauacaggugaaaaaauagacuuagacaaacuauuugauuccacacacuaugauaaagaucacauaauaccacaaucaaugaaaaaagacgacucaauaauaaacaacuuaguuuuaguaaacaagaacgcuaaccaaacuacuaaaggaaacaucuacccaguacccuccucaauucgaaacaauccagauauuuacaauuacuggaaauaccuaauggaaaaagaauuuauuaguaaagaaaaauauaacaggcuaaucagaaacaccccauuaacgaaugaagaacucggaguuuucauaaauagacaacuaguagaaacgcgccaaagcacaaaggcaauaaaagaauuauucgaaaaauucuaccagaaaucgaaaauaauaccaguaaaggcaucgcuggccagugaucuccgaaaagauaugaacacacuaaaaagcagagaagucaacgaccuucaccacgcccacgacgcauucuuaaacaucguagcaggagacguauggaacagagaauuuacaucuaaucccauaaacuaugugaacgaaaaccgggaaggagauaaagugaaauauucacuuucuaaauauuuuacuagaccaaggaaaucaaaaggaaaagugauuuggacccccgagaaagguagaaaacucauaguagauacacucaauaaaccaucaguguuaaucucaaaugaaagucauguaaaaaaaggagaacuauucaaugcaacaauaucgggaaaaaaagacuacaaaaaagggaaaauauaccuaccucuaaaaaaagaugauagacuaaaagacgugaguaaauacggaggcuacaaggcuauaaacggagcguucuuuuucuuaguagaacauaccaaaucaaaaaaaaggauccgaagcauugagcucuuuccacuacacuuacuaucaaaauuuuaugaagacaaaaacacaguacuagauuacgcaaucaacguacuacaauuacaagacccuaagauaaucauagacaaaauuaauuaccgaacggaaauaaucauagacaauuucucguaucuaaucuccacuaaaucgaacgauggaucaauaaccguaaaacccaacgaacaaauguacuggagaguugaugaaauaucaaaccucaaaaaaauagaaaauaaauacaaaaaagaugccaucuuaaccgaagaagacagaaaaauaauggaauccuacaucgacaaaaucuaccaacaauucaaagcagguaaauauaagaaccgcagaacaaccgacacaaucauagaaaaauaugaaauuaucgacuuagacacauuagacaacaaacaacuauaccaauuauuaguugcguuuauaagucuaucauacaaaaccucgaacaaugccguagauuucaccguuauaggccucgguacggaaugcggcaagccgagaauaacaaaccucccagauaauacauauuuaguguauaaaaguauaacaggcaucuaugagaaaaggauccggaucaaauga

SEQ ID NO: 5334 - RNA, 4047 nt, Artificial Sequence
  Cas9 variant
augaaaaagcccuauacaaucgcacuagauauuggcacaaacagcgugggauggguaguugucaccgacgacuaucgaguaccuacaaagaagaugaaggugcucggaaauacagaaagaaaaacgauuaaaaaaaaccuaauaggagcucuucuauucgacuccggcgauaccgcagaagggacccgauuaaagcgaaccgcaagaagaagauacaccagaagaaaaaauagacucagauaucuaaaagaaauauucacagaagaaauggcaaaagucgaugacggauucuuccaacgacucgaggauaguuucuaugugcucgaagacaaagaaggcaacaaacauccuauauucgcuaauuuagcagacgaagucgcuuaccacaaaaaauaccccacgauauaucaucucagaaaagaacuagucgacaacccacaaaaagcugaucuaaggcucauauaucuugccgucgcacauauuauaaaguuucguggccacuuccuaauagaagguacauuaagcucuaaaaauaacaaucuccaaaaaagcuucgaucaccuaguagacacauauaauuuacuauuugaagaacaacgccuacugacugagggaauaaaugcaaaagaauuacucagcgcagcacucucaaaaaguaaaagauuagaaaaccuaauaagucuuauaccaggacaaaaaaaaacaggcauauuuggcaacaucauagcauuaagccuaggacuaacaccgaauuucaaagccaauuucggacuaaguaaggacguaaaacuacaacuggcaaaagacaccuaugcagaugaucucgauucacuacucgcacaaaucggagaucaauacgcagauuuguuccuugccgccaaaaauuuaucugaugcgauuuuacuaagcgacauacucacagaaagugaugaaaucacaagagcaccucuaucugcaaguauggucaaaagauacagagaacaccacaaagaucuagugacucucaaaacacuaaucaaagaucaacucccagaaaaauaucaagagaucuuucuggauaaaacgaaaaauggauaugccggauacaucgaagggcaaguaucacaagaagaauuuuauaaauaccuuaaaccuauccuagcccgauuagauggauccgaacccuuauuauuaaaaauagaucgagaagacuuuuugaggaaacaaagaacauucgauaacgguucaauaccccaccaaauccaccuagaagaacuacaugcaauauuacgaagacaagaaguguuuuauccguuuuuaaaagacaacaggaaaaaaauagaaucacuucuaacauucagaauucccuacuacgucggaccacucgcacgaggucauagcagauuugccuggguuaaaagaaaauuugauggagcaauccgaccauggaacuucgaagaaauaguggacgaagaagcuucugcacaaauauucauagagaaaaugacaaaaaacgaucucuacuuaccaaaugaaaaaguacuaccaaaacacucccuauuguaugaaaccuuuaccguuuauaacgaacuaacaaaagugaaguacgcaaccgaagguaugacaagaccgcaauuucucucugcagaccaaaagcaagcaauaguagacuuguuauuuaaaacuaacaggaaagucacaguaaaacaauuaaaagaaaacuacuucaaaaaaauugaauguugggacaguguagaaauuacuggcguggaagacucuuuuaacgccucccuuggcacauaucaugaucuacucaaaauuauacaagauaaagauuucuuagauaauccagacaaucaaaaaaucauugaggauauaauacuaacacucacuuuauucgaagacaaaaagaugauaucgaaacgacuagaucaauaugcucauuuauucgacaaaguagucuuaaauaaacuagaaagacaccacuacacaggcuggggaagauuaucaggcaaauugauaaauggcaucagggauaaacaaaguggaaagacuauauuagauuuuuuaaaagcagauggguucgcuaaccgaaauuuuaugcaauuaauacaugacagugaauuaucguuuauagacgaaauagcaaaggcacaaguaauagguaaaacagaguauucaaaggauuuaguaggaaacuuagccggaucgccagccauaaaaaaagguauaucucaaaccauuaaaauuguagacgaguuagucaaaauaaugggcuaucucccacaacaaaucgucauugaaauggcuagggaaaaccagacaaccgcccaaggaauaaaaaacgcccgucaaagaaugagaaaauuagaagaaaccgcaaagaaauuaggauccaacauacuaaaagaacacccgguugauaacagccaacuccaaaaugauaaacgauaucuauauuaccugcaaaauggaaaagauauguauaccggugacgaucuagauauagauuaccuaaguucauaugauauagaccacaucauuccacaaucguucauaaaaaauaauaguauagauaacaaaguacugaccucucaaggugccaaccgcggaaaacuagacaauguaccuagcgaggcaauaguucgaaaaaugaaaggcuauuggcaaucuuuacugagagcgggugcaauaagcaagcaaaaauucgauaaucuaacaaaagcggaaagaggaggacuaacccagguggauaaagcuggcuucauccagcgacaacugguagagacacgacaaauaacaaaacacguagcacaaauuuuagauagcagauucaacacugaauuugaugaccacaauaaaagaauucgaaaaguacacauuaucacacuuaaaucuaaacucguuagcgauuucaggaaagaguuuggacuauauaaaauacgagacauaaaucacuaccaucaugcccaugaugccuaccuuaacgccguaguagcaaaagcaauauuagguaaauauccccaauuagcaccagaguuuguauacggcgauuacccaaaauacaacucauucaaagaaagacaaaaagcuacccaaaagaugcuauucuacucuaauauacuaaaauucuucaaagaucaggaaucuuuacacgugaauucagacggcgaagaaauauggaacgcaaauaaacaucuuccaauaauaaaaaacguccuuucaauaccacaaguaaacaucguuaaaaaaacugaaguacaaacagguggauuuuacaaagagucaauacuuucaaaagguaacucagauaaacucaucccaagaaaaaauaacugggacacaagaaaauacgguggauuugacagccccacaguggcauacagcguucuagugauagcaaaaauggagaaaggcaaagcaaaaguccuaaaaccaguaaaagaaauggucggaaucacaaucauggaacgaacugcauucgaagaaaacccagucgucuucuuagaagcacgcggauaucgagaaauacaagaacaccucauuaucaaguugccaaaauacucacuauucgaauuagaaaacggaaggagaagacuacuagcauccgcaucagaacuccaaaaaggaaaugaacuauucuuaccaguagacuacaugacauuccucuacuuagcagcacacuaucaugaacuaaccggcucaagcgaggacguccuacggaaaaaauacuuuguagacagacaccuacacuacuuugacgacaucauacagaugauuaacgacuucgcagaaagacauauauuagcaagcucuaaucuagagaaaauaaaucacacuuaccauaauaauagugacuuaccagugaaugaaagagcggaaaacauaauuaacguauuuacauucguagcccuaggugcaccagcagcauuuaaauuuuucgacgccacgaucgauagaaaacgauacacaucuacaaaagaagucuuaaaugccacauuaauucaccaaucaguaacaggacucuaugaaacaagaauagaucucucacaauuaggcgaaaauuga

SEQ ID NO: 5335 - RNA, 4047 nt, Artificial Sequence
  Cas9 variant
augaaguccgaaaaaaaauacuacaucggucuagacguagggacaaauagcguagggugggcaguaaccgaugaauuuuacaauauacuacgagcuaaaggaaaagaccuauggggcgugcgcuuauuugagaaagcaaaaaccgcggcugauacaagaacuuuuagaucuggacgacgcaggaacgauagaaaaggaguacgacugcaaauccucagggagauauuugaagacgaaauaaaaaaaguagacaaagauuuuuaugacagacuagaugaaucaaaauuuugggccgaggacaaaaaaguaagcgguaaauauagccucuuuaacgacaaaaacuucuccgacaaacaauacuucgaaaaauucccaaccauuuuucaucuaagaaaauaucuaauggaggaacauggaaaaguugauauacgcuacuacuuccuagcuaucaaccaaaugaugaaacgaagaggacauuuuuuaauagauggccaaaucagccacguaacagacgauaaacccuuaaaacaacaacuuauacuccucaucaacgaucugcuaaaaauugaacuagaggaagaauucauggacucaauuuucgaaauauuagccgacguaaaugaaaagaaaacugaaaaaaaaaacauauuaaaagaacugauaaaugcacaagacuuuaacaaacaagaaggaaaaaucuuauacucaauauucgaaucgauagugaccgggaaagccaaaauaaaaaacauaauuagugaugaagauauauuagagaaaauaaaagaagauaauaaggaagauuuuguauuaacaggagauucauaugaagaaaaccuccaauacuuugaagaaguccuacaagaaaacauaacacuuuuuaacacauuaaaaucagcauacgauuuuguaauauuacaaucaauauuaaaaggaaaaucaacacucagcgaugcccaaguugaacgauacgacgaacauaaaaaggaccuagaaauacugaaaaagguaauaaaaaaauacgacgaagacggaaaacuauucaaacaagucuucaaagaagacaauggcaauggauauguuaguuacauuggauauuauuugaauaaaaauaaaaaaauuacugcgaaaaaaaaaauaucgaacauugaauucacaaaauaugucaaagguaucuuagaaaaacaaugcgacugugaagacgaagacgucaaauauuuacucggaaaaaucgaacaagaaaacuucuuacugaaacaaaucuccaguauaaacagcguaauaccccaucaaauacaucuuuucgaguuagacaaaauucuagaaaaucucgcgaaauacuauccaagcuuuaauaacaaaaaagaagaauucacaaaaauugaaaagaucagaaaaaccuucacauucagaauaccauauuacgucggaccacuaaacgauuaccacaaaaacaacggcggcaacgcauggauauuucguaauaaaggagaaaaaauacgcccauggaacuuugaaaaaaucguagauuuacauaaaagcgaagaagaauuuauaaaacgcaugcucaaucaaugcacauaucuacccgaagaaacuguacuaccuaaaucauccauacuauauucagaauacauggucuugaacgaacuaaacaaccucagaauaaacggaaaaccaauugacacugauguaaaacuaaagcuaauagaagaauuguucaaaaaaaaaacgaaaguaacacuaaaaucuauuagagacuacaugauaaggaacaauuucgccgacaaggaagacuuugacaauucagaaaaaaacuuggaaauaguaucaaacaugaaaagcuacauagauuucaauaacauacuaggcgacaaauuugaauuagaaaugguagaagauuugauugaaaagauuacuauacacacaggaaauaaaaaacuacuaaaaaaauauauagaagaaacauacccagacuuaucaagcucacaaauacaaaaaauaauaaacuuaaaauacaaagauuggggucgacucagcagaaaacuauuggacggaauaacaggcaccaauauagaaacaggcgagaucgacacaguuaucaacuuuuugagaaacaguuccgacaaucuaaugcaaauaauaggaagccaaaacuauucauucaauaacgauauagacaaacuacguaaaaaguauauaccccaagaaaucagcuaugaagucguugaaaauuuguauguaaguccaaguguaaaaaaaaugauauggcaaguaauaagaauaaccgaagaaauuacaaaaguuaugggcuacgaccccgacaaaauauucauagaaauggcaaaaagugaggaaggaaaaaaaacgacaauuaguagaaaaaacaaauuguuagcacuguacaaagcuauaaaaaaagaugaacgagauucacaauacgaaaagcuacuaacaggccuaaauaaacuugacgauucagaccuucgaagccgaaaacucuaucucuacuacacacaaaugggacgcgauauguacacuggcgaaaaaaucgaucuagauaaauuauucgacaguacacacuaugauaaagaccacaucaucccacagaguaugaaaaaagacgacucuauuauaaacaaucuaguacuuguaaacaaaaacgccaaccaaacaaccaaaggaaauauauaccccguuccuucaaguaucagaaauaacccuaaaauauacaacuacuggaaauaccugauggaaaaggaauucauaucgaaggaaaaauauaaucguuuaaucagaaacaccccacuuacaaaugaggagcucggcggauucauaaauagacaacugguggaaaccagacaaucuacaaaagccauaaaagaacuauucgagaaauuuuauaaaaaaucuaaaauaaucccaguaaaagcuauccuagccucagacuuacgcaaagacaugaacacccugaagagcagagaagucaacgaucuacaccacgcucacgacgcguucuuaaacauaguugcgggagacguauggaacagagaauucacauccaaccccauuaacuacguuaaagagaacagagaaggugauaaagucaaauauagcuuaucaaaauacuuuacaagaccccgaaaauccaaagguaaaguuauauggacaccggaaaaggggagaaaacuuaucgucgacacacuaaauaaacccaguguacuaauuuccaaugaaagccacguaaaaaaaggcgaacuauucaacgcaacaaucgcgggaaaaaaagacuauaaaaaaggaaagauauaucuaccgcuaaaaaaagacgacagacuccaagacguaaguaaguauggagguuauaaagcaauaaacggagccuuuuucuuccuuguagaacauaccaaaagcaagaaacgaauacgaucaauugaacuauuuccucuacaucuacuaucaaaauucuaugaagacaaaaacacgguacuggacuaugcaaucaacguacuccaacugcaagacccaaagauaaucauagauaagauaaauuaccgcacagaaauaaucauugacaacuuuagcuacuuaauaucaaccaaaagcaaugauggaucuauaaccgucaaaccaaacgaacaaauguauuggaggguagaugaaauuucaaaucuaaagaaaauagaaaacaaauauaagaaagacgcaauacucacugaagaagacagaaaaauaauggaaagcuacaucgauaagaucuaucagcaauucaaggccgggaaauauaaaaaucgacgaacaacagauacuauaauagagaaauaugaaaucauagaucucgauacacuagacaacaaacaacuuuaccaacuucucguagcauucauauccuugucauauaaaacaagcaauaacgcaguagacuucacuguaauaggacuuggaacagaaugcgggaaaccacgaauaacuaaccuacccgacaacacuuaccucguauauaaaucaaucacaggaauauacgagaaaaggauaaggauaaaauga

SEQ ID NO: 5336 - RNA, 4047 nt, Artificial Sequence
  Cas9 variant
augaaaucagaaaaaaaauauuacaucggauuggacguaggaacgaacaguguagggugggcaguuacugacgaguucuacaauauacuuagggcaaaaggaaaagaucuauggggcguaagacuauucgaaaaggcagauaccgcagcaaacacaagaaucuuucgaucggggagacgcagaaacgauagaaaaggaaugcgacuacaaauacuucgcgaaauauucgaagacgaaauaaaaaaaguagacaaagauuucuaugacagauuagaugagucgaaauucugggccgaagacaaaaaagucaguggaaaauauucccuauucaaugauaaaaacuuuucagacaaacaguacuuugagaaauuuccgaccauauuccaucuccgaaaauaucuaauggaagaacaugggaaagucgauauacgauacuauuucuuagcgauaaaccaaaugaugaaacgaagaggucauuuccucauugauggacaaauuucacacguaacggaugauaagccacucaaagaacaacucauacuauuaauuaaugauuuauuaaaaauagaacucgaagaagaacuaauggauucuauuuuugaaauauuagcggacguaaacgaaaagaggacugauaaaaagaacaaccuaaaagaauuaauaaaaggucaagacuucaacaaacaggaaggaaacauuuugaauagcauauuugagucuauagucaccggcaaagcaaaaauaaaaaauaucauuucagacgaagacaucuuggaaaaaauaaaagaagauaacaaagaagauuucguccuaacaggcgacagcuacgaggaaaaucuccaguacuuugaagaaguguuacaggaaaacauuacauuauuuaacacccuaaaaucaacauaugauuuuuuaauacuacaaucaauccuuaaaggcaaaagcacacucucggacgcacaagucgaaagauacgacgaacacaaaaaggauuuagaaauauuaaagaagguuauuaaaaaauacgaugaagaugggaaacuauucaaacaaguauucaaagaagacaacgguaacggguauguaucuuacauaggauacuaucuaaauaaaaauaaaaaaaucacugcaaaaaaaaaaaucucaaacaucgaauucacaaaauauguaaaaggaauacuugaaaaacagugugauugugaagaugaagaugucaaauaucuccuugggaaaauagagcaagagaauuuucuacugaaacaaauaagcucaauuaauagugucaucccgcaccaaauucaucuuuucgaacuggacaagauccucgaaaaccuagccaaaaacuauccaucauuuaacaauaaaaaagaagaguucacaaaaauagagaaaaucagaaaaaccuucacguuuaggauaccauacuauguuggaccauuaaacgacuaucacaaaaacaauggaggaaaugcauggauauucagaaacaaaggcgaaaaaauaagaccguggaauuuugaaaaaauuguagacuuacacaaaucggaagaagaauucaucaaacgcauguuaaaccaauguacauauuuaccugaagaaacaguucuaccuaaaucaagcauacuuuauagcgaauacaugguacucaacgaacugaauaacuuacggaucaauggaaaaccacucgauacagauguaaaacucaaacuaaucgaggaacuuuuuaaaaaaaaaacaaaaguaacauuaaaaagcauuagagauuauaugguuagaaacaacuucgccgacaaagaggauuuugacaacucagaaaaaaaccuagaaauugcaagcaacaugaagagcuacauugacuucaacaacauccuagaggauaaauuugauguagaaaugguagaggauuuaauagaaaaaauaacgauacacacagggaauaaaaaacucuuaaaaaaauacauagaagaaaccuaccccgacuuaagcagcagucaaauacaaaaaauaauaaauuuaaaauacaaagacugggggaggcugaguagaaaauuacuagacggaauaaaaggaacaaagaaagaaacugaaaaaacagauacaguaauaaacuuccuacgcaauagcucugacaauuuaaugcagauaauagguucacagaauuauaguuucaacgaguauauagacaaacugcgaaaaaaauauaucccacaagaaauaaguuacgaagucguagaaaaucuuuacguaucaccaucgguaaaaaaaaugauuuggcaaguaauaagaguaacagaagaaauaacuaaaguaaugggauacgacccagacaaaauauucauagaaauggccaaauccgaagaagaaaaaaaaacgaccauaagccgaaaaaauaaacuauuagaucuauauaaagcaauuaaaaaagaugagagagauagccaauacgaaaaacuacucacaggacucaacaagcuagaugacucugacuuacgaagcagaaaacuguaccuuuacuauacgcaaaugggcagagacauguacacuggugagaaaaucgaucucgauaaacucuuugacucaacccauuacgauaaagaccacauuauaccccagucaaugaaaaaagaugauucaauuaucaauaaccucguacuagucaacaaaaacgccaaccaaacaacuaaagggaacaucuacccaguccccaguagcauuagaaacaacccgaaaauauauaauuacuggaaauaccuaauggaaaaagaauuuaucuccaaagaaaaauauaacagauuaauaagaaauacaccauuaacuaacgaagaacucggaggcuuuauaaauagacaacuaguggaaacuaggcaauccaccaaagcuauaaaggaauuauucgaaaaauucuaucaaaaaucuaaaauuauaccagucaaagcgucacuugcauccgacuuaagaaaagauaugaacacacuaaaaucaagagaaguaaaugaucuacaucacgcucacgacgccuuuuuaaacaucgucgcaggcgacguguggaacagagaauucacaagcaaucccauuaauuaugucaaagaaaaucgagaaggagauaagguaaaauacucucuuucaaaagacuuuacacgaccgagaaaaagcaaaggaaaagucauuuggacucccgaaaaaggacgaaaacuuauaguugacacacugaacaaaccaucaguacucauaagcaacgaaucucacguaaaaaaaggagaacuauucaacgccaccauagcaggcaagaaagacuacaagaaaggaaaaauauaccuaccacucaaaaaagacgacaggcuacaagacgugucuaaauacggaggguacaaagccauaaauggagcauuuuuuuuucuaguugaacacacaaaaaguaaaaaaagaauaagaaguauagaacucuuccccuuacaucuacuuaguaaauucuaugaagacaagaacacgguauuggacuaugcaauaaacguacuucaacuacaagauccaaaaauaaucauugacaaaauaaacuauagaacagaaauaaucauagacaacuuuucauaccucauaaguaccaaaagcaacgacggcucgauaacugugaaaccgaaugaacaaauguacuggagaguagacgaaauuucgaacuuaaaaaaaauagaaaacaaauauaaaaaagacgcuauacuaacagaagaagauaggaaaauaauggaaaguuauauugauaaaauauaucaacaauuuaaagcaggaaaauauaaaaaucgacgcacgacugauacaauaauagaaaaauacgaaauaauugacuuagacacacuggacaacaaacaauuauaccaacuccuugucgcauuuauaucacuaucuuauaaaacuucaaacaaugcuguagauuuuacagugauaggauuagguacggaauguggaaaaccccgaauuacaaaucuucccgacaauacauaccuaguauacaaaagcauaacaggaauauaugaaaaacgaauacggauaaaauga

SEQ ID NO: 5337 - RNA, 4047 nt, Artificial Sequence
  Cas9 variant
auggagaaaaauuacuaccuaggauuggaccuaggaucuaauucaguuggaugggcagcaacagacgaagacuauaacuuccuaagacuaaaaggcaaaacagcauggggcgcucgcaucuuuuccgaagcuaaggacugcaaagaaaggaggacauacagaaguaauaaaagaagacuagcaagacgaaaauauagauuaguauugcucaaacaauuauucgccgaagaaaugacuaaaguugacaagacauucuuccuucgauuagcuaacagcaccuacugggaagaagauaaaacuaaagacucugauggaaacgaaauaggaaagaaccuuauuuucaaaacacaugaagaagaaaaacaguauuacacaaaauauccaacaaucuggcacuugcguaaggcccucaucgagaacgacgaagaagcacucagcaaccuacguuauguauauuuagcaauacaucacauuguaaaauauaggggaaacuuccucacagaaggcgaaaugggcaacgacauacccccaaucacaacaauugaagaaauaaaccaaacgcucagccuauuagaaguugauaguuccgaagacgccacugauaaaacgacauacauaaaaccugaaucuuauaacgaauuauucacaauauuagaaaacaauaauuuaaacaaaguaaagaaacaacaagagauagacaaacuuuucauauccucgaaagaaagaucugaaaauaucaaaaacuacauaaaucuauucaaaacaauaaucguaggagguucauuuaguuuaaagaaaauuaacgaggauacagaggacauuagcgucgacuuuacaaaagauuucgagaacagcgaagcagacauuagcaaagcacuaggcgacuccuucaaucuagugcuuaucgcaaagaaauauuacgauuacauaauccuuaaagaacuucuaggcaaaaacaaagaaauauccgaagcaaugguccaaaucuacgaagaacauaaagaugaucuaaaaucucugaaaacaauccuaaaagaucuagauaacaaacuaggaaaugacgguaaagacagaauauacuacagcguauucaaacaagaaccgacggaaaaauuuaaagaaaccaauuaucuaucauucguacaaggcggaaagcuggaagaacugaacaaauacaucaagaaaauauuagaaaacaacgaaaaagauauagacgauaaagaaacauauaaugcccuauacgaaaaagcgugcaaaggggauuuauuuaagaaacaggcuaaugcuugcacgagccugauaccacaccaauuucaucuaagggaacuaaagaaaauucucgaaaaugcggggcguaaauacucuuucuuaaacgacauaagcgacaaaauaauaaaaauauucaaauucagaguaccguauuacuacggcccacucaacaaugaaaguaaugcgcacagcuggguaguaaagaaagaagggcaagaaaaagcaaagaucacaccauggaacauaaacgaaaucauagauacgcccaaaacuagagacaacuucuucaagaaacugaccaauagcuguacauacuuaguaggcgagacaguacugcccaaaacaucacuuuacuaugaaaaauaccuaguacucgacaggcuaaacaaaaugcaaguaaacggagauuaucuaucagcuagugagaaaaacgacguauugaaauucauacucucccguaaaacuacaacgauagaacaaauaagaacauaccucagcaaaaacaaaucaacuaaagcaaacgacauaagcaucagcaacauaaaagcgacugauccuuucaacgcaguuucucacgcauuuuacggaaaacacccggaucucaauauaaauuuaugcgaagaacugaucaaauucgcaacaauauacgcagacgauaagaaagaacucaagaaauuugucucaaguaacuuuaaucuaacugaugaguucauaaaagaauacuugaauacaccuacaaacaaaugggguagacuuuccagaaaauuccucugcgguggagaccaauuagaaauguauuaugucgacgacaacggcauauuacauagcaucuugaacauucuagaagaaacaaaugaaaaucuacaagaaauccuaaacaaugaaaaauacggguucaaccagaaaauagcagacuucaacaauacucuuacagcagacaaaacaacagaagaacaaauagaagauaucuuggacuccacaccagcauuaaugagaagaucaauuauacaaacacuugcgguaguagacgacguaauuaaagcagcaggaaaggcaccacagaaaauaaugauggaaguaacacgcacugacggcaagaaagaagaaacaaaaucaagguacguacaacucaagaaacaaauaacaaacgauaaaguauuaacaucagacgaaaagaaagaacuauuaacuaacuuagaaaacaagaaaauccaacucaaaggaaaacauauauaucuauacuucaugcaaauggguauagauuuuuauacaggaaaaauaauggacauaaacgacguaauaaauggaaaauaugauauugaccauaucauuccacaaucaaugaucaaagaugacagucucgacaauauggugcuaguaagcaaagacuauaaccaaaaaguuaagaaagauaucuauccaauaugugacgaaauacguaauaacaugcuagacaaauggaaaggcuacuacgccaggaaaauuauuuccgaagaaaaauacaacagauuaaaaagaacaaaagaacucaaugcagacgagauaaacgccuucaucaauagacaaauaaacguaguuaauuacucaaacauacaaaucaaaagaauauuugaaauaaaauaccccgaaacaaaaauaauauucuccaaagccagcuuuccuagcuuacuccguaaagaauacgaaauagcuaaaaugagagauuuaaaugacgcacaccacgcuguugacgcauaccuaaacauaguuugcggaaauauacucacgacauuauauacggacaucuucuauauguucaaagaaaagaaagaagaccacaaaaacaucucauucaacauggagaaaagacuuauaaacuauauagauaaaaacaacuuaaaagacaaaauaaaaacaagcugcuuacgacacgacgcacucauaacauauaaacccgacuacgacagcgguaaauucuacaaagaaacaauauuuaagaaaagcggagauaaagaaaccggauuaauaccgcuccauacaaaaggacccaugagugacacuaagaaauauggaggauacucacaauuaucgcaauccuauauaauagcgguugaauacaaacucaaaaauaaaacaguaaagaaauuaugucgaguucccaccuuauaccuaaaacaauacaaaaaugaccuaaauacgaucgcaaaaaucaugauagacgacgaaaaagcuacagacaucaaaguacucagaaaaauuuaccuaaaccagaaaaucagguacaacggaugcuacuaccuaaucuauacaucuaaagaaaaacaaaauaaauauaaaauggcauaccaaaacuaccuagacaaugauuaucuaauauaccuaaacaaaugucucaagaaaauagaugaacuagacgauggggaauuaacaagucaagaauuuauugucaacaaagacggcgacaaauuucuuauagacaaaaaucacaaucuggaaauuuuuaaaucaaucaaagaacaauacaacaaaaccauauaugauuacacacccuauauaguacaaucccgcgaaaugaaagaagaggacuuuaacaaucuaagucuaaagaaacaaauagacacauuauuaaacaugaucaaaauacuaucaaggagcaacgaacaagcuaaauucgaaacugccuucuucgaaaacuucaccaaaguauuccuaaaaaccaugacaauaacuaacgaaaaagucuacauagucaacgaaaguccaucugggcuguucaaaggaaaagaagaacuaauauga

SEQ ID NO: 5338 - RNA, 4047 nt, Artificial Sequence
  Cas9 variant
augaaaaaauucgaagauuacuauuuagguuuagacuugggaacaaguaguauaggaugggcgguaacaaaugagaaauacgacaucuuaagauuuaacaaaaaauucauguggggcacccacuuauuugacaugggcaauaccgccucagaaagacgaauauuccguaccucuaggagaagacucaaaagaaaaaaaaaucgaauagaauuacuacaaacauuauuuucagcagaaaugucaaaaaaggauuucggauucuuucaaagacuuaaagaaagucaguacuuuaucgaagacaaaaccuuuaaaaacaaaaacacauuauucauggaugaaaauuauaccgaucaagauuaccacauggaauaccccaccauauaccacuuaagaaaagcacuaauugacaacgaggaaucagccuuugaaaucagaaaacuuuaccucgccauaucccacauacucucacaucgaggacacuuccuauucgaaggugaacuaucggacaaccuagacuuugaugauauauucaaugaauucguaaaauaucuaaacgaagaguuaaauauagauuucaaaauuaaauccgaugucucacuacaggcuauaaaagaaauucucacagauaaaaugcucaaccgaaccaaaaaaaaagagaaacucucagaacuucuugaagaagaaaaaaauaaaauauaccaagaaauauggaagcuacugguaggcaacgaagcuaagaugagcacaauauucgacgacaaagaauacgaagaagccaagauagcauucuccaaaggaaauuaugaugaaaaagaagaagaauaugagagcauacuaggugaaaaaauauuauuuguacaaaaagcgaaagcaauuuaugacuggauguuauuacaaaacaucuuaaaagaagacaaauaucugucauacucaaaaguuaaacucuacaaugagcacaaaaaagaccuaaaaauauuaaaagaugugcuaaaaaaccuugacaaaaaaaucuacaaagaaauauucagcgagaauggacuauacgaagaauaucuuagaauugagaagaaaaagauuggaucuaaggaagaaaagacuaaagauauauuauacaaccgacucaaaaaaauauucgaaaauagagauaacauggccaucgaagacauacucaauaaaauugaacucgauucuuuucuaccuaaacaaaaaauaaaagacaacggaguaauacccagacaaguacaccagaaagaacuugaaauuauacugaaaaacgcugaaaaauauuuuaaauggcuaauagaaaaagaugaaacaggacuuuccgucucagaaaagauaaugaaaaucuuuaaauucaaaauaccuuauuacguuggaccucuaaacucaaaaucaccauuugcauggauugaaagaaaagaauauggaaaaauucuaccuuggaauuuugaaaacaugguagacaugucaaaaacggcagagaaauucauaaagagaaugacaaacaaauguaccuauuuaccugaaaaagauguaauaccaaaaaacagccuacucuauaccaaauacaugguccuuaacgaauuaaacaaucuaaaaauacguggagaaaaaaucaaaguggaacuaaaacaaaaaauauacacagagcuuuuccaaaaaaauaagaaaaucggaaugaaaacacuaaucgaauuucuuaaaucacaaaacauaguuguaacaaaaguugaaauuacaggaauagacggcacguuuaacacaucacucggaucguauauugauaugaaaaaaauauucggcgaagaaaaaauagucaaagauagcuauaagaaaaugauagaagacauaauauuauggauuacucuauacggagaagaaaagaaacuaauaaaguccaaaauugaagaaaaauauccugaaaaaguaacaccagaagaaaugaaauuaauauuaaaacugaaauauagggacuggagccgacuaucaaaagaauuccucacagaaauagaaacuauggacgaagaaacaggggaacuaauaucaauaauagaaaugcuauggagaaaaaacgaaaauaucauggaacuguuaucauacaaauacgacuuuucaaaccgaauaaaggaauacaauggaauaaacgaaaaagaaaaaaauauaacuuacgaagacuuagugaaagaccuacaaauaagccccucuguaaagaaaaugauuuggcgugcacuuguaauaguaaaagaaaucaaaaaagucacaaacaaaucaccuaaaaaggucuucauagaaauggcucgcgacacccaaaccgaaaagaaaagaacagagaagcgcaaagacaaacuccuagaauuauauaaaaacaucaagaacgaugauaguauaaaagagcucgaaaaaaacuuaaaagacaaaacaaacgaugaccuuaaaucaaaaaaguuauaucuauacuaccuacaauuagggagguguauguauagcggggaagucaucagauuagaagaccucaugaacgauaaccucuacgauauagaucauauuuauccacaauccaaaauaaaagaugacucauuugauaacaccguauuaguuaaaaagcaaauuaacgcagauaagacaaacgaauaccccauagauaaaucaauccaaaauaaaugcaaagcuuucuggaccucccuaaaagaacgaggacugaugucaaauacgaaauacgaacguuuaacccgaacggaaggauucuccgaugacgaacucgccgguuucauaucaagacaaauuguagaaaccaggcaagcgacgaaaguccuggcagaccuauuaaaaguaauauucggaagugacacacgaauaguauacgucaaagcaggacucacaucugacuuccgccaaaaauucggaauauauaaauuucgagaacucaacgacuaucaucaugcacacgacggauaccuaaacauuguaacagggaacaucuauaacacauuauucacagacaauccguacaacuucauaaaagauagaaaaaaagauaacagaacauauaaucuuaauaaaguauuugaaagagaaaaugacguauggaaucccgaugucauguugagcaaaauagagagguauaucuacaaaauaagaccccuauucacucgggcaagcuacgaacaaaaagggggcuuuagugaucaaaacauauccucagaaaaagacaaauuaagaccacuaaaaucaucugguguccuuucaaacauuaaguacggaggauacgauaaaaucaaaaacucuuacuuuuucauuguggaauacaccgaaaaaaagaaaaggguaagaaguauagaaacacucccaaucuauauaaaaaagucaauaaguacaaaggaggaccuugaaaaauauuguaaagaagaauuaaaauuacaagaaccuaaaguacuagucagcaaauuaaauuacaaaucccuuauauacucaaacggacacgaauacuauauaaacucaaaaacagcagauuccaucacaauucaaaauggaauucaaauaauccucacuaaagaaaacuacgaaacguacagaaaaauuuacaagaaucucgaauacuuaaaacuaauauauaaggacgagaaaauccgcgaagaaaaaauacucgaaaaaaucccaaaaauauuaaaaaacaauaaaaaugacagagaccucucagaagaugaaauaucagagaaauucuggaagcuauacaaagaaaucuucgaaaaaaucaaaauuggcaucuucaguaaauuuaaauccacacucccuauuuacaucgaggauugcaaaaagcuuaaagacuuuacaacacuaaacaacuacgcuaaaucacgcuucauacaagaaauucuaaagugccuuaacagccaacagggggaauucgacacaaaauauacacauaacuacuccaaaaaauauaacaccaaacucucgaaaucaaaaauacuagaaaacgacuucuacauaauaaaccagucgccaacaggacuuuucgaaaaaaaaguauuccuagauaaauga

SEQ ID NO: 5339 - RNA, 4047 nt, Artificial Sequence
  Cas9 variant
augggagaagauggaaaaccauuaaggguaaaaggaaaaacagccauaggagcacgccuuuuccaagaaggcaauccagcagccgacaggagaauguuuagaacaacacggagaagauugaaccgccgcaaauggcgauuaaaauuacuagacgaaauuuuugaccccuauauaaccccuguagacagcacauucuucgcacgcuuaaaacaaucaaaccuaucgccaaaagacuccagaaaggaauucaaaggcucaaugcuauuucccgaccucacggacaaacaauaccacuuagauuaucccacgauuuaucaccuuagacacgccuugaugacacaggacaaacaauucgacauacgaaugguuuauuuagcaauccaucacauagucaaauauagaggaaauuuucuaaauucaacacccgucgacucauucaaagcuucuaagguaaacuucgaugaccaauuuaaaaaacuaaaugaacucuauacagcaauaaacccagaagaauccuuccaaaucaaucuagcaaacucagaaaaaauaggucagcaauuccucgaccccucaauaagaaaauuugacaaaaaaaaacaaauuccaaaaaucguaccaguaacaauggacgauaaagcuguagauaaauugaauggaaaaauagcaagcgaaauaauaaacgccauacuaggcuauaaaucuaaacuagauguagcaguacaaugcgacccagaagacuccaacccgugggcaguaaaauuugaugacgaagacauagacgcaaaauugcaaaaaauccuacccgagauggacgaaaaccaacaaaguaucauaggcaucauacaagauuuauacucucaaguuacucuaaaucaaauuguuccaaacggaaugucauuaagcgaaagcaugauaaaaaaauauaaugaccaccaugaccaucucaaacucuacaaaaaauugaucggacaaauuagugauucaaaaaagaaaacggcuuuaaaaaaagccuacgaccaauacgucggcaaugauggcaaaguaauugagcaggaugacuucuauucgagcgucaaaaaaaacuuagaugacucugaacuaucuaaacaaaucauggaccuaauugaugcagauaaauucaugcccaagcaacgcacgagucaaaacggaguaauaccucaccaacuccaucagcgggaacuugacgagauaauagaacaucaaucaaaauacuauccaugguuagccgaguccaaccccaacaaacacgaccuacaccuagcaaaauauaaaaucgaagaguuagucgcauuucgaauucccuauuauguaggaccaaugauaaccccugaagaccaaaaaaaauccggagcagcaguuuuuaguuggaugaaacgaaaagaaccaggacaaauuacaccauggaacuuugacgaaaagguugacagaauggaaucagcaaacaaauuuaucaaacgaaugacuacaaaagauaccuaucugaucggagaggauguauuaccggacgaauccuuacuuuacgaaaaauuuaaaguccuaaacgaacuuaacaugguacgaguaaacggggacagucuaaaaguugcagacaaacaggcaauuuaucaagaucuauuugaaaacuauaaacacaucaguguaaaaaagcuacaaaauuauaucaaaggaaaaaccggacuacccaacaauccagagauaucuggacuaucagauccagaucaauucaacaauucauuggguacauauaaugauuuuaaaaaacuauucggagauaaaguagacgacccagacuuacagaaugacuuugaaaaaaucgucgaauggucgacaguauucgaagauaaaaaaauacuuagagcuaaacucaacgaaaucacaugguuaacagacaaacaaaaggaugaccuagaaucaucacgguaccaaggauggggaagacucuccaaaaaacuacuuacagggaucguaaacgaucaaggggaaagaauaauagacgaacucuggaauaccaacaaaaacuucaugcaaauacaaucagaugacgacuucgcgaaaagaauccacgaagcuaacgcugaccaaaugaaaaguacaaauauggaagauguacuugcagacgcauacaccaguccacaaaauaagaaagcaauccgccaagugguuaaaguaguagacgauauccaaaaagcaaugggaggagucgcaccaaaauucauaagcaucgaauuuacacgaucugaagacagaaacccaagaagaacgauaucuaggcaacgccaacuagaaaauacacuuaaagacacagcuaaaagcuuaguuaaaagcaugaacccaaacaucuuaagcgaacuugauaaugcaucuagaucaaaaaaaggacuaacagacaggcuauaccuauacuuuacacaauuagguaaggacauguacacuggggagccgaucaauauagaugaaauaaguaacuacgacaucgaucacaucuuaccacaagcauucauuaaagacgacagucuaaguaaucgcguuuuaguaucaaaggcaguaaauaacgguaaaucagcuaaugucccacuaaaauuguuuggcgcuaaaaugggucacuucuggaaacagcuugcagaagcagggcuuauuaauaaacauaaauugaaaaaccuacaaacuaacccagauacaauaaguaaauuugcuaugcauggguuuauacgaagacaauuaguagaaacaucacaagucauaaaacucguagcaaacaucuuaggagauaaauaucgaaaugacgauacaaaaauaauagaaaucaccgcacguaugaaccaccagaugagagacgaauuuggauuuaucaaaaauagagaaauaaacgauuaccaucacgcuuucgaugccuaccucacggcauuuuuagggcgauaccuuuaccacagauacauuaaacuacggccuuacuucguauauggagacuucaaaaaauuuagagaagacaaaguaacaaugagaaacuuuaacuuucuacaugaccuaacugaugacacccaagcaagaauagcagauaccgaaacaggugagguuauaugggauagagaaacaagcauaaaacagcuucgagaugucuaucauuauaaauuuaugcuaauaucccaagaaguauauacccuccgaggagcaauguuuaaucaaaccauauacccagcuucacaagcaggaagaaaaaaacuaauuccuaugaaagcugacaaacccguggauguuuacggaggguacucgggaagcacagacgcauacauggcaaucgugagaauucaugacaaaaaaggagacaaauauaaaguuguagguguuccaaugcgagcacuuaacagauuaaauacagcuaaaaacguaucagacgccaaauacgaccaagaacuaaaagaaguauuaacaccacaauucaccaaaucgaaaaagaaucgcaaaacaggagaaauaacacaaaccgucgaagauuucgaaguugugcuagguaagguuauguacaggcaacucguaaucgacggcgacaaaaaauucaugcuagguucaucaacuuaccaauacaaugcgaaacaacugguacuaucugaugaaucaauaaaaacucuagccuccgaaggaaaacuuaaugaagcacaagagucugcagcauaugacaaaguauaugacgaaauccuugauaaaguaaacaaauacuucgcccuauaugauacaaacaaauuucggcaaaaacucagucucggaaaagauaaauucgucggacuaccaaaucacaacguauuugacggaucaaaaaaaaucucaucaggaaagcgcgaaauacuuaacgaaauucuaaacggacugcacgcgaaugcaacacuaggcacacuuucugacaucggcuuuucaacacccuuuggaaaaaugcaacaaccucgaggcaucggacugagcucaaauacuucuauugaauaugaaaguuucaccgggcuauucaaacgaacaauauucuugaaagaccuauga

SEQ ID NO: 5340 - RNA, 4047 nt, Artificial Sequence
  Cas9 variant
augaagaaaccauauacgauugcacuagauauaggaacaaacuccgucggauggguaguugucacugacgacuaucgagucccuacaaagaaaaugaaaguacuuggaaacacugaaagaaaaaccaucaagaaaaaucuaaucggagcauuauuguuugauaguggagacacagcagagggcaccagguuaaaaagaaccgcaagaccaagguacacaagaaggaaaaacagacucagguuuuuaaaagaaaucuuuaccgaggagauggccaaaguagaugauggcuucuuucaaagacuugaagauucauucuacguacuugaagacaaagaaggaaauaaacauccuauuuucgcaaacuuagcagaugaaguagccuaucacaagaaauauccuaccauauaccaccuaagaaaagaauuaguugacaacccgcaaaaagcggacuuacgacuuaucuauuuagcagucgcacauaucauuaaauucagaggacacuuccuuaucgaaggcaccuuaaguuccaaaaacaacaaccuacaaaaaucauucgaccaccuaguggacacauauaacuuacuuuuugaagaacaaagguuacucacagaaggaauaaacgcuaaagaacuuuugucagcagcacuuucaaaaucaaaaagacuagagaacuuaaucucauuaauaccaggucaaaagaaaacuggaauauucggaaauauaauagcauuaagccugggccuuaccccgaacuucaaagcaaacuucggcuuaucaaaagauguaaaacugcaauuagcaaaagauaccuaugcagaugaucucgauagccuauuagcucaaauaggagaccaauaugcagacuuauuucuagcugccaaaaauuuaagcgacgcgauacuguuaucagacaucuuaacugaaucagacgaaauaacuagggccccacuaagugcgagcaugguuaaacgauauagggaacaucacaaagacuuaguuacacuaaaaacacuuauuaaagaccaauuaccagaaaaauaucaagagauauucuuagacaaaacuaaaaauggauacgcaggauacauagaaggccaagucagucaggaagaauuuuauaaauaucucaaaccgaucuuagcuagacucgacggaucagaaccauuauuacuaaaaauagaccgagaagacuuucuaagaaaacaaagaacguucgauaaugggucuauaccacaccaaauccaccuagaggaacuccaugccauacuaagaagacaggagguauuuuauccauucuuaaaagacaauagaaagaaaauagaaucauuacugacguuucgaauaccauacuacguaggcccacuggcacguggucauuccagguuugcauggguaaaaagaaaauuugauggcgccauccgaccauggaauuuugaagaaaucguagacgaggaagccucagcacaaaucuuuauugagaaaaugacgaaaaacgaucuauaccuucccaacgaaaaaguacuuccaaaacauucccuacuuuacgaaacauucacaguauacaaugaacuaacaaaaguaaaauacgccacagaaggcaugacacgaccgcaauuucuaucggcagaucaaaaacaagcaauuguagaccuauuauuuaaaacaaaccgaaaaguaacaguaaaacaauuaaaagaaaacuacuuuaaaaagauugaaugcugggauucuguagaaaucacaggaguagaagacucguuuaaugcaucacuaggaaccuaccacgacuuauuaaaaauuauacaagacaaagacuuuuuggauaacccggacaaccagaaaauuaucgaagauaucauauuaacccugaccuuauuugaagacaagaaaaugauuagcaaaagacuagaccaauaugcucaucuauuugacaaagucguauuaaacaaauuagaaaggcaccauuauacaggauggggacgucucucgggcaaacugaucaacggcaucagagauaaacaaucaggaaaaacaauuuuagacuuccucaaagcagacggauuugcaaaucgcaacuucaugcaacuaauacaugacucagaacuuagcuuuauagacgagaucgcaaaagcacaagucauuggaaaaacagaauauaguaaagaccucgucggaaauuuagcaggaucuccagcaauaaagaaaggaauaagccagacaauaaaaauuguagaugaacuugucaaaauuaugggguaucuuccacaacaaauaguuauugaaauggcaagagaaaaccaaacuacugcccaaggaauuaaaaacgcacggcaaagaaugagaaaacuagaggaaacggcaaagaaauuggguucaaauauacugaaagaacacccagucgauaacagucaauuacaaaacgauaaacgauauuuauauuaucuccaaaauggcaaagauauguacacaggugacgaccuagauauagauuaccuaucaaguuacgauauagaccauauaauaccucaaaguuuuaucaaaaauaauagcauagacaauaaaguucugacaagucaaggagcuaauagaggcaaauuagacaaugucccuucagaggcgauuguaagaaaaaugaaaggauauuggcaaucgcuccucagagccggugccauuucuaaacaaaaauuugacaaucuaaccaaagcagaaagaggaggacuuacacaaguagacaaagccggauucauacaacuucaauuaguagaaacuagacaaauaacaaaacauguagcacaaauacuagacucgcgguucaacacagaguucgacgaccauaauaaaagaauacguaaaguucacauuauuacacucaaaucaaagcucguaucagacuuuagaaaagaauuuggacuuuacaaaauaagagacauaaaucauuaccaucacgcacacgacgccuaucuuaaugcaguaguagcaaaagcuauacuagggaaauauccacaauuagcgccugaguucguauauggagacuacccaaaauacaacucauucaaagaaaggcaaaaagcaacacagaaaacguuguuuuauucaaauauucuaaaauuuuucaaagaccaagaaucuuuacauguaaauucagacggagaagaaauauggaaugcuaauaaacaucuacccaucauuaaaaacguucuuucaauuccacaaguaaauauuguaaagaaaacggaaguucaaaccggaggcuucuacaaagaaucaauauuaagcaaaggaaacucagauaaacuaaucccucguaaaaacaacugggacaccagaaaauauggcggauucgacagcccuacaguugcauauucaguacuuguaauagcaaaaauggaaaaaggaaaagcaaaaguucuaaaaccugucaaagaaaugguagguauaacaauaauggaaagaauugcuuucgaagaaaauccaguggucuucuuagaagccaaaggauacagggaaauacaagaacaucucaucauaaaacucccaaaauacucucuuuuugaauuggaaaacggaagacgaaggcuacucgcgagcgccucagaacuucaaaaagguaacgaacuguuuuuacccguugacuacaugacauucuuauaucuugccgcucauuaucaugaauuaacagguucaucagaagacguccuacgaaagaaauauuucguugagagacauuuacacuauuucgacgacauuauacaaaugauaaacgacuuugccgagcgacacauccuugcaaguucuaaucuggagaaaaucaaucacacauaucacaacaauagcgauuuaccaguuaacgaaagagccgaaaauauuauaaauguauucacauuugucgcacuaggagcaccagcggcuuuuaaauucuuugaugccacuauagauagaaaaagauacacuucaacaaaagaagucuuaaacgccacccucauucaucaaaguguaacaggccuguacgaaacgcgaauagaucuaagccaacuaggagagaauuga

SEQ ID NO: 5341 - RNA, 4050 nt, Artificial Sequence
  Cas9 variant
augaaacaaaaauuuuacguaggcuuagauaugggcaccgcgucuguuggcugggcagugaccgaugacaaauacaacauuauaaaaagacacggaaaagcacucuggggaguuagauuguuuaaaacagcuaacacagcagaagagagaagaauauuccgagcagcaaggagacgaacacaaagaagaaaacaaagaauggaacuccuacaagagauauucggagacgaaauaagcaaaacggacauaggauuuuaccaacgaaugaaggaaucaaaauacugguuugaagauaaacgagacauaaaugguaaacaacccgaacuaccguacgcccuauuuguugaugacggauuuacggauaaagacuaucacgaacaauuuccuacaauauuucacuuaaggaacguccuaguaaaugaauggacucaaaaguaugauauccgacuagucuaucuugccauucaccacaucauaaaacaucgcggacauuuuuuauuugaagguaaaaaaaugagcgaaguaacagauuuuggaagugcauuugaagcauuuuguaaagucgccucagauaaugacaucgagauaacuguagaugaagagaaguuaaaagacauagaagaccuacuuaaaucgagacaaaaaagcaaaacagcaaaaaaacaagaacuagguaagauuauagcgggagcugacaaacaaaaaaaagcucuggcggcacuugugacaggaugcaugguuaaauuaucagaaauauucgcagauaagucuuuagaugauggggaaagaaacaagauaucguuugcagauuccaacuacgaugaauacauugcaaacguugaagaaacgcuagcagaaagguuccuccuuauagcagcugguaaagcccuguaugacugggcagugcuaucagacauacucgaaggaucaacauacaucucagaggccaaaguuaagauuuacaaaaagcacggagacgaccuacgaaaacuuaaaggauuauuaaaaacucgaccagaugaauacaaacuaauuuucggccuaccagaaaaacaagccaauuacagcgcauauauaggaaugguaaaaaaaaacgguaagaagguacccauagauaaaaaauguacaaaagcugacuucuauucauuccuuaagaaaacccucaauaaaauuaauuuugaggacgaaaaggagagagaaaucgcagaaucuaucauuaacgaaauagagaacgaaacauuccuaccaaaacaagugauaagcgacaacggaguuauuccuuaccaacuacaugaggcagaauuagacagaaucuuaaaaaaugcagcccuauauuauccguucuuaagcgaaaaagaugacgagggguacacaaauauggauaaaauaaaagcaauuuucaaauuuagaauuccauacuauguuggccccuuaaauacauaucauucugacaaggggggaaacucuugggcaguuagaaaacaagauggaaagauauacccuuggaauuucgaaucaaaaauugaugcaggagaaagugcacgaaaauuuauaggaagaaugacaaauaaauguacauacuuaauuggaaaagauguacuaccaaaagaaagucuacucuauuccaaauucaugguacuaaacgaacuaaauaauuuaagaauagauggagaaaaagugaguguagaaauaaaacaagcaguauacgaaaauguguuuaaaaaauaccagcguguuacuggaaagaaggucaaagacuuucugaucagaagcggaaucaucgggagagaacaagaacuuagugguuucgaccaaaauuucaagucaagccuaaaagcauaucacgauauuaaacagaucgcaggagacauaaaucuaucucaaaaucaaaaagaagacauaauaaaagaaauuacuguauucgcagauagccaaaaaaugcuaaaaaaacgccuaaaaauaaaauauccagaacuaagcgauaaacaaguaacaaaauuagcagccaaaaaauauacaggauggggccgacuaagcagagaauuucuugaagaagucgaaaguguaaacaaagaaaccggugaaguacucaauauuaucagugcuuuaugggaaacaaacgagaaucuaaugcaauuacuaaguaauaaauaugauuaccuuagugaaauaaagagacuaaaugacgaagccgaagauaaauccgaaguuguuacauaugacgauguacagaaauuguauguaucacccgccguaaaaaggccaguauggcaaacacuuaaaaucgucgaagaaauaaguaagauaauggguucaaagccagaaagaauauuuguagaaauggcuagagagcccggacaaaaaggugaugucaaagucucaaggaaaaguagacuucuagaaaaguauaaauacuguaaaaaagaggcaccagaaauauacgaaaaccucguaaaagaagaugauaacaaguuacgaucagauaaauuguuuuuauauuauacccaaaugggcagguguauguauaguaaugaagucaucgacaucgaggacuuauucacaaacagauacgauauagaccacauauacccacagucaaaaguaauggaugacucgcuagauaacagaguucuaguaaaacgcgaacuaaauucaaacaagacagacguguuuccagucccaaaagaguauauggauaaggcgaaaacacucugggauauguuaaaaaaaaaagaucuuauaaguaaagaaaaauaucauagacuaacucgaagagauggauuuagugaaaacgaacuaucagguuucauagcaagacaacuaguagaaaccaggcaaaguacaaaagccgucacacagcuacuaacgaaagcuuauccggaaucugaaaucguuuaugccaaagcaaacgcgguaucagaauuuagacauaaguucggauuuaccaaaguuagaucgauaaaugacuaucaccaugcuaaagacgcauaccucaauaucguagucggaaauacuuauuaugugaaauuuacaaaagaugcagccugguucauaagaaauaacccagguagaacauacaaccugaaaaagauguucgaacaaggcacgguaucuagagguggagaaacagcuugggucucaggagaagacgggacuauauuuacaguuaaacgaguaaugggcaaaaacaacauauuauuuacucgaaaagcguaugaaguacgagguggauuauucgaucaacagaucaugaaaaaaggaaaaggacaaauucccguaaaaaacaacuccgaagaugaccguuuaugcgcuacagagaaguauggugcauauaacaaagcaucgggagccuauuuuaugcuuguagagucagaagauaaaaaaggaaauaaaauuagaacauuagaauuugucccgguguacuuagcaaaagaauuggaaaagucagaagacgcagcaaucagauauugugucgaaaaacuagaauuaaaaaauccagauguuagaguuagaaaaaucaagauggauagccuauucaauguagauggauuucgaaugcaucuaaguggcagaacuggaaaacaauuaauauucaaaugugcagaacaacugguccuagacgaggaaucacaaaaaauccucaaaaaaacugccaaaguguucgcagacuauaaagagaauaagaacaucaaaaucuccgacaaaaucgaauuaaccgaugaaaugcucauaaaacuauacgagcuauuuuacaaaaaauuaaaagauacuguauacaacauacgauuaucaacacaaguaaaaacacuugaaucuggaaaagaaaaauucgaaaagcucagccuucucgacaaauguuugguaauagaagaaauucuccaucuauuccaaugucagucagucgccgcaaaucuuucaucaaucggaggcgccgcaacagcaggaauauuaguccuaaauaaugaaaucucuagaugugggaaaguagaaauaauaaaucaaagcauuacuggauucuacgaacaaguuauagauuuaaaaaauauuuga

SEQ ID NO: 5342 - RNA, 4050 nt, Artificial Sequence
  Cas9 variant
augcagaaauauuaucuaggccuagacaucgguacaaauaguguugguugggccguaacugaugaaaacuacaaccuauguaaauuugguggcaaaagaauguggggcauacgauuauucgauggagcacaaaccgcugaagaacgaagaaugaauagaagcaauagaaggcgacuuaguaggcaaaaacaaagaauagaccuuuuacaagaauuauucgcaaaagaaauagcuaagguagauccaacauucuuuauuagacugaacgaaucaagacuguauauggaagacaaaucaacaggaacaaaauuuccacuauucgcugauccgggauacacagauaaagaauauuauaaagaauacccuacaauauaccacuuacgccaagaacuaauaaaaaaccccgaaucacaugacauaagacucguuuaucuggcgugucaccacauucucaaaaauagaggacacuuucuaauaaacgguaguuucucagaucugaagaauuuaaguuucguaugccgagaaauguuagacgccuuuaacgaauuaucuaaauaccagcugaugauaucagauaucgacgcauuagaaaaaauacucucggacagaaaacaacaaaaaucugcaaaaguaaaagaacuagugcaaauauucgaaugcguaccaagagaagauaaaucagaugcaaaaauuuguaaagaaauacuuucuaauuuaugcaaauuucuagucggugcaaaaggaaacauuacccgacucuuugauacagacuucgaugaaauggaaacgucaucauuuucauucggagauaguaaauaugaggauagccuacuuccuucauuagaagaaaauuacccagauuacgcuaacguaauucagaaaauaaaggcaauguacgacuggagcguccuuguagaaauaauggcaggagagaacuaucuuucauuugcaaaaguaaacgccuacaaaaagcacaaagaaaaucuuucaauacuuaagucccugaugaaaaaauauuguacuccagaugucuaccaacgauucuuuuaugaaacugacgaaaaaucuagcuacggaaacuacauuggcgccauacauaacaacggacauucacacacaaugaaaaaaugcgacgaagaaacguucuauaagucacuauccaaaauauuagauaaacuagucguucaaaagacagaccaagacacacuugagauacuaaaaaaagaagcaaaaaaccaaacauuacucccuuuagccaggacaaaagccaauggaguaauuccaaaccaaauacacauacaagaacuuagagcaauccuggacaacgccaagacauacuuaucauucuuaaaugaagccgacgaauacgguacuauagccgaaaaaauaauacguaucgcaaaauucaagauuccuuauuaugcuggcccacucagcacucgacacaaagaacagggagcaaacacauggauaguccgaaaacaggaaggccgaaucuauccauggaauuuugaagagaugguagaccuagagaggagcaacaacgaauuuauaagaaggaugacaaauaaauguacauauuuaauaggagaagauguucuccccaaaaacucacuacuauacagcaaauucaugguacugaaugaacuaaacaaucuaaaaauacguggacacaagaucuccguagaauuaaaacaagaacuauauaaagagcuuuucuguaagaaagccaaagucaccggaaaagcacuuuuaguauauuuaaaaaaaaaagacgcagagcuaacacucgaggauaucucaggauucgacgcagauuucaaaaguagccucaguaucuacauugauuuuaaaaaucacauccuacgagaacaaauagaugauggcaaauaccaauccauaguggaaaauauuauaaaauggaaaacgaucuuugauguagacucaaaaaugauagagaaauugauagcacgcgaguacccaaacauguuuuccucugaacaaaucaaaaaaaucugcagauuaaaauguagaggcuggggcaacuuuucaagcagauuucuuaacggaauacaaggugaaaacacagagacaaaagaguguuuuaccauaauugaagccuuauggaaaacaaacuauaaccuuaugcaauuauuauccaagcaauucacauuuaaagaugcuauagacugcauaaacgccgauaaaguuggcaaaauagacaaagugacauaugaaaacacaguaaaagacuuagugguaucccccgcgaacaaaagggcaauuuggcaaaccguccaaauaacagaagagaucaaaaaaguaaugaaaugcgaaccagaaaaaauauucguagaaauggcucgaggaggagaaaaagaaaaaaagagaacaauaagucggaaggaacgacuauuaaaauuauacauggauuauaaagacgaaaaucgagacuggauaaaagaaauugaauccagagacgaacaagacuucaccaaucgaaaacuauaucuauauuauacacaaauugguagguguauguacucaggagaggaaauaagucuugaagaacucaugcaaaaaaauaguaaaugggacaaagaccacaucuacccacaauccaaaauaaaagacgacucacuagauaacuuaguauuagccaggaaagacauaaauaauaacaaaucaaauaaauuauuaccaacuggaauucaagauaaaaugaaaaaauauuggaaaaugcuacuaaaauacgguuuuauuaguaaaaagaaauaugacagauugaugaggacagaagacuucagcgacgaggaacuauccggauucauagcaagacaaauugucgagacuagacagucgucaaaagcuguagcugaauuacuagaacauuuaaaugaacauacagaaauaguuuacgucaaagcagaacucguaucagauuucagacaugauaauaacaugcuuaaaagucgaagaauaaaugacuaccaccacgccaaagaugcauucuuaaauauaguagugggaaacguauacaaugcuaaauucacagcaaacccccggaacuggauaaagaaaaaccgcaacacaaacuacucaauacgcagaguauucgacuauacaguaaaaagaggcucaacaaucgucuggcaaggaguuaaagacggcggacacuccauagauggcauuaagaaaacaauggcaagaaaugacauauuauacaccgaaagaacauauugugaacaaggcgaacuauucaacgccacauuaauaaaaaaaggaaauccgaacgcuauaggacuaaaaaaaggacuagacccaaugaaauaugguggauacucaaguccgaaaacuagugcauucgccuucaucgaauuugauggaaaaaaaggccgacaaaaucaccuaguggaaaucccgguauauauagcgaauauagcagcuagacaaccagaauauauaaagaaucaccuggaagaaaagaaggguuaucaaaacgucauuguuaaaaaauaucccauacaaaaaaacgcacuuauuaaacucgauggauacccagcaagacuacgcggugcaaacgaaaaaucaauaacacuaaagaacgcuguacagcucgugcuuaagccagaauaucacgagacgauaagaaacguugaaaaauacuuggaauacauagauaaagacgagucaguuaguaaggcagcacgauuuagccacacagaacuagacaaacucuacgaugaacuaugcuuuaaagcagaaaauaguauauauaaaaaacgcccagcaaaccaaucagcaacuuuaaaaaauggacaaaaaacauuuuuagccauaacaaauuuaaaagaaaaagcacaagucaucaauaacauaauaacgauguuuagaugcgaugccacaacaacuacgaaucuaaaaacgauagggggaucagcuaacgcaggaggaaugcaagugaacaaaaacacacuaacaucacagaaaguaguauuaguacaccaaaguauuacaggccucuucggaacagaagaggaacuguuguga

SEQ ID NO: 5343 - RNA, 4053 nt, Artificial Sequence
  Cas9 variant
augaagaaaccuuacucaaucggccuagauauugguaccaauucaguaggaugggcgguggucacagacgacuacaaagucccggcgaagaaaaugacaguuuuaggaaacacugacaaaucacauauuaagaaaaaucuacuaggagcauuacuuuuugacucaggaaauaccgcggcugacagaagacuaaaaagaacagcacggcgaagauauacacguagaagaaacagaauccuauauuuacaagagauauucgcagaagagaugucuaaaguagaugacucauucuuucaccgauuagaagauagcuuucuaguaacagaggauaaaaggggagaaaggcacccuauuuuuggaaaucucgaagaagaaguuaaauaccaugaaaacuuuccuacuauauaccaccuaagacaauauuuagcagacaacccggaaaaaguagauuugcgacuuguauacuuagcgcuugcucacauaauaaaauuccgcggucauuuucuaauagaaggaaaauuugacacaagaaauaacgacguccaacgacuauuucaagaguuccuugcuguuuacgauaauacauucgaaaacaguucacuacaagagcaaaacguucaaguagaagaaauauuaacagacaaaaucuccaaaucagcgaagaaagacaggguacuaaaacuuuuuccgaaugaaaaaucaaauggacgauuugcagaauuucucaaacuuauaguaggcaaucaagcggauuucaagaaacauuucgaacuggaagagaaaacaccauuacaauuuucaaaagacaccuaugaagaagaacuagaaguccuacuagcacaaaucggagauaacuaugcugaacuuuucuuaagcgccaagaaacucuaugacagcauacuacuaucagggaucuuaacuguaacugaugucucaacgaaagcuccucucucagcauccaugauacaacgguauaacgaacaccaaauggaccuagcccaauuaaaacaauucaucagacaaaaauuaucagacaaauacaaugaaguuuucagcgacgucucaaaagacggcuacgcuggcuauaucgauggcaaaacaaaccaagaagccuucuacaaauaucuaaaaggauuauuaaacaaaauagaagggagcggauacuuuuuagacaaaauagaaagagaagauuuucucagaaaacaaagaacauucgauaauggaucaauuccacaccaaauacacuuacaagaaaugagagcaauaauacgaaggcaagcagaguucuauccauucuuagcugacaaccaggauagaauagagaaaauccuuacuuuccgcauaccauacuauguagggccauuagcgcgaggaaaaagugauuucgcguggcucucgaggaaaucugccgacaaaauuacaccauggaacuuugaugaaauaguagauaaagaaucaucagcagaagccuucauuaaccgaaugacuaacuaugaccuauauuuaccaaaccaaaaaguacucccuaaacacucccuucucuaugaaaaauucacaguauacaaugaacucacaaaaguaaaauauaaaacagaacagggcaaaacagcauucuuugacgccaacaugaagcaagaaauauucgauggaguauuuaaagucuaucgaaaagucacaaaagacaaauuaauggauuucuuagagaaagaauuugacgaguucagaauaguggaucuuacuggccuugauaaagaaaacaaagcauuuaacgcuucauacgggacauaccacgauuuacgaaaaauacuugacaaagauuuucucgauaauagcaaaaaugagaaaaucuuagaagauauaguauuaacucuaacacuauuugaagaccgugaaaugauaagaaaaagauuggaaaauuauucagacuuacucacgaaagaacaggucaaaaaguuagaaagaagacacuacacaggauggggucgcuuaucggccgaacuuauccauggcauacgcaacaaagaaucccgcaaaacaauacucgauuacuuaauugacgauggcaauaguaacaggaacuucaugcaacuaauaaacgacgaugcuuuaaguuuuaaagaagaaauugcaaaagcacagguaauaggugagacugauaaucuaaaccaaguaguaucagacauagcaggaagcccagcuaucaagaaagguauuuuacaaucacucaaaauagucgacgaacugguaaaaaucaugggacaucaaccagaaaacauaguagucgaaauggccagggaaaaccaauucaccaaucaaggacgacgcaacucccaacaacgcuuaaaagggcuaaccgacagcauaaaagaauuuggaucacaaaucuuaaaagaacacccagucgaaaacagccagcuacaaaacgacagguuauucuuauacuauuuacaaaacggacgagauauguauacuggugaggaacuagacaucgacuaccuuucccaauacgacauagaccacauaauaccacaagcauuuaucaaagauaacaguauugauaauagaguuuuaacuagcagcaaagaaaauagggguaaaagcgacgacguaccaucugaagacguaguaaaccgaaugcgaccauucuggaauaaauuacuuucuuccggucucauuucacagcgcaaauauaacaaccugacuaagaaagaacuaacaccagaugauaaagccggauucaucaaaagacaauuaguagaaacaaggcaaauaacaaaacauguagcaagaauguuagaugaaagauucaacaaagaguucgaugauaacaacaaaagaauaagacgaguaaaaaucguaacauuaaaaucuaaccuaguuuccucauuucgaaaagaauuugaacuauauaaaguacgggaaauaaaugauuaccaucaugcccacgacgcauaccucaaugccguaguagugaaagcucuauugguaaaauauccaaaacucgaacccgaguucgucuauggcgaauaucccaaauauaacucauauagggaaagaaaaacagcuacccagaaaauguucuucuauucaaauauaaugaacauguucaaaucaaaaguaaaacuagcggacgaucaaauuguagaaagacccaugaucgaaguaaacgacgaaacaggugaaauagcuugggacaaaaccaaacauaucacaacuguaaagaaaguacucagcuacccccaagucaacauaguuaagaaagucgaagaacaaacaauaggacaaaacggaggucucuucgaugacaauccaaaaucaccucuagagguaauaccaagcaaacuugucccuuuaaagaaagcacuaaacccagaaaaauauggaggcuaucaaaaaccaaccacugccuacccuauacuucuaauaguagacacuaaacaauuaauaccgauaaguguuauggauaagaaaagauucgaacagaauccaguaaaauuuuuaaaagauaaaggauaccaacaaauagagaaaaacaauuucguaaaauuaccaaaauauacccuaguggauauuggcaacggaauaaaaagacucugggcuagcagcaaagagguacauaaaggaaaccaacuuguaguauccaagaaaucgcaggaucuauuauaucaugcacaccauuuagacaaugauuacucaaacgaauaugugaaaaaccacuaucaacaauuugauauauuauucaacgaaauaacaaguuucucuaagaaaugcaaacuaggaaaggaacacauccagaaaaucgaagaagcauacucaaaagaaagagauucagccuccauagaagaauuagcggauggauucauaaaacuacuuggauuuacacaacuaggagcaaccucaccauucaguuucuuagguaucaaacuaaaucaaaaacaauacaccgguaagaaagacuauuuauuacccugcauggaagccaccuuaauccaucaaaguaucacuggguuauacgaaacccgaauagacuuaucaaaauuaggaggagauuga

SEQ ID NO: 5344 - RNA, 4053 nt, Artificial Sequence
  Cas9 variant
auggggaagaacuacuaccuuggguuagacauggggacaucaucagugggaugggcaguaaccgaugaaaaguacagaauuuuacgcgccaaaggaaaagaucucuggggagugcgccuauuuagugaggccaaaacugcagcggaaagacgaacacacagaacaaguagaagaagacuagacagagaaaaggcaaggauagccugccucaaagaaauguuugcagaagaaauuaauaaaaucgauccaggauuuuaucaaagauuaaaugacuccaaauacuuccuagaagauaaaaaagagcaucaaccguaugcaauauuugccgacacaggauacacugacaaagaauacuacgacgaauacccaacaauauuccacuuaagaaaagcccuacucaacauagaaaaugacaaaaaaaaauacgauguacgauuaguauaccuggcaauacuuaauauguucaaacaucggggucacuuucucaaugcuaaccuagaugauaaaagugggggaaacuugaaagaauacauagagaugcuacaccaaucaaugguuaacaucuuaaauauuaaucuaaaaaacguggaaauagagaaaaucgaaaaaauauuaaaaucuacccaauacucaaauuccgaaagacuagagaaccuguuagaacuauacgaacugagcaaaaacaaaaacaaaauagaaacggagaucuucaaauuuauauguggacuuaaaggaacaauauccaaaauuuacguagaagauaaauucgaagacgaauuugcuaaaaugacacuaagcuuucgagacuccaauuuugacgaaaaaauaauagaaauagaagauaauuuggacgaugauaaauaugacauguuccuucuaauaaaacaaauacacgauuggucuguauuagcaaauauaaugaacggagaagaauauuuauccguagcuaggguaaaacuguaugauaaacacaaaaaagaccuggagguucuaaagaaauauuauaagcaaaauucgauggaagaguauaauaaaauguuuagacaaaugaaugacggaaacuauagcgccuauguaggcuccguaauuuauaaagacaacucaguacgcaggggcugcaagagcaaaaaggaagacuuuuacaaaaauauacugaacacaaucaaaaguugggaagauugugaggcaaaagaguacauaaccucagaaauagacaaaggcaauuuucuaccaaagcaaauaaccgcauccaauggagucauacccaaucaaguacacaaaaaagaacugaaaaaaauacuuaaaaacgcaucagaauacuuaaauuuccuuaacgaaaaagacgaauccggauacacaauaagcgaaaagauaguaaaauuauucgaauuccaaauaccauauuacguaggcccuauagcauacaacaucggaaacgacgaaucgaaacaccgccauaacauguggaguguuagaaaggaaaaaggaccuauauacccauggaacuuugaacaaaaaauagauauaaaaaaaucuagugaaaaauucauuagaaaccuaauaaaccauuguacauauuugaacgacgaagaaguauuacccaaaaacagccugcuauaugagaaauuuaugguucucaacgaacuaaacaaauuaaaaaucaauggcgagaaaaucucgguugaacuaaaacaaaauauauuuaaugacuuauucaaaaaagggaaaaaaguaaccaaaaagggacucauuaaauaccuaaaagagcaaggugaaauagauaauugcgaagaaguagagaucucaggaauagacggagacuucacaaacaagcuaucaaacuacaaaaaauucgcggacauauuuggaguacaaagucuaaccuacgaacaaaccgacaucgcagagaauaucauaagguauucaacuaucuacggagacagccggaaauucuuagaagaaagaauuagggaagaguacucaaauguacuagacgaaaagcaaauuaaaagaauacuaggaaugaaauuuaaagacuggggaagauugagcaaagaguuacuagaacuaucaggcgucgauaaagaaacaggagaaauugcaucggugauaaguagaauguggaacgauaacuacaauuuaauggaauuaauagcuacugagagguucagcuacgcuuaugaaauagaacaacgauccaaaaaacuagaaaagacuauuucaacuauagaauaugaagauuuagacgaacucuauaugagcacgccaguaaaaagaaugguauggcaaacaauauuaguacucaaagaacucgaagaaguacuaggauguccuccaaagagaaucuucguagaaauggcgagagacguaaaugcaccaaaagacagaaaagacucacguaaaaaaaaauuauuagaacuauauaaaaauuguaaaaaagaagaaggcgacuggucaaaagaacuaaaugcacgagaagaaagcgaauuuaaaaguaaaaaauuauacuuauacuauaugcaaaaaggacgguguauguauaguggaaaaccaaucgacuuaaagaaucuacuuaaugauaauuuauacgacaucgaccauauauaccccagacacuuuguuaaagaugauucaauagaaaauaacuuagucuuaguagagaaaaacuucaacgcucacaaaucagauaacuacccaauagaaaacgaaauaaggcagaaaaugcacuccauguggaagaugcuuagagacggcaauuuuaucacagaggaaaaauacagucgccuuaucagaaaagaggaauucaccgaugaugagaaagcaaaauucauaucacgacaaauuguagaaacaagacaaggaacgaaggucauaacagaccucuucgaacaaacauucccagaaucugacauaguauacguaaaagccggaaauguaagcgaauucaggcauaaauuuaagcuaauaaaaugucgcaacguaaacgacuuccaccacgccaaugacgcauacuuaaauauaguaguuggaaacguauacuacacgaaauuuacaaaaagugcacucaauuuuauaaaagacuacaagaaaaauccagaaaagaacaaauaccacauggaucacauguuccaauaccccguaucuaggggcggaguagacgcauggauaacaaaaggcgccgaaagcauaaguaugguacgaaaaaugauggcaaaaaacaccccaaugguaacaagaaugaacuaugaaaagcacucgggucaaaaaggcggaauauccgaccaaaauaucuguucagccaaaaucgccaaaaaaaauguauaccuaccaauaaaaaugggugacgaaaaacuaaaaaacguagagaaauaugguggauacggguccuuaacagccaaauacuuuuuccuuguagaacauacaauaaaaaaaaaaagaaucagaacgaucgaagcauauccuauguaucuagacgcacuaaacaaagaaaacaaacuacucaauuacuguguacaaguccuugaauaugaugaaccgaaaauaauaauggaaaaaauaaaaguuaagagucuguucaaaaucaacggguauuacuacuacuuaaacgcaaaaucaguuaauagaauaauauggggaaacgcaacacaacuauuucuggaaaaugauauaaacgaauacguuagaaaaauaaguaaaaacauagaauguauagauauuaauucagaaaauaacaucaaaguauacgacauauuuauagaaaaauauucaaacaaacuauuuaguaauaggcuaggcaaccugaaagaggcgauaauccaaaaccgcaacaaauuuauagaacucaaaaucaaugaacaaaucaauguaaucuuagaacucguaagauauucacaggacgguguguacagcaucaaucuuagucaauugggacucuccucaacuuaugccauaaauaggacuucaaaagagauaaguaaaaugaaagaaugcaaacuaaucaaucaaagcguaacaggacuauaugaaaacgaaauagauuuauuaacuguauga

SEQ ID NO: 5345 - RNA, 4053 nt, Artificial Sequence
  Cas9 variant
augcaacaauauuaucugggcgucgauaugggaagugcgagcguggguugggcagugacugaugaaaaauaccaauuagucagaaagaaaggaaaagaucucuggggaguuagaacguuugauauagcucaaacugcagagguacgccgcgucagcagaacgaacaggagacgacagaacagaagaaaacaaagaauccaaauauuacaagaacuauuaggggaagaaguauuaaaaauagacgccggauucuuccaccguaugaaagaaucacgauauguugccgaagauaaaagaacacucgauggaaaacaaguagaacuuccauaugcucuuuucguagaucaaggcuuuaccgacaaagacuucuacaaacaguuuccgacaaucaaucacuuaauagucuacuuaaugacgacaucggauacaccagauaucagauuaguauaucuugcacuucacuauuauaugaaaaauagaggcaauuuucuacacucuggugacaucaaugauguaaaagacauacaaaguauuuuagaacaauuggaaaacguucuaaaagaauacguugacgauugggagcucagucucaaagacaaaguggacgcuauaaaagaaauuuacaauaaagaccugggacguggugaaaggaaaaaggcauucauaaacacguuaggaguaaagacgaaaucugcuaaagcauuuugcucacucauaagcggcggaucaaccaaccucgcagaauuauuugacgacucaggacuaaaggagucagaauaugcaaaaauugaguucgccaacgcaaacuuugaagauagugucgaaggcauucaagcacuauuagaagauagauuugcaguaauagaagcagcaaaacgacuuuacgacuggaaaaucuuaacugauauucuaggagacaaugcaucacuggcugaagccagaguaaaaucauacgaaacucaucacgaacaacucguugaguuaaagagcuuuauaaagaaauauuuagacagaaaaauauaccaagacauauuuaucaacccaaacaucgcgaauaacuaucccgcauaugugggacacacaaaaauaaauggaaagaaacaagaacuagaaguaaaacgcgccaaaagaaacgacuuuuacgcauauauaaagaaacaaguaaucgauccgaucaaaaagaaaguaucugauaaagcaguucuagcacgauuagccgaaauagagagcuuaauagaaguuaauaaauaccuuccauugcaaguaaacucagacaacggcgugauaccauaucaaauuaaacuaaacgaauuaagacgaauauucaauaacuuagaaaauagacuaccaguguuaaaagaaaaucgagauaaaauuaucaaaacauuuuccuauagaauacccuacuacgucggaccuuuaaauggcguuaaccguaacgguaaaucaacgaacuggaugguucgaaaagaaggggaagaaggaaaaaucuacccauggaacuuugaagaaaaagucgaucuugaagcauccgcagaaaaauucaucagaagaaugacaaacaaauguacauaccuaguaaacgaagacguacuacccaaauacagccucuuauauagcaaauaccucguccuauccgaacuuaacaaccuacggcuugauggaaggccauuagaaguaucgguaaaacaagaaauuuacgaaaauguauuuaaacggaacagaaaaguaacacuuaagaaaaucaaaaauuaucuucuuaaagaagguguuauaagcgaaaaagacgaacuaaguggacuagcagaugacguaaaaagcucccucacagccuaccacgauuuuaaagaaaaauuaggacacuuaacccuaacggaagaccaaauggagaaaaucauucuaaacgucacuuuauucggcgacgauaagaaauuacucaagaaacgacuagcagcauuauauccuaauauagaugaaaaaucgcucucccgaauggcaacauuuaacuaucgugauugggguagacuaucuaagaaauuucuaagcgaaauaaccagcguagaccaagaaaccggagaacuacgaacuauuauccaauguauguaugaaacgcaaaacaaccuuaugcaacuacuaucagaaccuuaccauuucguagaagcuauugaaaaagaaaacccaaaaguagaccuagaaucaauaucauacagaaucguaaaugacuuauauguuucgccagcaguaaaaagacaaaucuggcaaacgcuguuaguaauuaaagacaucaaacaaguaaugaaacaugaccccaaacgcauauuuauagaaauggccagagaaaaacaggaaucaaaaacaacaaaauccaggaaacaaguucugucugaaguauauaaaaaugcugaaaaauacaaaaacuuauucgaaaaguuaaauucacugacggaggaacaacuacguucaaagaaaguauauuuauacuuuacccagcucggaaaaugcauguauaccaacgaugcaauagacuuugaaaauuuaguuagcgcaaauucgaacuacgacauugaccauauauauccucaaucgaaaaccauagacgauucauucaauaauuuaguucuaguuaagaaagguauaaacaacgacaaaucugacagauacccaauagacaaaaacaucagagacgacgaaaaaguaaaaacucuuuggaauacacuccuaucaaaaggauuaauaacuaaagaaaaauucgaaagauugauucgaucaaccccuuucucagaugaagaauuagcgggauucauagcccgccagcugguagaaacuagacaaucuacaaaagcaguagcagaaauacuauccaauugguucccggaaucugagauaguauauucaaaagccaaacauauaacaaacuuuaggcaagauuuugaaauacuaaaaguaagagaacuaaacgauugccaccaugcgcacgaugcauaccuaaauauuguaguaggaaacgcuuaccauacaaaauucacaaauucgccauaccgauucauucaaaauaaagcuaaccaagaauacaaccuaagaaaauuacuacaaaaagcaaagaaaauugaauccaauggaguaauagcauggauuggucaaucugaaaacaaccccggcacaauagccacaguaaagaaaguaauaagccgcaauacuguauuaauaagucguaugguaaaagagguugacgggcaauuauucgaccaacaauuaaugaagaaagggaaaggucaaguaccaauaaaaucauccgacgacagacucaucgauaucucaaaauacggagguuacaauaaagccaaaggagcauauuuuguauucauuaaaucuguuagaagaggaaaaaccaucaaaucuuucgaauacauuccaguucauuuggcaaagaaauuugacugcaacuuagaacucuuaaaagaauaucuugaaucagaaaaagacuuaaauaauguagaaauacuaaugcccaaaguaaugauaaacucguuauucaacuacaauggaucauuaauaagaaucccagggagauaugacaagaaaucauuacuuauaaacgucgacguaccccuauuacucgaaucgcaacauauaaaacaacucaaagucauagaaaaauauauguauaagaaacguguauccaaaaacagcaacauacuacuaaccaaauucgcaucagaucaacuuaaagaucuugaugcccuauuugacguccuaucauauaaauugaacgaaaacauuuauaauguaaucaaugacaaauaugauaaacucguaaucuguagagauaaauucaucagucuugacaccgaaguaaaaugcgaaaugauauucgaacuacuacaucuauuccaauguaauagccaacuugcaaauaucacaaaaauuggagccacuuccaaauucggaucgaucucaaugaguaaaaaucuaaaagaaaaugauaaaaugucaauuauacaccaaucuccaaguggaauauucgaacaugaaaucgaauuaacagcacucuga

SEQ ID NO: 5346 - RNA, 4053 nt, Artificial Sequence
  Cas9 variant
augaaaaggauccucggcuuagauuugggcacagcaaguauaggcugggccuuaguuaaugaaucugaaaacgaaaaagaaaaaucagaaauaauaaaacuaggaguacgcguaaauccucuaacaacagacgaacaaacagacuuugaaaaaggacgaccauuaagcguuaaugcagacagaacauuaaaaagaggcgcgagaagaaauuuacaaagauucaaacagagaaggaaaaaccuaauagaaauacucaucaaaaagggauuuauaaccaauauaucgcuguuaacagaaauagguucgaacaccacauaucaaacucuagaauugagagcgaagaguguaaaagaaaagauugaaaaagaagaguucgcaaggguacuacuaacaaucaauaaaaagcgcggauauaaaagcucaagaaaagcuaaaaaugaugaagaaggcucucuuauagauggaaugucgguugcaaaagaauuauaugacaauaacuuaacugugggacaauacguauaccaacuacucgaaaaaggagggaaauauauaccagauuucuacagaucagaccuccaaaacgaauuugaugucauuuggaacuuucaaaaggaauuuuacccuaauauacuaacuggagaauuauacaagaaauuacaagggcaaggucaacaaaacucccgcaaacucuucuuagcaauucaucaaauauacaccgcagaaaauaaagggaaaagagauacagucaagaaacaacacuacaaauggcgaaacgaugcaauaaacacacaacucuuaaucgaagaaguagcauacguccuaguagaaaucaacaacaacuuaaacaaaucaagcggcuaucucggugcaaucuccgacagaucgaaagaauuauacuucaacaaagaaacaguaggcgaaaaucuauauaaacaaauacaagaaaacccacaaacuuccuuaaagaaccaaguuuucuacagacaagauuaccuagacgaguucgaacaaaucugggaaacacaagcaaaauuuuacuccgaauuaaccaaagaacuaaaagaagaaguaagggauguagucauuuucuaccaaagaaaauuaaaaagccaaaaacacuuaauaagcgaaugugaauuugagaaacaccauaaagcaauuccaaaaucauccccauuauuucaagaauuuaaaauuuggcaaauacuaaacaacauugaauuuaaacauaagaaaacaaaagaacuaaaaauauuaagcgaagaauuaaaagaaacucuuuucgaagaacucaacauaagaggaaacuuuacaucugaugcugugcuuaaauucguaaaacuagauaagaaagaaugggagcuaaauuacaagaaagguaucgaagguaauaggacaaaugaagucuuauacaacgucuaucagaaaauugcagaauaugaaggcuaugguuuugacuggucaaagaaaucagcaguagagauuaaagaagaauuaaacaccauauucagcgaaauaggaauaaacucaaaaauacuagacuucaacccagaaaucagcggcaaugauuuugacaaacaagaaucauaccaauuauggcaucuacuguauagcgcagaagaagacggauucuugaaacaaaaacuacaagacaaauacggguucaaaucagaauacgcaaacaugcuagcaaacgucucuuuccaaucagacuacggaucuuuaagcgcaagggccauuaagaaaauacuuccuaauuugaucgccggccacgaguucuccgaagcauguucauuaucaggcuauaaccauagcaacucauuaacuaaagaagaacuggcaaacagaccgcuaaaagguaaauuagaacuauuaaagaaaaauucacucagaaaccccgugguggagaaaauacugaaccagaugguaaaccuaguuaaucaaguaaucgaaaguuauggagaaaucgaugaagucaggauagaacucgcaagggaacuuaagaaaucagcacaagaacgagcccuaaugacuacaaacauaaacgcaagcaaaaccaaauaugaauccuuuagaaaacuacuacaaaaagauuuuggcauuaaaaauccaacaagaaacgacaucaucaaauacagauuauaugaagaauuaaaagcaaacaaauaucauacuauauacacgaauaaauacauaccaagagacaaacuauucucgaaagaaaucgacaucgaacacauaauaccaaaagcaaaacuguuugacgauucauucucuaauaaaacacuagcuuuucgaaaacccaaucaggacaaagguaacaugacagcuaucgauuauauucucagcuaccaaucuaaagauauagacaacuauaaaucaagaaucgaaaacuuauucaaaaacgggaaaggcgauauaucaaaagcuaaacgaaauaaacuucucauggaagaaaaagacauaccagauggauucauagaccgggacuuaagaaauucucaguacauagcuaagaaagcaaaacaacuacuggaagaagucauacgcacaguaaacacgaccacagggucuguuacaaacaaauuacgagacgacuggggacuaaucaacguuaugcaagaauuaaacaugccaaaauucaaagcaauagacgaaucauuaauagaacagauagagaagaaagacggaaccuuuaaaacacguauaaaagacuggagcaaaagaaacgaccauagacaccacgcuauggaugcgcuaaccguagccuucacacgauacaaccauauacaauauuuaaauaaucuaaaugccaaaucagacaagaaaggugcuauauacgguauucaagaacuagaaacuuauguuaacagcaaaggaaaaagaaaauucauaaaaccgaugcauaauuucagggaagaagcuaagaaacacauagaagacauucucauuaguuuuaaagccaaaaacaaaguagugacuaaaaacauaaauaaaauaaaaagcaaagacggauucauaaagaaaguacaauuaacgccaaggggacaacuucacaaagaaaccguauauggcaaaauuaaugaaguaguaguaaaagaagagaaaauaaacgcaaaauucgaccucgagaaaauaaauaaaguaacaaaacccauuuaucgaaacgcacuauuaaaaagauuacaagaauuuaacggagaaccuaaaaaggcuuuuaccgguaaaaacaguuuaagcaaaaaucccauauaccucgauguugcacaaacaaaaacccuaccagaauccguaaagguacaauucuucgaagaaaauuacaccaucagaaaagaaauaagcccagaccuaaaaauagauaagaucauagauaaaggcauccaaagaauccuauuaaaacgauuagacgaguucaacggaaagcccaaagaagcauuuucuaaccucgaaaagaacccuauauggcuuaauaaagaaaaagguaucgccauaaaaagaguuaaaauaaaaggagucaaaaauguagaaucgcuccacaauaaacgugaccaccuugguaacgaaauacuucaaaaaggaaaauccgcaccaaacgacuauguaucaacuggaaauaaccaucacguagcaauuuaucaagacaaaaaugggaaacuccaagaaaaagugguuucauuuuaugaagcagucgcaagaguuaacaauaaauuaccaauaauugaucaagacuuuaauaaagauuuaggauggaaauuuuuauucacgaugaagcaaaacgaaauguuuguuuuuccaagcgaagauuuuaaaccacuagaaacagaucucauggauaagaaaaacaauagcaaaauauccaaaaacuuauuccgaguccagaaacuaggcaacaaagacuacacuuuccgacaucaccuagaaacuaaaauagaagauaucaagaaacuaagagacuucaccuacauaagaaaacgaaaucccgaaucaaucaaaaacauaauuaaagugagaaucaaucacuuagggaacaucguacacguaggcgaauacuga

SEQ ID NO: 5347 - RNA, 4056 nt, Artificial Sequence
  Cas9 variant
auguccaagaaauacuauuuaggccuugauauagguacgaacucaguuggcugggcaguaacugaugaaaacuacaaccuaugcaaauaugcaggaaaaaggaugugggguauacgauuguucgaaggaggagaaacagcggaacaacgaagaauaagucggucgaaccgcagaagauuaagccgaaagaaacaacgaauagaucugcuacaagaacuauuugcagaagaaauagcgaaaauggacccaaccuucuuuauacgauuaaaugaaucacgacuucaucuagaagauaaaucaaccggggaaaaauucccccuauuucgagacaaagacuauaccgauauucaauauuacaaagaauauccgacaauguaucaucuccgcaaagaauuaauagaaaauagcaaagugcacgauauaagauuaguauauuuagccugccaccacauucugaaaaauagaggccacuuuuuaauaaacggcaguuucagugacguaaagaaacuaaguucuguaugcgaaagcaugcucaauucauucaacggaaucuccaaauaccaaaucgagaucaacgacauagaacgacuggaagaaauacuauccgacaggaagaaacagaaaagcgucaaagcuaaagaauuaauacaaauauucgagugcggaccgugcgaagauaaaacagaugagaaaacuugcaaagcaauuguaucaaaucuauguaaaugguuaacuggccucaaagguaauaucaauucaauauuugauaugcaauuugaagaaauagauaccaguucuuucucauucacagagccaaaauaugaagacacaauaucugcagcauuagaagaaaaauacccggauuaugcugacguaauccagaaaauaaaagcagucuacgacuggucugugcucguagagauaauggcaggagaagauuaucuaaguuuugcuaaagucaacgcauauaauaaacacaaagaaaaucuguguauacuaaaagaagugauaaggaaauauugugauucagaaauauaucauaaauucuuuaacggauucgacgagaaaaauggguauggaaacuauauagguucaaucuacaaaaauggacacucauacgcaaugaagaaaugcaguacagaagauuucuauaaaacacucgguaaaauacucgauaaaauacaacccgaaaaagaagacgaaaauguccuagaagaguuaaaaguugaggucaaaaaucaaacacuucuuccacuagcacgaacaacggcaaacggaacaauaccaaaccaaguacacauccaagaacuuagagcaauucuggauaacgcaaagaaauaccucccauuuuuaaacgaagaagaugaauacggaacaguugcagagaaaauaauaagcauagcaaaauuucgcauuccauauuacguagguccucuaaguacaagacacaaagaacaaggagccaauucauggauuguucgaaaacaagaagguagaaucuacccuuggaacuucgaagaaaugguagacuuagaacaauccaauaaagaguucauacaacgaaugacuaauaaauguaccuaucuaauaggcgaggacguccugccuaaaaacaguuuauuauauuccagauacauggugcuuaacgaauuaaacaacuuacgcaucaggggaaauaaaauaaguguaaaacuaaaacaagaacuguacaaagaacuauucugcacaaaagcuaaaguaacuggaaaaggacucuuuaacuaccucaagaaagaagacgaagaauuagcacuagaagauaucagcgguuuugauaucgacuucaaaaguucguuaacuucuuaccuagacuucaaaaagcaaauacuaggagaagaaauagaaaaagauaaauauaaagguauaguagaaaauaucauaaaauggaaaaccauuuaugaugacgacucaaaaaugaugaagaaaaugauagaaagagaauauccaaauguauucaguaaagacaaaauaaagaaaauuugcagauuuaaauacagcggaugggguaacuuuagccuaucuuuucuaaacggcauaagaggagccgaccgagagacaggagaaaguuucacaaucauagaagcauuauggaaaacgaauuacaacuuaaugcaacuacugagcaaacaauuuacuuuucgagaagaaaucgaucuaauaaacgcggaaaaaguuggaaaaauuaauaaaguaagcuaugacaauaccguaaaagacuuaauaguuuccccugccaacaaaagagcaauauggcaaacaguacaaauaacagaagaaauaaagaaagucaugaaaugugagccagagcgcauauucauagaaauggcuagaggaggagaaaaagagaagaaaagaacgguaagucgcaaagcgagauuauuagaacuuuaugcagcauguaaagaugauguaagagacuggacaaaagagauagaagaucgcgaggaaagggaauuuaauucgaagaaacuauaucuauauuacacacaaaugggaagaugcauguauucuggagaggaaauuaauauagacgaacuuaugcagaaaaacucaaaaugggauauagaucauauauacccacaauccaaaauaaaagaugauucauuagacaacaugguuuuagcgaagaaaguuauaaacaauaguaaacaaaacaaacuguuaaguucagacaucagaaucaaaaugaagaaauacuggaacgcauuauauaaaggaaacuucauaucaaagaagaaauacgaucgcuuaacaagaacggaagauuucacaaaugaagaguuaaguggauucauagaacgacaaauaguagaaacaagacaaucaucaaaagcaguagccgaacuccuuaaccgacuauaugaacauagugagauaguauauguaaaagcaggccucguaucagacuucagacaugacaacaaacuuuuaaaaucaagaagaauaaacgauuaucaucaugcuaaagacgccuucuugaacauaguagucggaaacguuuacaacgcaaaauucacaagcaauccuagaaaauggauaaaagaaaauaggggcaccaacuauaguauaagaagagucuuugacuacaacguaaaaagggguaacacaguaguauggcaagggguugaagaugggggccacucaauagacgaaauacgaaagacaauggccaggaaugacauacuauacacggaguauaccuauugcgauaaaggggaauuauucaaugcgacauuaaucaagaaagguaacgauaaagcaauaaaccucaagaaagcacuagauagcguuaaauauggaggauacaauucuccaaaaacaagcgcauucgccuucauugaauuugacggcaaaaagaaagaaaggaaaaaccacauaguagaaauuccagucuacauaguuaauaucgcaaaaagacaaccagacacaauaaaagaguaccuugaacaaaagaagggauacaaaaaugucguaguuaagaaauacccuauuaagaaaaacgcacuaauaaagaucgacggcuaucuggcuagauuaagaggggcaaaugaaacggacauccuacuaaagaaugcaguacagcuaauucuaaacgacaaauauuaugaaauaauaagacgaguagagaaauaccuagaauauaauguaagguaugaagcagaaucuauguuugaaggcuuugaccacgcagaccuaaacagcuuauaugaugaauuaacgaguaaauuagagacaaguauauacaagaaaagaccugcaaaccaacuaaaugcacuagaaaaggggaaagagaaauuuaaaaacauucaaaccuuaagagaaaaagcgcaaaucauaaaagaaaugcuaauaauguaccguugugacgcugcuacagucgccaaucuaaaggcgauuggaggauccgcaaaugcuggaaguaugaaaaucaagaaaaauacauuaacauccagaagucuaguacuggucaaucaaaguauaacaggacucuucgaaacagaagaagaacucguuuga

SEQ ID NO: 5348 - RNA, 4056 nt, Artificial Sequence
  Cas9 variant
auguauaagaaauauggcauaggacuggauauaggcacauccucaauuggauggaguguaguagaugaauacggacacauaauaagaguaaaaggccaaaccggucuaggaguuaggcuauucagggaagggcaaccugcagcagauagacguacuuuucguaccacccgcagacguuuggguagaagacgauggagacuaagauuauuacgagaaauuuuugacccuuacauagccgcucaagauccuaauuucuuugcacgacaaaaggccucagccauagcuccuggugauucuagauuuaaagcuguguacagacuauucaaugaccagacugauagacaauucuacgauaaguauccaacaguauaccauuuacgacaaaaauuaaugacagagaaaaggcaauuugacauacgcgaaauuuauuuagcaguucaucauauuguaaaauauagagggcacuuuuuaacaggcggagcugccaagaacuucaaaccaggaaaauuagaucuaaacacauacuucgcaacuauaaacgcgcaguuagcagccauauuuauggacucacaagucgaauuaccacaacuagauugggaugcaguaguuucucuccuaacuaacgaucaggaaaguccaucugaccgucaaaaagcauuaacaaaaaugcucguugcucaaggagaugccacccagaaaagauuuuacaccgaguucuccaaagcacuacuaggccuaaaagcuaaauuauacgucuuaacaggauucgaaggugacaagacagaucaaaaagcauuaacgcuuucacuagaaacacuugacgaccaccaagacgaugugacacaacuacuuggugaugaacaaagacaguuaguggaacuccuagcacguguacaaucggcaauucaacuggcaaucauaauaccaaacggcaaaacauuuucaggccaaauggugcaacaauaucaaacacauuacgaucagcuacgacugcucaaggacuaccgcgaacaauuaacagaucaaaaacaccguagagcguuaaaacaagccuaugcugacuacuuagcaaacgaucaagaucaagacgcauuaguaaaggccguugaaaaaguuuuaaaacagaaccaaccccuuuccacuguaggaguacgucuacaaacagcaauagaugcuggugauuuucucccuaaacaaagaacgaaggcaaacucaguaauaccacaucagauacaucaacaagaacuagaccgaauaauugaagcacaaagcguuuacuaucccugguuagcggaagaaaacccuguugcagcccauagaucauacgcacccuacaaacuugacgagcuaguugacuuucgaguaccauacuacguaggaccacuuguucaaccacaagcugauaaagccgcuaaagaaacaaaauuugcauggaugacacgaaaagaggcgcaauccacaaccccuauaacuccguggaauuucgaacaagaagucgaucguaaugcauccgcaaacgcuuucauucaaaggaugaaaacaacagacacauauuuacucggggaagacguucuuccgaagaauagucuauuauaucaaagauucgagguauuaaaugaacuaaacaacguaagaguagauggaaaauuguuaacuauagcagaaaagcaacgccuauuucaggaucuuuuugucgaucgaucacaagcuagcguaacaaucgcucaacugcaagcuaaucuuauugcccacggcgcugcgaaagaccgcguagaaaucaaaggguuagccgacccaaaaagauucuuaucuucuuuaaccacuuaucacgauuacgcacagauuauacccgaagcauuagagcagcccgacaaaagagcggacauugagaaaauaauaaauuggaguacaauauucgaagauacaucaauauucaaagaaaaacuucaagaaauagcauggcucacaccggaccaacguaggcagcucucacagaaaagguauagaggguggggacaacuauccgacaaauuguuaacacaacuucgcgaugcaacaggccaaucaguaauggauuuacuauggacagaaccuaacaauuuuaugcaaauuauacgacguacugaauuucaacaagcaauagcacgcgucaaucaaacugaucuuaaacaacaagacuuagccacuacaauuaaugaccuuuacacaucaccucaaaacaaaaaggcgauccgucaaguauuauuaguaguagcagacauacaaacugccaugcaugaaguggccccaaguuggcucuuuaucgaggccgcaagaggacccgaacagaauccaaaaagaaaauuagcaagacaacaacaacuacuagaagcauacaaaacaucagcaaaagaaauugucaaugaagcaguaaaagaaaaacuuuuaucagcaaucgaugaucaucaaaaauuugaagaccagguaguucuauacuuccaacaaaaugguuuagauauguacacggguaaaccauuagauuuugaacguuuaagcaaauaccauauagaucauauaauaccucaaagcguaguaaaggacgacagucuugauaauagaguacuaacaacuccagaagaaaaugaacgaaaaggagcaagaguaccaggcccccuauacgccucacaacaaggacguuggagauuacuacaaagagcuggacuaauuagccaaagaaaacucgaucaucuucuacuucgaccugaagaguuggaucaacaggccacaggauuuguggcacgacagcuaguagaaacacgacaaguaaucaaacuaaucacuaacauucuaucgcaacaauaugaucccgaacaaacuaaauuaguaucaguaaaagcuggcuuaucccaucaauuccgcacccgguuaaaucucccgaaacuucgagaacuaaacgacuaucaucaugcccacgaugcuuaccuagcagcaagaauaggaacguaucuccuacaaagauacccaaaccuagaaagauuuuucgucuacggccaauaucagaaaacuagauucgaccuaaaaagacacuuuaacuuuauaggagagauguuaaaaggaaagccagaggacgcaguaaucguuaaagccccucacuccgaaacagucaucugggauaaacaagaugaaguaaaacaauuaaagaaaauaauggaauauagacaucuauuaguaacucaugaaguauaugauaaccacggagcccuauucaaucaaaccauacacccagccaaaaaccccaaaaauaggaaacuaaucccacgaaaaacaacucaaucaacagaacuauacggaggauacuccggagaaacuacaggauauuuagccaucgcacgaacgguuacgaaaaacaaaauaucauaucaaguacuaagaguaccgaccagacucguuggccgacuacaaagaucaucagaauccgcacaaagacaaauacuaacagacugguucgcaccaucauucguuucuagagggaagcaacaaccauucgaaaucguuuuaagacauguguucaaaaaucagacuguaauagaugacauacaugaacaaucucaucgauuuggucuuagaucugauacguacuacugcaaucaacaacaauuaguacuaucguuagaacaacagagaaugauuauagaccaaaaauuaaacaacacaaacaaauuaauggugguauacgaagccgucugcgaccaaguagccaaguacuuuccauuauaccgaaugaaucacuuuaaagaauccuuauuagaagcaggcccaaaauuagcugaacuaccaauaaacaccguucaaaguaaaaacgguaagcugaaguuaggucaaagauccguccuccuacaaacaaugcaaggacuacacgccaacccggagacaaaagaccuuagcauuauaggaugccccaaauacuucgguaaacuacagguaagcucuggcaucaaauuaaccgaaaacgcaguacuaauacacgaaucccccacuggcuuauuccaacggcguguucguuuaucagaccuuuga

SEQ ID NO: 5349 - RNA, 4056 nt, Artificial Sequence
  Cas9 variant
augaaaaucuuaggacuagacuuagggacaaacaguauaggaugggcaguagugaacgaggcagaaaacgaaagagaaagcucuagcauaauuagacuugguguacgcgugaacccauuaacaguagaugaacaaaauaacuucgaaaaaggaaaaccaauaacaacaaaugcugacagaacacuaaaaagaucuaugcgcagaaaccuucaacgcuauaaacuacgacgugcgaaccuuguaaguuuauuaaaaacacaaggauggauaacagaugagacucuucuaagcgaacaaggcaauaacaguacuuuugaaaccuauagacucagagcugaagcagccacaaaagagauaacguuagaacaauuugcacgagucuuacuaaugcuaaauaagaaacgcgguuacaaaucuucaagaaaaaugaaacacgaugaggacgguucguucgucaauaacuuagauaucgcccgcgagcucuacgacaguggucuaaccccgggacaauaugcuuacaaucuucuuaaagaugguaagaaauacaucccugacuucuacagaagugaccuccaagaggaacuagauaaaaucugggcguaccaauaugaauaucaugaaaauauucuaacucacagccuucgauccgcaaucauagaucaaagcaaaacaggcacuacaaaaauauuuuuaaaaacucauggcaucuucacagccgacaucaaaggaaaccgaaaugaacgaaauaagcaacuauuugaauugcguugcggagcucuagaaagagcauuaacagcagaagaacuagcgacaguaauugcagagguuaacggacaaauaaauucaagcaguggcuaucucggagcuauaucagaccguaguaaggcucuuuuuauaaaccaucaaacaguaggacaauacuuaaugcaacagcuagaccgcgacccaaacaaaucacucaaaaaucaaccauuuuacaggcaagacuaucuagaugaguucgaacaacuaugggaaacacaagcacacuaccauccagaauuaacagcagccuuaaaacaugaaaucagagacauaauaauauuuuaucaaaggagacuaaaaagucaaaaauggcucguggcuaauugcccauuugaacauagaaaaguauguccgaagaguucuccacuguuucaacauuucaggauauggcaaguccugaauaaugugacugugaccguagauaauaaaaccuauguccucaacgaagaacagaaaaguauacugaguaaagaacuccuguacaaagagaaaauaaguaaaagagaugcacuaaaaauguuauucguaaaagcaaagggagucgauaugaauuucgcgucucuagaaggagacagaaccaugucgaaccuacucaaggcagcccaagaaauagugagcaucucaggacauggugauuacgacuucggaaaaaugccugcggaugacauacauaacaucauaagaaguguauuuggggguuuaggauucgcgacugauugguugaaucucgauacagaugcagacgaucucgaacaagaaagucaaaugagguuguggcauuuaauauauucauuugaaggagacaauucgacuacgggggacacgaagcuaguggaaaggcucaugucacuuuugaaccuaccccaagaauaugcuagauuauuugcuaacguacauuuggaagacgauuauugcgggauuagcaguaaagcucuuaaacgaauacucccguuuaugaaagcaggccauauuuauucagaagcgugugcacuagcaggauacaaacauagcgaacaaagccuuacaagggaagaaaauaaaaacagaccuuuaaaagaucaucuagaacaauuacccaaaaacagccuaagaaauccuguaguggaaaagauacuaaaucagaugguaaauguagucaauagcauaauagacacauacggucgaccagacgaaauacguauagaacuagcaagagaauuaaagaacaacgcgcuaggaagacaagcaauauucgaagcuauaaacaggaacacaaaagaaagcgagcgcauucagcaaauacuaaagaaagaguucggauugacucauguaucaagaaaugauauaauaagauacagacuuuaucaagaauuaucuggaaauggauacaaaacucuauacuccaacaucuacauaccucaagaaaaacuuuucagcaaagaaauagauauagaacacauaaucccccaagcaagacuuuuugaugauucauucagcaauaaaacccuggaauauagagacguuaauauaaagaaaucaaauacaacggcaauagacuucguaagaaacgaauacggugaaaaugaagucgaacaauauaagaaacgaguaaacgauuuacuuaaaaguggagcaauaucccaagcaaaagcuaagaaauuaaaaaugacagaagcugaaauaccuaaugauuucauagaaagagauuuaagaaauacacaauacauuucacggaaagcacaagaaauguuacgagacguagcuagaguggucacugcuaccacagguaguguuacagacagauuacgacaagacuggcagcuaguagacguaaugcaagaacuaaauugggacaaauacgaacgucaaggacugacaacgguuauaaacggucgagacggccaacaaauacgaaggauaacagauuggacaaaaagaaaugaucaucgacaccacgccauggacgcccucacaauagccuuuaccaaaccagcauacauaucauaucuaaaccaucuaaacgcaaggagcgaggaugacauaaggagcauugaaagacgauuucuagaaagagacgcaaauggacaccuaagauuuaucaguccaaucgcccauaauuuucggagugaagcuaaaagacaccuagaaaugauacuuguaagcauaaaagcuaaaaauaaaguugugacaagaaacaauaauacaacaaaaaccaaaggaggaaggcguaauagaauacaauuaacgccaagaggccaacuucacgaugcaacagucuacggaucuauacuauuaccacauacaaaaacuauagccguagacgguaaaaugacagccgaaauaauaggacaaguacaaaauccagucuuccgucaggcacuaagucagcgauuagaggccuguggaaaugauccaaagaaagcauucacagguaaaaacucacuggaaaaagcuccaguauggauagaccaagcacauacagaacaugucccagcagaaguaacaauccaacgucuggaaccacaacauaccauacggagagcaguaaacaaagaucugaauauaaacaaaguucuagacaaaggaauccaacauauauuacaagcaagacuagacgccuacggaggagacgcagccaaagcauuugcaaaucuugauaacaacccuauuuggcuaaaccaggaaaaaggaauugcaauuaaaagaguaacaacagcagagaauauaaguggagaacccuugcaccacaaacaugauaaagaagggagaccuauacuagacacaaaugggaaaccaaugcccucagauuuuguaagauuaaugaacaaccaucacguugcaauauuucaagaugccgacgguaauuuacaagagcacauaguaucauuuuaugaagcgguagcuagagugacggaacuaggauugcccguaauagauaaagaauacaacaaagacaaaggauggcaauuccuauuuacuuugaaacaaaaugaauauuucguuuuuccaaauccagcacaaggauucaacccagacgaaauugaucuuacggaugaaagaaauuacucgcggauaagcccaaaucuauacagggugcagaaaaugucaucaaaauauuauguauucagacaucauuuggaaaccacuguagaagauaagaaagaacuacaaggaauaacuuggaaaagaauccaaagccuaaauaaccugaaagggauaguaaaaguacgaauagaucacauaggaagaauuguucaaauaggagaauauuga

SEQ ID NO: 5350 - RNA, 4056 nt, Artificial Sequence
  Cas9 variant
auguuuucacaacaaaauaaucuauacugcgaaagccuaucaaaacuauauuauaauauaacaaaaaauuuucucagcaaaaacgaggucugcagaauuuaugaaaucuuuuucuguucaauauuaacauacuuccuaaaaaaguacaaucacgauauauucaaaaaaagcucaaccaugaaaaccauccuuggccuagaucugggggucacaucaauagguugggcaguaauaguaacggacgacgacaacacacccauaaaaauacuggggaugggcucaagaauaaucccacuaagcaccgcugauaaagaagaguuccaaaaaggucaagccauauccaaaaaccaaucccgcacaauagcgagaacgcaaagaaaaggguacaaucggaaacaauuaagaaaggaagaacuaaaaaagaucuuaggagaacuuggaaucacuccgaguaaagaauugcuaaaccuaccguccauagaauuauggaaauuacgagcugaugccgccaguggaaaugcaccacuuucagcagaacaacucggaagaauauucuacaugcugaaccagaaaagaggauacaaaagugcgagaagugaagcaaaucaagacaagaaagauaccgacuauguagccgcugucaaaggaagacaccaacaacuaaaagagaaaggccaaacaauaggucagcacuucuauacagaaaugcuaacauuagaagagaacagcgggcacuuccaaguaaaaaauaauguuuacccgagagaagcauaccucgaagaauuuaaugcaauaauagcugcacaaaaaccccagcaugccuucuugacggaugacguaguugaccgacugcgagaugaaguaauauucuaccaaagaaaacuaaaaagccaaaaaggccuaguuaguauaugcgaauuugaaggcuuugaacgaaccuuuuuugacaacgugaaacaaaaagauaaaacaauauucacagguccgaaaguagcgccaaaaucgucgccauuauuucaacuuuguaaaaucugggaaaccgugaacaauauuaaccuaaaggucaaaaauacugacggcucaaaaaacaaaugggccgauuacguucccacuuuagaacaaaagcaagaaauuauugaacaccuauuuaaaaacgcaggaaucucguuagaugccuuaagaaaaauauuaggguucaauaaagacgaaauauucguaaauaaacaaauagagaagggucuacaaggaaacacaacauaugccgaaauacacaaaauacucggcgacaguaagcccgaauuguuaggauucaauauuaacauagaaccaucaaaacauucugcucuacuuguugacaagcgcaccggagaaauacuagcagagaaggagggacaacaaguaucugcagaaauagaaaaagagaauuuuuaccagcucuggcacacgauuuacucuauaaaagaccuagacgaaugugccgcugcccuaauaaaaagauucaacaucgaccccaacguagcagcucaguuggcgaaaaucgauuucucaaaaggagccuucggcaacaaaucuaauaaggccaugagaaagauauuaccguacuuaaugcaagguuacaauuacgcagacgcaugcagucuagcggguuacaaucacucggacucacaaacaaaaaaagaaaaagaagaaaacgugguagacgauaaacuaaaauugcuagaaaaaaacagcuuaagacaaccaguaguggagaaaauaaucaaccaaaugauacacguagugaaugcaauaauagauaaauacggcaaacccgacgaaauaagaguagaguuagcgagagaccuaaaaaaaaguaaagacgaacggaacgaagcugaauuacaaaaugccucaaacaaaaaguuaaacgaagaagucgcaaauagacuuaaagaguuaggauuaccaguuaccaaacgguucguccaaaaauauaaauuuauauuucccgugcgugauagaaaaauaaaagaagcacaauuaguaaaccaaugcauuuauugcggcgaaacauucaacguuacagaagcauuaucaggcgauaacuucgauguagaucauaucauacccaaaucaauguuauuugacgauagucaaacaaauaaaguauuaguccauaggaaauguaacgcuaaagacaaaaguaacaaaacagcuuaugauuucauagcggccaagggagaaaaugaacuugcaauauaccuagacagaguagaugacugguucaaacgaggggucuuaaguuacggcaaaaugcaacguuugaaaguaaguuacgagcaauacgcggaaagaaaacaacuaaaaaaagaaacugaagcagauauaaaacucugggaaaacuucauagaacgagauuuacgacaaacucaauacaucgcuaaaaaaucaaaagaucuccuuaagaaaauauguaacaacgucaccguaacagaaggaaagauaacugcacaauuaaggaaccucugggguugggaugauguacucaugaaucuccaacuucccaaauacaaagcacuuggccaaacagaaaucaaagaauggacauccgaacacgggagacgucuacacaaaaaagaagaaauaacaaacuggacuaaaagagaugaccaucgucaucacgcuauagacgcguuaguuguugccuguacaaaacaagguuucauacagagaauaaauacacuuaacucuucagauacgaaagaugcuauggauagagaaauaaaagccgcuaaggaaaaauacaaugaacuuuacgacaaaaaauuacucaccgaaacaaacgaacaaguaaagaaucacacagaaagguucaacaaacuggaaacauaccuuaaaucacagcaaccuccacuuuucacuacaagauauguagaacaagaagcagacaaaauauucguaucguucaaagcugguaaaaaagcagcaacguacggaaucagaaagauaaaaaaagacggcaaaaaaguaguggugcaagagaaaauaguaguaccacgaggagcauuacacgaacaaucuguauacggcaaaauaaaaacucaagaaaaagauaaaccccuaaaauauuuauuugaaaauccagaaaccauaguagacaaucgaaucaaaauuuuaguaaaagaaagacuagacaaauucgaaggcgaugucaaaaaagcacucaccucucuaaaaaaagagccguuauucauugacaaugaaaaaaacacccuacuggaaaaagcagcaugcuacacagaugccaccguacugaaauacaaacuacaagcuuuaaaagcaaaccagguuaaugauauaguagacgaaggcguuaaacgaauuguuaaagcgcgacuugcacaacacaagaacgaaaaggaagcauuuaaagauacagucugguucaaucaagagaaaagaauacccauuguauccgucaggguauucgcaagaccggaugcaagcaaauuagcaauaauuaaaacagacgaaaacaacaaaccuaucgguuucgcacuuaccggcaauaaccaucacauagcaauauauaaagacaacacaggaaaauuaguacaacacauaugcacuuuuuggagcgcaguagaaagaaaaaaauucggaguuccgacaguaguaaaaaacacagguacucuauggucugaauuauuacauaaggaucuucccggaacguuccucgauaaauugccacaagacggguuagaacuagaauauucauuacaacaaaaugaaauguucguucuuggauuaccgaaagaaucauuugaagacgcaauaaagaacaacgaccuaccguuauuaucaaaacacuuauaucucguaugguccaucucagacaacgauuacugguucagacaucauuuggaaaccaaaaacucagaacucaaaagcacaacaggagcuaaagaaaguaaacgauauuacagauuucaaucaguaggaacauucacgaaggaaaauccaauuaaaguucaauuaaaucacuuaggugagauaacaaaaauaggagaaccauga

SEQ ID NO: 5351 - RNA, 4059 nt, Artificial Sequence
  Cas9 variant
augaaaaaaagaaaccgagaggaguacuacgugggacuugauauaggcacaaguaguguuggaugggcaguugcuaccccagacuacaggauaccaaaguucagaggacauaaaaugugggguagucguuuauuugcggaagguaaaagggcagcagagcgaagacaauuuaggacaaauagacgucgacucgcuagaagacgagacagacuacaaaucuuagaagaacuguuugcugaggaaauggcgaaagucgauaacacuuuuuuuaugcggcuaaaagaaucuaaauucuuccuugaagacaaaaccgucaaagaaaaacacauacuauuuucuacggacaaauuugacgcugaccgauuuuacaaagacaacccaaccauauaccacguaagaaagagacuuauggaagaagaaccacaagacaucagagaauuauucuuggcuguacaucauauauuaaaauacaggggacauuuccuauucgcaggaucauuagaacaaaacggagcaagcauagaagaacuaguaagaacguuacuaggaaaacaaggacucgccauauuggacgacaccauagacagcaaugaaaugguuaauauacucaaaaacacaggcgaaaccaaaucagaucgaaaaaaggauguacaagaauuauggaacccauuaaaagauaaaguaaaaaaagcacaagcagccgaaauggccgguuuagugcuaggguugaaaagcgauauaagcaaacuauucgcaaacucagauuauaaagaccucgauuccucaauaaagaauauaaacuuuagcucaggagauuacgaagaaaaacgugaugauuaugcaaauaguauaggggaugacauaguauuacuggacacaaugaaagcacuauaugacacuuuaauuuuaucucaaauacuacaaggaaaaagaucaauaagugcugccaaagucgaagauuauaacacacauaaagaacaacuaagagcacuaaaagcgauauuaaaaccacauaaacgcuuauacaacgagauguucagggaaaauaauaagaaagaccuaaguaauuauguagcauacaucucuaguuauagcgaaggaaaaagaguuaauagagaaggauuuuauaaauacguacaagcuguauuaaagcaaguugacgauucagauuccaaacaggcaauacuugaagcaauucgccuagaaacauuccuaccguuauuacgaguaaaagauaaugcgguaauaccacaucaaauucaucaagccgaauuagaagcgauacuugaaacagcgaggaaaaaauauaauuucuuaaaugacguaucagaugggguaagcguaaaagauaaaauaauucaacuauuuacauuccgaauuccuuauuacguaggaccguuaaacccccacaguggggagacaguggcagacagaaagcaagggacaggauggguaguaagaaaacaacgaggcaaaguauacccuuggaauuucgcggacaugguagacguaaaagccagcgcagaagcauucauuacaaaccuaacgaacaaaugcacauauuuaauaggggaagauguauuacccaagcgaagcuuguuauacagugaauuuauguuacuaaaugaacuaaauaugaucaaauaugauggccaugaauugccaguagccauaaaacaauuguauauagaacaaguuuucaaacaagaacauaaaaaacagacaaaagguagaguacuugauuuucucaaaagaaacggauuaauaacaggaucagcaaccgcugucauuacaggaauggaugaugcuauaaaaggagauuuacaaagcuacagagauaugguacgaauuuuuggcgcgggcuuugaucauucaauggccgaaaggauaauaagauggguuacacuauuuggcgaagcaaaagauauauuagagaauaaaauccgugaaguauacgggaauucaauaucagacucccaaaugcgagccaucaaaaaacuaaaauacgcagauuggggcagacugagccaagcauuccucaucgcaguuaaaggaugcgacaaaagcggcguagaaaggaacauaauaacaugcuuacgugcaucaucacaaaaccuaauggaaauacucagcgaucaagguaccuauauaaaacagauaaaagcuuggaaucaccaacauaccacaaauaugauggauacacucgauuaucaacuuguagacgauuuauacgucgcuccuucaguaaagagaucaauauggcagucucucugcauaguagaagaauuagucaaaauaaugggucaagcucccaagaaaaucuuuguugaggugacuaggacaaaacaagcggaaaaaacaaaaaaagauucuagaaaaaaaagguugguagaauuauacacagccauagggaaagaaggugcagcauggaaaaaagaaauugaagcucaucaagcuggagacuuuagaagaaagaaauuauaccuauauuacacacagaugggaagaugcauguauagcaacgagccaauagcaauggacgccuuauucacaagugccuacgauauagaucauauuuauccacaaucauuaacaaaagauggcaguugggacaaucuaguacuuguaaaaucacaauuaaacaaagaaaaaucagaucaauauccccuuaggccagcaauaagagagaaaaauaaagcucauuggcaauaccuaugcagagcuggguucaucucagaaaaaaaauacgaaagacuuaugagaacaacagaauuaacagcagaagaauuaucaggauucaucgcuaggcaacuagucgagaccagucaggcaacuaaagcaguuacagggcuccuugaacgcauuuauaccaacacagagauauguuuugucaaagcugaaacgguuucacaauuuagacaccaacauaauuucauuaaaauacgcgaacugaauaacuaucaccacgccaaggaugcuuaucuaaacaucguaguagguaacguuuaucacgaaaaauuuacaaaaaauccaugggaauuuauugcgagaagcacagaaagaagaccguauaaccugaauaggauguacgacuuugauuuacuaaaacaaggacguguuauauggcaagucccuaaaaguuuagaaaccguacaagccaugaugaaaagcaacgaugugagaauaacaaaaaaauuauuaguccaaaaaggggagcuguaugaugcaaccauaaccaaagcacauaaagcaaaggagggaacuuacuuuccacucaaaggagcugacgcaaggcuaagagacgugcauagauaugguggguacgaaaaaauaaaaauagccuauuauucuguguucaguuguagagaaaaagccucaaacacaauucacacauuaauuauaccuauaccaguuuacaaggcaggacuauuacagacggaagcagacuugacugccuacgccuggcaaacaaaacaaaaaacuaaaccaauuaaagacauuuauucagcaaucacucccaucuauaaaaaacuauguauaaauacagugguaaaaauagacgguuuuaaauacuuucuaggcggaaaaacaggagacuauauguggcuagauccugcaauuccuguaguacucgacgaacaagcugcagccuaccucaaagccauaucuaaaguggggcgugcggaugauguugaaaacacggcacaagccaucgauuuaauuacagcagaggcgaacgaagccuuuuacgauguacuauuaaaaaagauggaagcuaaaauauuugccaaggcguaccaaacaauaguugaaaaacuagcaagugaaaccgcacgagaaagauucagggaacucucaauaggcgcgcaauguucgugucuauuagaaauacuaaauuuacuugcaaacaauaaaacaacauucaccuucuucaaggauaaaaugggcguaaccaugucaagaagaaaacagccaauggacuuaacuaaacuugaagaauguaucguguaugagacaaguaucacaggucuuuaugaaaaagcaguaucacuucuauga

SEQ ID NO: 5352 - RNA, 4059 nt, Artificial Sequence
  Cas9 variant
augggaaaacgauaccauauaggacucgauauaggcacaucgaguauagggugggcaguaauggaugacgacuucaaaauaaugcgaguaaaaggaaaaaaagguaucggaguacgccucuuugaagaaggaaaaaccgcugcagaaagacgaggacacagaaccacuagaagaagauacagcagacgaaaguggagacucaacuuauuagaagaaauauucgauccggaaaucgcaaaaguagaucccacuuucuucgccaggcuaaaagagagcaauuuaucaccuaaagaugaccgaaagcaauacaguggcaaucuaauauuuccggaaaaggcaaaagaagaaauaagagaauggacagagaaauauccgaccauauaccauuuacgaaacgcgcuaaugacagaaaaucgacaauuugauaucagagaaguuuuccuagcauuacaucacaucguaaaauaucgaggaaauuuccucuucaauggcaauuuccaaacaggcgaaguaaaccucagcgaccguuucgacgacauuaacagcgcauuuauaucagcaugcggagaagaagaagccccccaaaucccaucugaguuauacaaugauauucaagaauuacucuuugauaaaaauaccagaaaauuagacaaccaaaaacaauuggcaacaaaacucucacaagauaacgauaaagauuggucaacacaauuuaguaaagcgcucuucggcuacaagacuaaauucaaagucguucuucaaaguaacgaagaucuugacgacuuucaacuagacucagacgacgcagaugauaaaauagcaucaaucagcgaacaaauagacgacgacagggguucaaucuuagauaauauaaaaauauuauauucacggauaacucucaacgaaauagucccagaugguaagacucuaagccaaaguaugaucgaaaaauacaacuugcacagagaccaccuaaaagagaucaaggaucagcuaaaacauacagacaacugggucaaauuugaugaccucuauucccaguauguaaacggaaaacuagaaagugaccgccauaagaaauuaucaucagaugacuucuacaaaaaaguacuaaccuuauuugacggugaacuaaaaacaagagucaaagaguggcaagagaaaggcgaauuucucccaaaacaaaggaccggaucaaacggagugaucccacaucaauuacaccaaaaugaacuugaucaaauaauugaaaaucaaaguaaauacuacccauggcuagcuacucuaaacccaaaugaaaaaagacagagagucgcaaaauauaaacuuagugaacuuguugcauucaggauaccuuacuauguaggcccaauggugaccaaagaccaaucagacuucgcuuggaugguaaggaaaucagacgaaaaagaaauuacuccauggaauuuugaucagguaguagacagagacaaaagugccgaggaauuuaucaauagaaugacaacgaaagauacauaccucauaggugaagacguccuuccagcaaaaucacuccucuaugaaaaauucacagucuuaaaugaacugaacaacauacguauaaauggcaaaccccuaaccaccgacgaaaaacaccaaguauacagggaccuguuccagaacgccaaaagcauaucaacaaaaaaauuucacaauuauuuaguauguaaacuaaacaaacccaaccaucuaaauauaacaggauucucugaucugacuaaauucaacucuucccuagauucauacauugacuugaagaaaauauucgcagaccaaauagacgaucaaagucuucaggaugacuucgaaaaaaugauacgauggaguaccguauucgaagauaaacaaauauuugaaagaaaauuaucagaaaucaacugguugacugaccaagaaagaucagaaguagcuaaauuaagauacagaggguggggcagacuaucaaaaagacuauuagcgggaauacaugacgagaaugggcagcgaauuauugacgcgcuauggaauucaccaaaaaacuuuaugcaaauucaagccgagguugcuuucaacaaacaaaucaacgaccuuaacacaaaagaacugucagauaacaacgucgaagacgucuuagcagacgcauauacaaguccccaaaauaaaaaagcaauaagacaaguucuacuugucguagaagacauacagaaggccaugcauggagaugccccaacaucaaucagccuagaauuugcccgggaagaacaagaaaguagcagaacacgaagcaggagagcagccuuaagcgcaaccuauaggcaaauaagugaugaaauagucucugcaacaguuaaaggagaauuaggaaaagcuacgaguauaagcgacagacuauacuuauacuucacacaaggagguagggauauguacacaggcgaaccgaucaacauagacgaaauaagucguggauacgaaauagaccauauacuaccacaauccuuuauaaaggaugauucgcuagauaaucgcguauuaguaaaaggagccauuaacaauggaaaaucagcaaacuacguaauggaucaaucgugggccccagauagacuagcaugguggaaaaaauuacucgacaaucgauuaauuuccagaaaaaaauaccaaaguuuaacauuaacccccggaaaaauaaauaaguacucucaaaacggcuucauaaauagacaauuaguagaaacaagacaaguaaucaagcucguagccaauauucuaaaugaccaauauucaaacgaugauacaaaaauaaucguuguaaaagcagcauuaaacucacaauuaaggggcuuuuuagaacucuuuaaaaauagaaacauaaaugacuaccaucauggaauggacgcguaccuaagcacauuuauagguaauuaccuuuauaaaaaauaucccaaacuaaggaguuacuucguuuacggagaauucaaaaaguuuuccggcaaacagaauuuaaagucauucaauuuuuuacacgauuuagaagacgauaguauaaauauaauaagcaacgaugauggagaaauaguugguaaccaucacgaaaugaucgaagaacuagagaaagccuaucaauacaaauauaugcuagugucaagagaagucuucgaaaaaacaggagaucuguucaacgugacaguuuacagccgaaaagccaaaaaaacccuaauaccgauaaaacaagauaaaccaauaaauaucuacggcggauauucagggaacaaugacgcauacauggccauaguaaaacucccagguaaaaaaggaaaaccagacaccuauaaaaucguaggcauaccacucagauuugccggagaacuugaacgagcaaaacaacuaggugagucagcauauagagagaaauuaagugcaguaauaacaccccaauucacaaaagagaaaaaagauaggaaaacaggugaaauaacaaaaguagucgaugauuuugaaguuguacuagauagaguaccauaccgacaacuauuuaaagauucagacaagugguuuauguuaggauccgcugcauaccaauacaacgcaaagcaauuaguauuaaacaaugaugacgugaaguuacuaaacgaacaaggcagaaagaaauuagaacuuccaaacgaaaaacucucaucagcacugaacgacguauuugaccacauaauacaaauaaugaacucuaaguucgggcuauaugauaaaaacggauucagaacuaaguuaacagaggcagcaaguauauuuuacgauuuaccgcuuagagcagaguauaauggaaauaaaaaaguaacagacggcaaacuagaaguacuagacaauauacuaauuggauuacacgcugacccaucauucggaaacuuaaaacaauuaaacauguccacaccauucggacagaugcaaacaaaaggaggagugguccuaaacggaaauucaacccuuauauaccaaaguccaacagguuuauucgagagaagagucaagcuuaaagaccuaucuaaauga

SEQ ID NO: 5353 - RNA, 4059 nt, Artificial Sequence
  Cas9 variant
augaaaaaaauccuuggauuagauuuaggaacaacaucaauaggaugggccuucauaaaugaaggcgaaaacgacaacgaaaccaguaguauaauaaacgcaggaguacgcaucgugcccuuaacaaccgacgaagaggcagauuucaaaaaagggaauacuaucucuauaaacgcagacagaacacuaaagcgcggagcaagaagaggccuucagcgguuuaaacaaagaagagaugcauuacuacaaaguuucagggguauaaacuuuauaucaucgaauuacguuuacgcagaaacuggaaaacaaacaacauuuucaaguuacaaacuaagagcaaagagcgcaaccgaacuuguuacuaaagaagaauuaguccaaguacucuuaaugcuuaauaaaaaaagaggauauaaaucgucaagaaaagcaaaaacugcugaagagggagacgcaauagauggaaugaaaauugccaaggagauauucgaaaacaaccuaacaccuggacaauggguauauaacaguuuaucaauaggagggaaauucauucccgacuucuaccgaucagaccuacaaaaagagguagaaaaaauaguaagauuccaaaaucaguuucacccagaacaaaugaacgaaaaauuauuggaaaacauacaaggaaaagcaagaacugucacuucccaauacuuuagucgaauucuaaacaucccauuagccgaaaauaagggcacucgugaagaaaccaaacuccaacauuacaaauggagaaacgaagcucuaaccgaagaacuagacuuaaaaguauuagccuuuauuaucacagaaauaaacaaucaaauaaaccaaucaaaugguuacuuaggagcuauuagcgacagauccaaagagcucuauuucaaccaagaaacagucggccaauuccaguauaaucagcugaaggaaaaugcacauacaaaacuaaaaaaucagguuuucuaccgacaagauuaccuagaugaguuugaaaaaauaugggaaacacaaucaaaauucuacccugaauuaaaugacgaauuaaaaucggaagucagagacaucacaauauuuuaccaacgaaaacuaaaaucucagaaacaccucgucucauucugcgaauucgaaaaaggacacaaagcaauucccaaaucaaguccacucuuccaagaauucagaauauggcaaaacauaaacaacauagucgucaaaaacgagaccacaaaagaaccauuucuacucggagaagauuugaaaaagguaauagcccaagagcuaaguuucaaagagucaaugaccgauagccaacuauuaacauuuugcgaccuuaagaaaggaacacacacagugaauuuuaaaaagauagaaggaaaccgaaccaacaccucauuauuuaaagcuuucgaaaaaauacugguauuagaaggauaugacgaacucgaucuaucaaaacuagacgcgagcgacauaaaaagcauuauaaaaucagccuucucggaccuagaaauaucaacagcaauuuuagacuuugacccgacaauacaaggaaaugacuaugacaaacaaaguuacuaccagcuguggcaccugcuauauaguagugaagaagaugauuuccuaaagaaaucucugauggauaaguuuggcuucaaagaaucccaccuaccauuucuuuugaacauaaacuuacaagccgauuacggguccuuauccgcgaaagcaauuaaaaaaguccuaccccauuuaauggauggucacauauaugauaaagccugcacacuuguaggauauaaccacaguaguucucucaccacagaucaaaacaaugagagaguacuaaaagauacucuugaauugcuuaaaaaaaacagucucagaaaucccguaguagaaaagauacuaaaucaaaugaucaacgucauaaacgcgaucauaaaagaucccgcaauggguaaaccggaugaaauaagaguagaacuugcaagagaacugaagaauaacaacgaacaacgaucggaaaugacaaaagcaauaaacaaaucaacgacagaacacgaacagauccgaaaguuauuacacacagaauuuggaauacauagaguuacaaggaacgauauaauacgauacaaguuauggaaagaaugugaugggauuucucuauacacgggaaagcccauagagcccagcaaacuauucacgaaagacuaugauauugaacacauaauaccaaaaagcagauuauucgacgacuccuuuaguaauaaaacuauaugcgaaagacaacucaacaucgacaaaucaaauaaaacggccuauagcuuuuuccaagaaaaacuaagcgccgaagaauuugaccaauucgaaaaaagagucaaaucacuuuucggaaaaauaagcagaaccaaacaaaauaaacucuuaauggccaacaacgagaucccugagggauuuauagauagacaacuccgagaaacccaauauauagcaaagaaagcuaaggagauacuauuagaaguaucacgaaacgugacagcaacuaucggaucuguaacagacaaacuuagagacgauugggaacucguagauguuaugaaggaauuaaacugggaaaaauacgacaagcucggacuaacauacauagaagaaggaaaaaacggcgaaaggcuauauaaaauaaaagacuggacaaaaagaaacgaccauagacaucaugcuauggacgcuauaacaguagcuuucacaaaaccugcauacauccaguaucuuaacaacuuaaacgcccgaaccaauacagauaaaaaaggaaauuccauaaucggaauagaaaauaaauaccuaaaaagagauaaaaacaauaaacuacgcuuuauagaaccaauaccaaauuucagagaaguagcaaaaaaacaacucgaaagcauauuaaucucuuauaaagccaaaaauaaaguagugacaaagaauaaaaaugucacaaaaaaaucaaaugguacaaaucaaaaaauccaacuuacuccaaggggacaauuacauaaggaaacgguauauggcaagcuacaacaauacguaacaaaagaagaaaaaauaaacgccaauuucacaccagaauacguaacaaaaguugcgaaaaaagaauaccgagaagcacuacucaaaagacuuaucgagaacgaaaaugaucccaagaaagcauucacaggaaaaaacgcacuaucuaaaaacccuauuuacauaagccuagaaaauaacauauuaguaccagaaaaaguaaaaauagucugguuaaaauccgauuacaccauaagaaaagacauaaccccagauuuaaaaaucgauaaagucauagauaucggacuaaaaacaauacuacagaaucgguuaaacgaguuuaauggagauacaaaaaaagcauuugucaacuuagaugaaaaccccauuuggcaaaacaaagaaaaaggaauagcaaucaaacgcguaacaauaucaggaguauccaaugcacaagcauuacacacaaaaaaggaucaccucggaaaugaaauauuagaugaaaacggacaaccccuaccaguagacuuugucaguacaggaaauaaucaccacguagccauauauagagaugaaaaaggaaaccuacaagaagaagucguaaguuucuuugaggcaguaacucguaacaaucuagggcuaucaauaauaaacaaaaaccaugaaaaaggaugggaauucuuauucucaaugaaacaaaaugaauuuuucauauucccuacagacggauuuaacccacaugaaauagacuuacuuaacacagaaaauuaucaucucaucucaagaaauauguuccgaguccaaaaaauugcgacuaaaaacuauauguuuaaucaucaucucgaaaccaaaucaguagacggggaaaugcuuaaaacaaagaaacaacucucaaaaaucucauaccacuucauccaaacaccaagcuaccuuaacuacauaauaaagauccguauaaaccaucucggacagauagugcaauugggugaguacuga

SEQ ID NO: 5354 - RNA, 4059 nt, Artificial Sequence
  Cas9 variant
augaaacaagauuauuauauaggauuagacauggguacggaaaguguaggaugggcggugaccgacguugauuacaauuuaaucaagaaaagaggucaagacuauugggguguauauuuauucgacgaagcacaaacggcacaaggacggagggcauucagaacuaauagaagacgacuugcacgaguacgucaucgauuaaacuuacuccaagaacuauucgauagcgagauaucggcaaaagauuuuggauucuucuacagguuagaaaauucaaaauacuucgacgaagauaaacccgaaauugcgaggggaaaauucuuacuauuuaacgauaaagacuucggugacaaagaauauuacaaaaacuacccuacaauauuucauuuaagaaacgcauugagaacacaagaaauaaaagacguucgauuauuauauuuggcgguacaucacauauugaaaaacagaggacacuuucuauuuggggaacaagacuuuaaugugaaugacgcgagugauguaucaggggaauuugagaaaauaaacagauuccuaagcgaaaacgacggggcuggauucgaucgagagaaaauaccagaaauauucgaaacacucugcaaugaaaaccuagccaaacgugaaagaaaagagaaaauacuagaauuagcagggaacagcaaaaauaaacuauuaggugaagcaguaaacgcuguuguaggacuaaauuuuucgcuauccaaaauguucggagaagaccgcgauuuccaaggagaaaacaaaaugaguuuuacagauaguaguuucgaagaaaaacuagcuaaagcuagaauggcacuagaugaugaugaagcagacuuccuugaaacauugaagaaagugcaaagcguagcuucauuacauaacauauuacacgguaaagaauuuaucagugaagcuaaaaccgaagcauacgaaacgcacagaagagaccuaucugaacucaagaaauauguuagagaaaauuguccagaaaaauaugcuuugguauuuagacgacaggucaagaaagguaagaaaaauacuucaggggcugacgaaaacgaaaaagacgauaagaaaguaaauaacuacgcagcauacauugggauggacaaaggaaaagguuucgaaaaaugcaagaaagaagacuucuacgcauuccuaaagaaagaaauaggaauuaaugaugaaaguuuacuagccaaaauagacgaagguauauuuuuacccaaacaaauuucagcggaaaacugugauauuccauaucaaguacaccuagccgaauuaaaagcgauucucgcaaacgcagaaaacuauuuucccuucuuaaaacaaaaagaugaaaauugcgaaaugacaguaucggagaaaauaauaucauuaaugaaauucaggguaccauauuauguaggaccuuucacagacaaagaaacaagauuuucuuggaugaucaagaaagaagguuuaucaacacagaaaauaacgccguggaauuucgaugauguaguugaucgagaugccuccgagaagaaauucauagaaaggaugaccaacuucuguacauaccuaacgggugaaaaaguacuaccugcaagcucauuuuuauacagcgaguacgcauucuuaaacgaacucaauaaccuuaaaguaaacggaacuaaagacuuaagggucaaaaacauuuuauuugacuuugcaaaaacaaacaagaaauuaacauugaagaaauguugcgaacaacugguuaaaaauggacuacuaccagaagguaguaaagcaagagauguauuuaguggaaccgacggcgauuuuaaaaauaguuuaagcucauauauagauuucaaaagaauaauuggugauaaagcugacuuauacagagauaugugcgagaaaauaauuuuauggauaaccguaauuagugacaaagaaaggcuagucaaaaucaucaaagauaaauacggaacgguucuaucugaugaagaaauaaaaggauuaaaagcacuaaacuacacuaaauggggccgacuuucagaaaaacuauuagaugggauauucgaaaccgacucagaaggagaaguaggaaacguuucuauuauagagaaaaugagaaccgauacggaaaauuuuauggaauuacuaucuaauaaacacaacuauaaaagagcaauagaacuggcaaauucggaaaguauaguagacgagagagugacauaccgagcgguagaagaauuauacuguuccccagcuguuaaaagauccauauggucagcacuaaaaauaguacgugaaauuguuaaaguacaaggacauagcccgaagaaaauauucguagagacgacuagagaaaaacccgaugugacacgaaaaggucaaaggacaguuucuagaaaacaacaauuauuagacaaauacagagagaauuugcgcaacgagacagaacuaaucaagaaaauugaagaaacagaagacucuaaauucaauagugauaaacuauucuuuuacuuuacccaaaugggaaaagaugcauacacuggagagaaaauagaguucgaugacguauucaaaacugaaaaauacgacaucgaccacauauacccaagaucaaaaauaaaagaugauagucucgacaaucguguguuagucagaaggaaaauaaaucagagcguaaagaaagauucauauccacuaucagccgaaauucgcaaucguauggaaggcuuauggagacaacugagagacaagaaauuaauuagugacgagaaauuuuacagacuuacaaggucaacuccauuaacagaaaaagaaugcggugauuuuauuaaugcucaauugauagcaacaagucaaucggcaaaagcagcaauccagcucuuaaaaagaauguuaccagaaucagaaauaguauacaguaaagcaggaaacgucaacgaguucaagaaaagauuagaauuuguaaaaauacgagaauuaaaugacuuacaccaugcaaaagaugcauacuuuaauauagugguaggcaacguuuucaacacgaaguuuaaucacaacccagcagucuuucaaagaaguaacggaacaggaaauuaugauuuugaaagacuauaugacuucgauauaacaaaugccuggaagaagggggaugaaaaccgaaucagaagugucgcagagaagaauacaugccggguagucagauucucaaaaacggaaaaaggccaauuuuaugaugccacaauuuacccagccggcaaaaacgauaaacucgcgccuguaaaaggaaaagcaccguuaaaugacacuucaaaauauggaggauacgauaaagagacuacagcuuauuucaugcuuguaaaaucaagagacaagaagaagaaagauaaaacauuacuaagucuggaguguguaacuguucuagccgacaaaaauuuucguacugcagaagauaaacuaaaauauugugaaaaagaacuuggguuaaaagagccagaaauacuuauagagaaaauaaaauuaaacacuuuauuuaaaauaaauggaagcuaugcguggauaagaggacgaaccaaugacagguuaguacuaugcaacgcaaaccaauuauggcuggauaauggaucagcaaaagaacuaaagaaaauaucaaaccauuuccgggacgucaagaaauauaacaauaaggauuuaccgguaagagaagaagaauuuagcaaagaacaaaaucucgcacuauacgauuuguuuaccgaaaaauuagguggaaaaaucuaugcaggacuuccaguacaaggccaaaucaaaaaccucgaaaaaggacgggauaaguucgaggcuuuagaacuaaaagaucaacuauuuguuuuaauggaaauucucaaauuuaugcagugcaauucaaugacuucgaauauaaaguuaaucggaggugccgaaaaugcagggaaaaauagaauaucuaaacuaauacaagacucggauguaaaaaugauauuuugcucgccaacaggauacuucuguaaaguaguggacuuuaaaagauuucuauga

SEQ ID NO: 5355 - RNA, 4059 nt, Artificial Sequence
  Cas9 variant
augaagaaaauacucggacuugaccucggcacaacauccauaggaugggcuuuuauaaaagaaccagaaaaagauguuguggguucagaaauaguagacaugggcgucaggauaguuccacuuucaagugacgaagaaaacgacuuugcaaaaggcaacaccauaucaauuaaugcagaucgaacucuaaaacgaggugcaagaaggaaucuccaaagauucaaacaaagaagaaaugcacuccuagaaauuuuuaaagagaagaaacuuauaaguacaaacuuuaaauacgcagaagacggacccucuucaacuuucagcacgcuaaaucuacgagcgaaagcagcaaaagagaaaauagaacuacaagaccucguaaaaguguuacuacaaauaaacaagaaacgaggauauaaauccagccgcaaagcaaaaagcgaagaagaugauggaagcgcaauugauaguaugggaauagcuaaagaacuauaugaaaaugaccucacuccgggccaauggguauacgaagcauuacaaaaaggacgcaaaaacguaccagacuucuaccgcucggauuuacaagaagaauuuaagaaaauuguaaacuaucaauccgaauuuuuccccgacauauucaacgcaucauuugucgaagauuggaugggaaaagcauccaccccuacuaaacaauacuucaacaagaaaggaguacaacuagcugaaaacaaaggaaaaagagaagaaagaagacuucaagaauacaaguggagggcagaagcaguaaacuucaaaauagaccucucugaaaucgcauuaauacuuagucaaauaaauagccaaauuucaaauagcucaggauaccuuggagccaucagugacaggucgaaagaauuauacuuuaaaaaucucacuguaggccaauauuuauaucaacaaaucaagaaaaauccccacacccgauuaaaaggacagguauuuuacagacaagacuaucuugaugaauuugaaaggaucuggagcguacagucaucauuuuacccacaauuaaaugacgcauuaaaaagagaaguaagagauaucacaauauuuuuccaaagaagacucaaaucacaaaaacaucuaauauccaacugugaguucgaagaccaucacaaaguaguacccaaaucgcacccagucuuucaagaguuccgaauauggcaaaaucuaaacaauuuacuucuuauaaagaaagauaaccucaaugaaaaauucgaccuugaacuagaaucaaaaauagcacuagcgaacgaacuagcauuuaaaagagaacucaacgucaaagaugccuuaaaaauauuaggcuuaaaaccaaacgaaugggaguucaacuucacgaaaauagaaggaaaucgaacaaaucaagccuucuucgaugcguuugcaaaaauaauagaacucgaagacggugaaccaauugaucuaggugacuugaaagcagaugacauacuagaucaauucucagaggcauuuuuaagaauuggcaucgauaccgaauuacuacaaguaaauucagauaucgaaggagcagaauaugaaaaacagucuuacauucaauucuggcacuuacuauauucuagugaagaugaucagaaauuaaaacuuaacuugauccgcaaauucggauuuaaaccggaacacgcaaaaauauuagcaaguaucagccuacaagacgaccacgccucucucuccucaagagcaaucaagaaaauacuaccccacuugcaaucaggccucauauaugauaaagccugcacauaugcuggauauaaccauagcucuaguuuuacuaaagacgaaaacgagaaaagagaacuacgcgcagaacuagaauuacucaagaaaaacucacuccguaacccuguuguagagaaaauacuaaaccaaaugauuaauguaguaaaugcaauacucaaagaucccgaacuuggacgaccagaugaaauucguguagagauggcacgcgaacuaaaagccaaugcagaacaaaggaaaaacaugacgucuaauauugccagugcgacaagagaccacgacaaauaccgugaaauacucaaaagugaauuuggacuaaaacgaguuaccaaaaacgaucuccuaagauauaaacuuuggcuugaaacugacggcauaucacuauauaccggaaaacccauagaagccucuaaauuauuuucaaaagaauaugacaucgaacauauaauuccgaaagcgaggcuauucgacgauaguuuuucaaacaaaacaauaugcgaaaggcaacuaaacauagacaaagcuaacgucacagcguucucuuuccuucaaaacaaauuaucagcagacgaauuugaacaguaccaaagucgcguaaaaucauuauauggaaaauuaucaaaagcaaaaauacaaaaauuacuaauggcuaacgacaaaauaccagaagauuuuauugcgagacaacuacaggaaacccgguauauaagcaagaaagccaaagaaauacuuuucgaaauaagcagacgaguaucagucacaacaggaacaaucacagacaaacuuagagaagacuggggcuuaguagaaauaaugaaggaacuaaauugggaaaaauaugauaaacuaggauuaaccuacacuaucgaagguaaacauggcgagcgacuaaacaaaauaaaagauuggucaaaacgcaacgaucaucgacaucacgcaauggacgcucuuacaguugcacucacaaaaccagcauacauacaauaccuaaauaaccuuaacgcuaaaggacuaaacaauaagaaagguacagaaguauucgcaauagaacaaaaauauuuaaaacgagaaaauggaaaacuaugcuuuauucccccaauagaaaauauaagguccgaggccaagaaacauuugagucgcauccuaguuucauauaaagccaaaaauaaaguagugaccaucaacaaaaacaaaacaaaaucgaaagcaggacuaaacgaacaaauugcauuaaccccaagaggacaacugcacaaagaaacgguauacgggaaauccuuucacuacucuaccaaauucgagaaaauaggagcaucauuuaacguacagaaaauaaacacagucgcgaaaaaggaagaaagagaagcccuacucaagagacuugcagaaaacggaaaugacccgaaaaaggcauuuacaggcaaaaacacccuaaacaaaaugccaaucuacuuagaucucgggaagaauauaaaacuguccgaaaaaguaaagacaguaguacuugaacaaaacuacacaauaagaaagaauauagaccccgaccucaagguagacaaagugauugacguaggaaucaaacgaauccuagaaucaagacucgaagaauuuggaggcaaugcuaaauuggccuucaguaaucuagaagaaaacccuaucugguuaaauaaagaaaaaggaauaagcauaaaacgaguuaaaauaucugguguaucaaauguagaaagccuccacguaaagaaagaucacuuuggcgaacccauucuggaccaagaaggaaacgaaauuccaguagauuucguaaguacagguaacaaucaucauguggcaauauaugaagaugaaaacggaaauuuacaagaagaaguaguaucauucuuugaagcaguagugagacaaaaucaaggacucccaauuauuaagaaaaaccauacacucggcuggaaauuccuauuuaccuuaaaacaaaaugaauacuucguauuuccaucagacgauuuuguuccagccgauguagacuuaauggaugaacaaaacuaccaucuaauaucacccaacuuauucagaguacagaaaauagcaagaaagaauuaugucuucaauaaucaucucgaaacaaaagcaguagauaaugacuugcucaaaaguaaaaaggaacucucaaaaaucacauaucacuuuuaucaaacacccgaacaucuccgaggcauaaucaagauccgcauaaaucauuuaggaaaaauuauacaaaucggggaauauuga

SEQ ID NO: 5356 - RNA, 4059 nt, Artificial Sequence
  Cas9 variant
augaacaagaaauauuaucuaggauuagauauaggaaccaacuccguagguugggcagugacagacgaaaacuacaaucucuauaaauacgcaggaaaaagaauguggggaauuagacuuuuugaagcagcagauacagcagcagaaagaagaaugaaaagaucaaauagaagacgacucuccagaaagaaacaaagaauagaccuacuucaagaacuauucucugaagaaauaguaaagaaagaccuaacauuuuucauaaggcuaaacgaaagcagacuccacuucgaagacaaaaguacuggagaaaaauaucccuuauuuguagauaaagaguauacggauauagacuaccacaaacaauauccaacaauguaccaucuacgaaaagaacuaaucgaaaauccagagccacacgacauaagacucguuuacuuagcuugccaucauauacuuaaaaaccgaggacacuuccuaauuaauggguccauaagugacgucaaaaauuuaucauucguaugcggggaaaugauaaaagaguucaauagcgucagugaauacgaaauaagccugacagauauaagagaacuagaaaggauacugagugacaagaaaacagcaaaaagcguaaaagccaaacaagucgcucaacuauucgaauguaccccugcagaggauaaagagcaacaaaaaugcgccaaagcaauaaucacaaaccucagcaaacuuauaguuggucuaaaagggaacauaaguaaaauguuucaucaaccccuggaagagauaucuacuaaaucauuuaaauuuacagaagccaaauacgaagaugaaauaaugccagcgauagaagaaaacuaucccgacuacgccucagucauugauagaauaaaagguguauaugacuggagcgucuuaguggaaauacuugauggagaagacuacuuauccuucgcaaaagucaaagcauaugaaaaacacgguaaaaaucuccacauauugaaaaaugugaugaagaaauauugcaaagaugaaguauaccaagcauucuuuaauggaauaaaugagaaaaauggauauggaaacuacauaggugcaauccguaaaaacggacauacguacaaaauggacaggugcaaaucagaagaagacuucuacaaaggccuacagaaaauucuaaguacaauaguacccgaccaagaagacgaagaacuccuagaaaaacuuaaagcagagguagaaaaucaaacccuucuaccauuagcuagaucaaaagaaaacggaacaauacccaaucaaguacacuuacaagagcucaugaaaauacuggacaacgcaaaagaauaccuagacuuucuaaagaaagaagaugaauacggcacaauugcggagaaaauaauaucuauagcaaaauucagaaucccauacuacgugggcccauuaucaagaagacauaaagaagaagguucuaacaguuggaugauacgaaaagaagaaggacgaauauacccauggaacuuuggagacaaaguagacguagaacaaaguaacaaagaguucauugaaagaaugacuaauaaaugcacauacuugauuggagaagacguacucccuaaaaacucauuauuauacucgaaauauaugguucuaaaugaauugaauaauuuaaaaauacgugggaacaaaauuucagucgaacuuaaacagagaaucuauaaagaucuauucugcaccauggcaaaagucacaggaaaaagaauacuagaguacuuaaaaauggaagacccagaaauuguccaggaagauauaaguggcuucgauauagacuucaaaucugcccuagcuucauaccuagacuuuaagaaacaaguugugggaaacgaaaucgaaaaagaccauuauaaagaaauaauugaagaaaucaucaaauggaaaacaauauaugaugacgauucaaaaaugaugagacgaaugaucgaacgggaauauccagaaguauuugacaaagaacaaauaaagaaaaucugucaacugaaauauucgggauggggcaacuucagcgacagguucuuaaauggaguaagaggagcagauaaagagacagaagagaguuauacaauaauagaggcccuauggaaaacaaauuacaauuuaaugcagcuucuaucuaaacaauucagcuucaaagaagaaauagaucaaauaaaugcagagaaagcaggcgauguuggaaaaauuaacuacgaaaauacagugaaagaccuuauaguaucaccaucaaacaaacgagccaucuggcaaacuauacaaauagcggaagaaauaaagaaagugaugaaaugcgagccagaaagaauuuuuauagagauggcaagagguggagaaaaagagaagaaaaggacaguaagccggaaaacuagauuacaggaacucuacgcaggcuguaaagacgacacaagaaacuggaugaaagaaauaggagacagagaagaaagagaguucaauaguagaaaguuauaucuuuacuauacccaaaugggcaaaugcauguacaccggagacgaaauagauguugacgcuuuaaugaaaggcaacagcaacugggacaucgaccacauauauccacaaagcaggaucaaagaugacagucuagacaacaugguccuggugaggaaagauguaaacaauaagaaaaggaauaaaauuuuaucaccaaaaaucagggaagauaugaaaggcuauuggaccaugcugugucaaaaaggucuaauaagcaaaagaaaauaugauagacuaacaagaacaacugauuucacagacgaagaacugucaggauucauugaaagacaauuaguggaaaccagacaaagcaguaaagcaguagcagaacuacuuaaucgacuauacaaagauagugaagucguauacguaaaagccggacuuguaagcgacuuuagacacgacaaugaucuauuaaaaaguagaagaguuaacgacuaucaucaugccaaagacgcauuucuaaacauuguaguagggaauguauaucacguaagauuuacaucaaacccucgcaaauggaucaaagauaacagagacucaaauuauuccauuagacguguguuuaauuacgacguuaaacaaggagacaaaauagucuggcaugguagugaaaacggcggacacaguauagaccaaauuaagaaaauaaugagccgaaacgacauccucuacacugaauacacguacugugaaaaaggccaacuuuucaacgaaacucuagccaagaaaggaaaugaaaaagcaaucgcacucaagaaaaacuuggacccaguaaaauacggugguuauacaacucccaaaacuucugcauucgcauucguagaguucgaugguaagaagaaagaaaggaaaaaccauauuguagaaauccccguuuauguagucaauauagcuaaacgugaacccgacgccguaaagaaauauuuagaagaacgcaaaggauacucaaauguaguaauaaagaaauauccuaucaaaaagaacucacuaaucaaaauggacgguuaccuagccagauuaagaggagcaaaugaaaaagacauuauacucaaaaaugcgguacaacuaauacuuaauaaagacuuauaugaaaucguccgcaaaauagaaaaauaucuagaauacaacuuacaauaccaagcagaugcaaaauucgaaggauuuacaaugaaagaccucaacaugauauaugaagaauuauaccuuaaacuaaaagagucaauauuucaaaaacgaccugcucaacaaaugaaaacacuagagaaaggcaaagaagccuucauaucaauugaaaaccucggugaaaaggcaaaaguaauaaacgaaaucauagcaauguucagaugcgaugcaacaacuguggcgaaccuaaaaguaauuaauggcucacaaaacgcaggauccaugaaaguaaacaaaaauacacucacuuccaaaucacuaaaauuaguacaucaaucaauaacaggacuauucgaaacagaagaagaacuuguauga

SEQ ID NO: 5357 - RNA, 4062 nt, Artificial Sequence
  Cas9 variant
augaaaaagaaauacuacuugggccuagacaucgguacuaacuccguaggaugggccguaacagacgaaaacuacaaccuaugcaaauucaacggcaagaaaauguggggaauaagauuauuugaagacgccaaaacagcagcggaaagacgaacgaaaagaaguaaucgaagacgaauugcaaggacuaaacaacgaauugaucuucuacaagaacuaugcgaaaaaucaauauuugaaaaagacccaacauucuuuauacguuuaaacgaaucaucccuacacuuagaagacaaaucaacgggagaaaaauauccauuauucguagauaaagaauauacugacauagacuaucacagagaauacccaacaguuuaucaccuaagaaaagaacuuauugaaaauccagaaccccaugaccccaggcuaguguacuuagcuugcugucacauaauaaaaucacgcggacacuuccugguaaacggaucuauuagcgacgcgaaagaccucucauuuaucugcgaaaacaugauaaacucauucaacgcugcuagcgauuauaaaauuaacauacaagacaugacugcauuagaaacaauacugacggacagaaaaauggcaaaaagugucaaagccaaacaaauaguucaacuauucaaaugcauaccaugcgaagacaaagaacaacaaaaaugcugcaaagcaauaauaacuaaccuaaguaaacuaauaguaggacuuaaaggagacauauccaaaaucuuuaacgagucauuugaagaaaucaaaaguuuuaaauuugcggaaacuaaauacgaagacgaaauacuuccgacaauggaggaaaucuacccagaucacgcagaaauaauagagaaaauuaaaucaauauacgauuggagcauucucgacgaaauccuagauggagaagaguacuugagcuuugccaaaguuaaagcauacgaaaaacacaagaaaaauuuacaugaucuaaaaauucuaauaaagaaauacugcgaugacgaaacauaccaauccuuuuucaauggaaugaaugagaaaaauaaauacucaaauuauauuggcucgaucaggaaaaacggacauacauauaaaguagaaaaaugcaaaagcagcgaagacuucuacaaagaacuacuaaaacuucuaucaucaguaaaccccggacaagaagacgaaucacuucuagaacaaauaaaauuugaaacagagaaccaaacucucuuaccacucuuaagaacaaaagaaaauggaacgauaccgaaccaaguacauaugcaagaauugauaaaaauccuagauaacgcaagcaaauauuuagacuuccuaaaugaaaaagaugaauacggcacaacagcagacaaaauaaucagcauagccaaauucaaaauaccauacuauguagguccacuaagugacagacauaaagaaaacggaucaaauucguggaugguaaggaaagaaaacggaagaauuuacccuuggaacuuugacgauaaaguagaugcagagaaaucgaacaaagaguucauacagagaaugacgaauaaauguaccuaccuaauuggcgaagauguauuacccaaaaauucauuacuauauucgagauauaugguauuaaacgaacuaaauaaccucaaaauccgagguaacaaaaucucugucgaacuaaaacaacaaauauauaaugaucuuuucugcacaaaagcaagagugaccggcaaaaauaucuuaaacuaccuaaagaaagaggauccagaauuagcggcagaagaucuaucaggcuucgacguugacuuuaaaucagcacucacaagcuaucuagacuuuaagaaacaaguaguaggaaacgaaauagaaaaagauuacuauaaagaaaucauugaggaaauuaucaaauggaaaacuauauauaacgaagauuccaaaaugaugaaacguaugauagguagggaauaucccgaaacauuaaaucaggaucaaaucaagaaaauuugccaccuaaaauauaacggguggggcaacuucagugaaacauuccuuaauggaauaaaaggagccaauaaagaaacaggagaaugcuauacaauaauagaagcacuauggaagacgaauuauaaccuaaugcaacuucuaagcaaacaauucucuuucaaagaagaaaucgaccaaauuaaugcagagaaaacuggagcaauugguaaaauuacauacgaaaaccuaguaaaagaucucgugguaucacccgcaaacaaacgcgccauauggcaaacgauucagaucacagaagaaaucaagaaaguuaugaaaugcgaaccagaacgcauuuuuauagaaauggcaagaggaggagaaaaagagaagaaaagaacagucucucguaaaacacgacuccaagaauuguauacggguuguaaagaugauacaagagauuggaugaaagaaaucggcgaccgagaagaacgugaauuuucuucuagaaaacuauaucuauauuauacucagaugggaaaauguauguauacgggggaagaaauugacguagaccuuuuaaugacagccaacuccaaaugggauauagaccacauauauccucaaaguagaauaaaagacgacucauuugacaauaugguccuaguucgaaaagauaucaauaacaacguuaaaggaaacaauauaguaccaucuucaauacaaaaagaaaugaccagcuacuggaaaaugcuucuacaaaaagaauuaauaaguaagaagaaauaugaacgacuaacgagauccacagauuuuacagacgaagaacuuagcggauucauagaaagacaacuggucgaaacuagacaaucuucuaaagcaguggcagcacuguuaaacagauuauacaaaaauagugaaauaguuuauguaaaggcaggcuugguuucagacuucaggcacgauaacaaguuacuaaaaucacgucguauaaaugauuaccaccaugcaaaagacgcuuuccugaacauuguaguaggaaauuguuacagaacaaaguucaccgccaacccucgacaauggaucaagaaaaacagagacacaaacuacaguaucagacgaguauuugacuuugauaucaagcaaggcgauaaaauagucugguaugguaauaaaaacgaaaauggaaaacacaccaucgaccaaauaaagaaagccaugaguaggaacgauauacuuuacacugaauacacauacugugaaaaaggaaaauuauuugaugaaacacuaaccaagaaaggaaacaagaaagcaaucccccucaagaaaaacuuagauccuuuaaaguauggaggauauacuucaguaaagaccagugcauuugcauuuauagaauuugacgauaagaagaaagaaaggaaaaaccacauaguugagauacccauauacguggcaaacaucgcaaagcgagaaccagaagcaguaauuaaauaucuagaagaacaaaaagguuacguaaacauuguagucaagaaauacccaaucaagaaaaauucacuauugaaaauugacgguuacuuagccagacuaagaggcggcgauagcucaauaauaacacucaaaaacgcaguucaacucguauuagauaagaaaaguuaugaaauaauuagaaaaguagaaaaauaucuagaccauaacucaaaauacgaggcaaauucuaaguuggaaaaauuuaacgaaaacgaccugaauauuauuuauaaugaacuaugccuaaaacuaagaaauucuauuuaucagaaaagaccuguacaucaacuagaaacauuagaacaaggaauugacaacuuccgaucgcucgagagcuuaaaggacaaagcuaagaucaucaaugaauuauuggccauguucagaugugaugcaaaaacaggaauggaucuucgauuaauaggaggagcaaguaauucaggacgaaugcguauaucaaaaagcagacuaacaucaaaaucauuaaaacuuauaaaccaaucuguaacagggcuuuucgaaacagaagaagaacuuguguga

SEQ ID NO: 5358 - RNA, 4062 nt, Artificial Sequence
  Cas9 variant
auggagaaaaauuauuaccuaggauuggauauggggacuucaucaguagggugggccgucacagacgaaaauuacaaucuaaugagaaagaaaggcaaagacuuauggggaguaagauuguuuaaagaagcaaaaaccagugcagaaagaagaguuaaacgaacuucacgaagaagacuacaaagagaaaaagcucguauagguuaucuaaaagaauuauuugcugaugaaauaaauaaaguagaugcagguuucuaucaaagaauggaagauagcaaauuuauaucagaugacaaaacgguccaccaaaaauucaccuuauucuccgacacaaacuauaccgaugaagauuauuacaacgauuauccaacgauauuucaucuacgaaagaaacuaauagaaagugacgaugaauacgacguaagaauggucuuccuggcacugcuaaacauguauaaacaucgaggacauuucuuaaacgcgaacuuaucagacaacgggaugggagauauaaaugaacaauacgaucguuuaaaagaacuuugcucagaauaucucaauguagaaugggaaaacaaaccagauaaauucgaagaaauacuuaaagaaugcaacuguucaaacucccuaagaaaugaaagauuacuagaaacauuuaaucucaagaaaacagauaaagaaaaaugugaaaugcuaaaacuaauaugcggacuaucaggaacacuaagcaaaauauucaaagaccucgaugacgacucagaaaccaagaaaaugacaaucagcuuuagguccuccaauuaugacgaagaagcaauaaauguggaagaaaucauaggcagugaaaacuucgaaauaauugcaguacuaaaagaaauccaugauuggucgaugcucgcaaacauaaugagagguaagaaauauuugagcguagcgaggguagaagaauacgaaaaacacaaagaugaccuaaaaauacuaaagaaagugaucaaagaauacucaauugaagaauauaauaacuucuuucgaguuauggcagacaauaacuacucugcauacguuaauagcguaaauaguaacaaagaaagcacaaggcgcggagcgaaaugcgacaacgacaccuucuuuaaagaaaucaagaaaauagugaauaaauguuaugauucagaagaaaaagaauauauacuuaaagaaauagaaaaaggaacauucuuaccaaaacaaauaauaaguucaaacggaguaaucccaaaccaaguccacaaaaucgaaaugaagaaaauacuacagaaugcugaaaaauacuuaccauuucucacagaaaaagaugacucaggccucucuguaucugaacggauauuacaaauguuuucauuccaaauaccguauuauauugggccaauaucuggaaaaaucggaagugacgagaaaagcaaaaacagcuggucuguacgaaaagaaaaaggaagaaucuacccauggaauuucaaagauaaaauagacgaaaaagaaagcgcugaaaaauuuaucgaaagaaugguuaaucauuguacuuacuuaaauaacgaaaugguacuacccaaaaacucacuucuguaugaaaaauucaugguucuuaacgaauuaaacaauuugaaaauaaacaaugaaaauauuucaguugaacuaaaacaaagccuauacaauaacuuauucaaaacaggcaagaaaguuacagcaaaagguauaaaaaguuaccuagaaagaaacggcuuaugugagccaaacgaagacauaaacuuaacaggaauagauggggacuucacaaacagacucagcaauuacgcaaaauucaaaggaauauuuaacacagaugaacuaacauaugagcaauggaauauggccgagaaaauaauaaaauggucaacuauauacggagauucaaagaaauucuuggaagagaaaauaagaaacgaauacuccgaaaaauuggacucucaacaaauaaaacgaauuuugggaauaaaauuuagagauuggggaagacuaagugaagaacuacuaaacauggagggagcggauguuaacacgggggaaaucaaaucaguuaucggacgcaugugggaugagaauuauaaccuaauggaauuaaucgcuacggacaauuucaccuacaaacaaguaauaaaagaaaaacaaaacggacuagacaaaagucuaucagaaauagauuaugacgacuuagaugagcuauauguuagugcaccaguaaaacgaaugaucuggcaaacgcuacuaaucauaaaagagcuagucagcgugauagguuaugaaccaacaagagucuucguagagauggcaaaagacguaaauacagagaagaaacgaacagauaguaggaagaagaaauuuuuggauuuauauaaacagugugaaaaagaugaaagagauuuuuggauuaaagaaaucgacgauaaaagcgaagcugaauuuaggaagaagaaacuauaccuauacuauacacaaaaaggaagaugcauguacaccggagagcaaauaaacccccuagaccuaaccaaugacaaccucuaugauaucgaccacauauacccacgacacuuuguaaaagacgacucaaucgaaaauaaucuaguauuagucaagaaagagaaaaacgcucauaaaagcgauaccuuccccauugaagaugacauaaggaaaaaccaauacgcuuucuggaaaaugcuauacgagaaaaacuucauaacgaagguaaaguaccaacgauuaaccagaaaagaaccauucuccgaugaagaaaaagccaauuucauaaugagacagaucgucgagacccgucaaggcacgaaaguaauaacagauauacuagagaaaaguuucgacaaaacacaaauaguauauguuaaagcagggaacguaucguuauucagacagaaauacgaauguauaaaauguagagaaauaaaugauuuccaucacgcaaacgacgcuuauuuaaacaucguagucggaaacgucuaugauacaaaauucacaagugaucccagaaauuucauaaaagaauacaggaaaaauccccaaaagaacgaauaccacauguacaaauuauucgacuacaacguucaaagaggcgaccgaguugcuuggacugcaucaaacggggaaaguaugaaagucgucaaaggaacauuaaagaaaaauacaccuuuaguaacauuuauguccuacgaagaacauggaggacuuuaugaccaaaacaucauaagugcgaaagauauagaaaaaguaaaaggaaaaggauauuugccaauaaaaucgagcgacucaagauugaauaauacggaaaaauacgggggauaugcaaaagugagcggagcauauuucuucguaguugaacacacuguuaaaaacguaagaauaaggacuauagaaccaaugcccuguuauuugacaaaaguacuaacaacaaaagaaaagauagaagacuauuguugcaauauucuuaaauacgauagcccaguagucaaauacgaaaagauaaaaauguacagccuaauuaaggucaacggguacccaauguaccucacaggacgaacggggaaccaguuaauaguaucuaauggaauacaauuagugcuuucauaugacgaggcgaaauacaucaaagacuuacuaaaaauaaaucaagaggaguuugaucaaaauagauuagaaaacuuaggaaucaauaaauuccgaaacgagaaacuauacgacacucuuaauaagaaauacacaaacgaaaucuauaagaaacgaccaaacaguaugggcaacaaaaugauagaguggaaaaauacguuccaaaauuuaucaaucaaagaccagacagaaguacuucuccaacuuauccaacuuggacaaaaacaaaauagcggagugaacuuagaaaaacuaggcgcaagcaagaaaacaggagucaguuuggugucaaagaaaauuacugauaaagaaucauucgaacuuauaaacaaaucaauaacaggucuauaugagaauaaaguugaucuacucagagucuga

SEQ ID NO: 5359 - RNA, 4062 nt, Artificial Sequence
  Cas9 variant
auggcugccuucaaguauuaucucggucucgacaugggaacaaacucaguuggcugggcagucacagacccaaauuacaaccuauuaaaagcuaagggaaaagaccuauggggaauucgagaauuuaacgaagcauccacugccguagaaagacggacucacaggauuucuagaagaaggagacaaagagaacaaguuagaauaggucuucuaaaagacuacuuccaugacgccaucggagaaguugacccagacuuuuuucaacgauuagcuaauucaaaauaccacuuagaggacaaagauacagaaguuagauacaaaaauaaugucuucaacgacgaugacuacacugauaaagacuacuucgaucaauacccaacaauauaucacuuaagaaaggaauuaaucgaaucaacagauaagcaugauguuagauuagucuucuuagcguugcuuaauauguuuaaacauagaggacacuucuuaaacucgggacuuggagaaaauaguggugaaaauaauauaaacaacgcuuaccucgaguuaacuaaccuacuuucagaauucacucaauauaaucugaacgaaacuauagacggcaaaaaaauagaagacaucuuaagcagaagagacaugucacgaacucgaaaagccgaaggcuuagcggaaaucuuaggugucgacuacaaaaacaaaccauacaaagaauuaauaaggggccuuuguggauuaaaauucaacgcaugcgcaauauucccugaaauacaaagugacgaaguacccaaauuagacauaugccugucggaagcaucguucgaugagaaaagcgaugaaaucgccaauauacuaggggaagacuauuucgaaauuauuauggcaaugaaagacauuuacgacauuggaucauuagcagggauaaugaaaggucauaacuaccuuucacaagcuaggguuacaucauacgaaaaacauaaggaagaccuaagauuacucaaaaaugucauaagaaaauacugcagcaaagaagauuaugauaauuucuuuaauuccgaagcagauggaagcuaugcauccuaugucgguucuuacaauucaaaaacaaaacaaagacguguaggaaacaaaagguccagugaggaauuauacaaagcaaucaaaaaaauucuaaaaaauguaccagcagaggacgccgacguacaaaggauacuaaugagcaucgaaaacgaaacauuuuugccgaaacaauuaacugccucaaacggaguuauaccaaaccaaguucaugcgaaagaaauaaaaaaaauauuaucaaaugcugaaagguaccuaccuuuccuacgagaaaaagacgaaacuggacuaucaguaagcgaaaaaauuaugaaauuauucucauuccaaauaccauauuacguugggccuacuacugaaaaaucgagcaaggacgggggaaauggcuggguuguacguaaagaagaaggacaaguacuaccuuggaauauagacgaaaaaauagacaugaaagcgacaucugaagcauuuauaucaagaaugguuaggagaugcacauacauaaguggggagccaguauuaccaaagagcucacuagaauaccaaucuuucuguguauuaaaugaaauaaauaacauaaaaauugacggugaacgaauaucaguagagcuuaaacaagauauauacaaagaagucuuccaaaaaggcaaaagggucacaaaaaaacaauugugcaaauaccuccacacuaggggaauaauugaagcggaagagcaaguaacaggaauagaugucacaauaaacaacgcacuaacuacuuauggaaaauuuaaggcaauacugggagacgacauaucaaaagacagcgugcaaaaaaugguugaaaacauaguauuuuggugcacaguauauggagacucaaaaaaauuucuaaaggaucgaauagaagaaaaauauggcgaaaaauuaacaaaagagcaaauaaaaaggauugugggguucaaauuuaaagauuggggaaaccuaucaaaaaauuucuuagaauuaaguggagcagacguuucaacaggugaaucugucuccauaauacgagcuuuauggaacaauaaccucaaucucauggaauuaauaaauagcagacuguauaacuauaaagaaagacucgcagaauaucaaaauacaaugaugaaaacuuuaagugauauagaagcggaagaucuagacgaauauuauuucagugcaccaguuaaacgcaugauauggcaaacuauucuaauaauuaaagaacugguuaaaguacuagggugcgaaccagauaggauauuuguugaaaugacaagaagaccagaugaaagaaaaaugagaaccgaaucuagaagaaagaaguucgaagaacuauacaaaaaagugaaagacgaagacguagauuggaugaaagucauagcacaugcagacgaaacaggcucaauacgaagcaaaaaaauguacuuauacuuaacacaaaaaggaagaugcauguacacaggcaaacauauugagcuaagcgaucucuuuaacaauaaucuauacgauauagaccauguuuauccgagacauuucguaaaagaugauaauauugauaacaaccucgucuuaguauguaaggaaaaaaacgcacauaaaucagauauuuauccccuagaagaugaaauacuagccucccaaaaaaauauguggagcgaauuaagaagauccggauucauuacugaagagaaauauaaccgacuaauaggacgcaacaguuucaccgacgaacaaaaagcagguuuuaucgcaagacaacuaguugagacaagucaagggacaaaagguguagcaaacauucuacagcaacuacuaccagaaucuaaaauuguuuaugcuaaagcuucaaaugucagugaguuucgaaauacuagggacauuccaaaaagccgguuaauaaacgaauuucaccacgcacacgacgcauaucuaaauauuguaguaggaaauguuuacuauguaaaguucacacagaauccgcuaaauuuuauaaaaaacgauuacgaucgagacaaaacaaagaauaauuacaacuuaucaaaaauguucgauugggacguagaaagaaauggcgaaguagcuuggauagcacagaaaaaagauggcgaggcagguacaauugcaacaguaaaaaaaguacuaggaagaaacacuccguuaaugaccagauacucguuugaggguaagggaggacuuacgaacgagacccucuauucagcaaaaaaagcgaaagaagaaggauacauuccuuucaaaucaagcgacgaaaaaaugaaagacguaacaaaauauggaggauuuacaucggucacaggugcuuauuuuuuucugguagaacauacagaaaaaaaaaaaagaaguaggaugauagaauccguaccgcuauauuuagcacaaaaaauagaacaaaauccgcacgaauuggaaaaauacugugaacaaguccuagggcuaauagauuuugauauacgaguaagaaaaauuaaaauagguuccuuaauuaaaagaaagggauacuucuucuacaucacuggcaaaacaggacauagacuuauauuacgaaaugcaguaaacaugugcuuaaaaaaagaauggguuaaauauauaagcaaacuggaaaaggcgguagauaagaacaauguagaagggauaaucaccaaagaaaaaaaugaacucuuauauucagaauuaaucgaaaaauucaaaaacagcauauucaguaacagaccaaacccaguuggugauaaguuagaugaagcuaaagaaaaauucauuaaccuagacauagagaaacaaugcaucgugcuaugccaaauauuacaauuaagcaguguucuaggaagcgaaugcgacaugaccuuguuaggagaaagugcgcacugcggcaaaauauuaauaucaaaaaaaauuggugaugaagacaucuacuuaauuaaccaaagcguaacagggcuuuaugaaaaaaagauaaauuuacgaacuguauga

SEQ ID NO: 5360 - RNA, 4065 nt, Artificial Sequence
  Cas9 variant
augaaaaaaauacucggacuugacuuagguacaaacuccauaggaugggccuucauuaacgaagcagaaaacgaaauagaaguuucaucaauuguaaacaccggcguucggaucguaccuuuaacuaccgacgaagaaucagacuuuaaaaaaggaaauacaauaucaauaaaugcugauagaacauugaagagaggcgcuaggcgaggccuucaaagauucaaacaaagaagagaagcauuauuagaaacauuuaacagaauuaaauucauagcuaccgacuuuguauacgcugagacaggagccgcaacaacauucagcagcuaccaacuaagggccaaaucagcgguagaggcaguaaccaaagaggaacucgugaaaguccuccuuaugcuaaacaaaaaaaggggcuauaaaaguucaagaaaagcaaaaacugcugaagaaggagaugcuaucgacggaaugaaaauagcaaaagaaauauuugaaaacaaccuaacgcccggucaguggguauauaauuccuugucuaaaggcggaaaauucauaccggacuuuuaccauuccgacuuacaaaaggaacuagagaaaauaguaagauuccaaaaucaauuccacucagagcaaauaaacgacaaauuacuagcagacauacaagguaaaucacggacacaaacaucacaacauuucucuaaaacacuuaauauaccacuagcagagaacaaagggacucgugaagaaacaaaauuacagcacuaucaauggagaaacgaagcucuugcaaaugaacuagauaugaaaauacuugcauucauaauuacagaaauaaacaaccagauaaaucaaucaagcggauaccuaggagcuauuuccgaucgcucuaaagaacucuacuuuaaccaagagaccguaggucaauaccaauacaaacaguuacaggaaaacguccacgcaaaauuaaaaaaucaaguuuuuuauagacaagacuaucuagaugaguucgaaaagauuugggagacucaagcaaaauuccauagcgaacuaaaugaaaaauuaaaagccgaaauacgagauauuacaauuuucuaccaacgcaaacuaaaaagccaaaaacaucucguaucauuuugcgaauuugaaaaaggccauaaagcuaucccaaaaagcucaccauuauuccaagaauuuagaauauggcaaaaucucaacaacguagucgugaaaaacgaaaccacaaaagaaguauuugaacucagcgaagaauugaagcaacucaucgcagaggaacuccaguuuaaagaaucaaugacggauguucaaaugcugacauuuugcgaacuaaagaaagggacacacaccguaaacuucaaaaaaauagaagggaaucgaacaaauacaagcaucuauaaagcauuugaaaaaauucuagaaguagaaggauaugaaauagacuuuucaaaaaugaaaccacuugaaauaaaagaaacugucgcucccaucuucgaaacccucaacaucaacacaguaauacuugacuucgaucccacaauacagggaaacgacuucgacaaacaaccuuauuaccaacucuggcacuugcuguauagugcagaagacgacgacaaauuaaaagaaacacuuaaaaccaaauucgguuuuaaagagaaucaccucccauuuauacucaauauaaauuuacaagcagauuacgguucauuaucggcaaaagccauaaagaaaauauuaccacauuuaauggauggacacauauacgacaaagcuugccuuaugguaggauacaaucacaguucuaguuuaacaacagcacaaaauaaugauagaguacugaaagauacgcuagaacuacuuaaaaaaaacaguuuacgaaauccagucgucgaaaagauacuaaaucaaaugauuaacguaauaaaugcaauaaugaaagacccagccaugggaaaaccagacgagauccgaguagaacucgcaagagaacugaaggcuaacaacgaacaaagaaaaaaagcaaccucugauauuaauacagcaacaacagaacaugaacgaauacgaaaacuacuacauagcgaguuuaacaucccaagaguaaccagaaaugacauaaucagguauaaacuauggcuugaaacagguggaaucagucuuuauacagguaacccuaucaaagcuucugacuuauucucuaaaaauuacgacauugaacauaucauaccaaaaucuagauuauucgacgacaguuuuucaaacaaaacacuaugugaaagacaacucaacauagacaaaucuaacaaaacugcauacucauuuuuacaggaaaaacuauccgagaacgacuucgcagcauaugaaaacagagucaaagaccuauuuaaaacaggcaaaauaaaaucauacacaaaauacaaaaaauuauuaauggcagacaacgagauucccgaaggcuucauugaccgacaacuccgcgaaacacaauauauugcaaaaaaagcaaaagaaauuuuacuugaaguaucaagaaaugucacagcuacuauuggaucaguaacagauaaauuaagacaagauugggaacuaguagaugucaugaaggaacucaacugggaaaaauaugacaaacuaggauuaacacacauagaagaagguaaaaauggggaaagacugucgaaaauaaaagauuggacaaaaagaaaugaccaucgacaccacgcaauggacgcuauaaccguagcuuuuacaaagccagcauacauacaauaucuaaacaauuuaaaugcaaaaacacaaggagaaaacaaagccaauuccauaauuggaauagaaaauaaacaucuguaucgggacaagaacaacaaacuacgauucauuagcccaaugaaaaacuuuagagaagaagcgaaaaagcagcuugaaucuauacuuauaucauacaaagccaaaaacaaagugguaaccaagaauaaaaauacaacuaaaaaaucgggaggaaccaaccaaaaaauucaacuaacacccagaggacgacuacacaaagaaacaguguacggcaaauugcaacaauacgcuacaaaggaagaaaaaguaaacgcuuccuucacagaagacuacauacaaaaaguagccaaaaaagaauauagagaggcacuacuuaagcgauuggaagaaaacgauaaugauccaaaaaaagcguucacagguaaaaacgcccuaaauaaaacaccaauauauauaagcuugaaagacaacauaauaguucccgaaaaaguuaaaaccguuuggcuggaaacagauuacacaauaagaaaagauaucacgccagaccucaaaaucgacaaaguaauagacguuggaauaaaaagaauauuacaaaacagacuuaaugaauucaacggggaucccaaaaaggcauuugugaaccugggcgagagcccaauuugguuaaacaaagaaaaagguauugccauaaaaagagucacaauaucaggagucuccaaugcacaagcguuacacacaaaaaaagaccacuuaggcaaugaaauccuugacaaaaacggaaacccaaucccaguagacuucauaucaaccggcaauaaucaccacguggcuauuuacagggacgaaaaaggaaaucuucaagaagaaguaguaaguuucuacgaugcuguaauaagaagaaaccuagggcuaaguguaauuaacaaaaaccacgagaaaggaugggaauuuuuauucuccaugaaacagaaugaauuuuuuauuuucccaucagacggauucaauccccacgaaauagaucugcucaaccccaauaacuaccaccuaauauccccuaacauauuccgugugcaaaaaauaucaacgaaaaacuauauguuuaaucaucaucuagaaacaaaagccgucgauggcgaaaugcuuaaaagcaaaaaagaacucucaaaaacuagcuaccauuuuauccaaacaccaaccaaccuuaacggaaucauuaaaguaaggauuaaucacuuaggcaagaucgugcaccuaggggaguauuga

SEQ ID NO: 5361 - RNA, 4065 nt, Artificial Sequence
  Cas9 variant
augaagaaaaucuuaggacuugaccuaggaacaaauucaauuggaugggcuuuuauaaaugaagccgaaaacgaaauugaagugucaucaaucgugaauacagggguucguaucguaccuuugacaacagacgaagaaucagacuucaagaaagggaacacuauaucuauaaaugcagaccguacccugaaacgaggagcaaggcgaggcuuacaacguuucaaacaacgcagagaagcacuauuagaaacuuuuaacagaaucaaauuuauagccacagacuuugucuacgcagaaacaggagcagcaaccacauuuaguucauaucaauuaagagcaaaaucugcagucgaagcaguaacuaaagaggaauuagucaaaguacuacucauguugaacaagaaaagaggguacaaaaguuccagaaaagcaaaaacugccgaagaaggcgacgcuauagauggaaugaaaauagccaaagaaauuuucgaaaauaaccuaacaccgggucaauggguauauaauagcuuauccaaagguggaaaauuuaucccagacuucuaccacagcgaucuacaaaaagaacucgagaaaauaguuagauuucaaaaucaauuucacucugaacaaauaaaugacaaacuacuagcagacauacaaggaaaaagccgcacgcaaacaagccaacacuucaguaaaaccuuaaauauacccuuggcagaaaacaaaggcacgcgugaagaaacaaaauuacagcauuaucaauggcgaaacgaagcacuagccaaugaacuagauaugaaaauacucgcauucauaaucacagagauaaauaaccagauuaaucaaaguucgggauaucuuggggccaucucagacagaucaaaagaacuauacuucaaucaggaaacagugggucaauaccaauauaaacaauugcaagaaaauguucaugcaaaauugaaaaaccaaguauuuuauagacaagacuaccuagacgaguucgagaaaauaugggaaacccaagcaaaauuucacagugaacuaaacgaaaaauuaaaagcagaaauaagagacaucacaauauucuaccaaagaaaacucaaaagccaaaaacaucucguauccuucugugaguucgaaaaaggacacaaagcaauucccaaaagcaguccucuauuccaagaguuccgaauauggcaaaaucucaacaauguaguagucaaaaacgaaacaaccaaagaagucuuugaauuaucagaagaauuaaaacaacucauugcugaagaacuucaauucaaagaauccaugacagacgugcaaaugcuaacauucugcgaacucaagaaaggaacacacacagucaauuucaagaaaauagaaggcaacagaacaaauaccugcauauauaaagccuuugagaaaaucuuagaagucgaagguuacgaaauggacuuuagcaaaaugaaaccacuagaaauaaaagaaaccguugcaccaauauuugaaacccugaauauaaauacaguuauacucgacuucgacccaucaauacagggaaacgacuucgacaaacaaccuuauuaucaacuauggcauuuauuauacucggcagaagacgaugauaaacugaaagaaacucuaaaaacaaaauuugguuuuaaagaaaaucaucuuccauucuuacuaaacauuaacuuacaagcagauuacgggucacuuuccgcuaaagcaauuaaaaagauacuaccccaccuaauggauggccauauauacgauaaagcaugccuaaugguuggcuacaaccauucaucaaguuuaaccacagcucaaaauaacgauaggguacuuaaagacaccuuagaacuacucaagaaaaacagccuaagaaacccaguaguagagaaaauccugaaucaaaugauaaacguuaucaacgcaauuaugaaagauccggcuauggggaaaccagaugaaauaaggguagaacuugcacgagaauuaaaagcaaacaaugaacaacgaaagaaagcaacaagugacaucaacacagccacaacagaacaugaaagaaucagaaaauuacuucacucggaauuuaauaucccgagagucacacgcaaugauauaauucgcuacaaauuauggcuagaaacaggcggaaucucauuauauacuggaaauccaaucaaaggaucagaccuauuuucuaaagacuacgauaucgaacauauaauaccaaaaucacgacuauucgacgacagcuucuccaacaaaacacuaugcgaacgucaacuaaauauagauaaaucuaauaaaaccgcuuacucguuucuacaggaaaaguuaucagaaaaugacuucgcagcuuacgaaaaccgagugaaagaccuuuucaagacaggaaaaauaaaaagcuacacaaaauacaagaaacuucuaauggccgacaacgaaauacccgaaggcuucaucgaccgacaauugagagaaacucaauacauugcuaagaaagcaaaagaaauacuccucgaaguaagcagaaacguaaccgcaacaauaggaucaguaaccgacaaauugcgagaagauugggaauuaguugacguaaugaaagaauuaaauugggaaaaauaugauaaauuaggccuaacacacauagaagaaggcaaaaacggagaacgauuaucaaaaaucaaagacuggacaaaaagaaacgaccauagacaccacgcaauggaugccauaaccguagcauucaccaaaccagcuuacauacaauacuuaaacaaucuaaacgcaaaaacccaaggggaaaacaaagccaauucaauaauagguaucgaaaacaaacaucuauacagagacaaaaauaacaagcuaagauuuaucagccccaugaaaaauuuuagagaggaagcgaaaaagcaacuugagaguauacuaauuuccuauaaagcuaaaaacaaaguagucacgaaaaacaaaaacacgacaaagaaaagcgguggaaccaaccagaaaauucaacuaacaccaagaggacgauuacauaaagaaacuguuuacgggaaacuccaacaauacgcaacaaaagaggaaaaagucaacgccagcuuuacagaggauuacauacaaaaagucgcaaagaaagaauaccgagaagcacuacuuaaaaggcuagaggaaaaugauaaugauccuaagaaagcauuuacgggcaaaaacgcgcuaaacaaaacaccaauauacauuagcuuaaaagacaacauuaucgucccagaaaaaguuaaaacaguaugguuagaaacugacuauacaauaagaaaagacaucacaccugacuuaaaaaucgauaaagucauagacguaggaaucaaacggaucuuacaaaaccgacuaaacgaauuuaauggugacccaaagaaagccuuuguuaacuuaggcgagagcccaauuuggcuaaauaaagaaaaaggaaucgcaauaaaacgagucacaauauccggaguaagcaaugcccaagcccuacacacaaagaaagaccacuuagguaaugaaaucuuagacaaaaacggcaaccccauaccuguagacuucauaagcaccggaaauaaccaccaugucgcaaucuaccgagaugaaaaagggaacuuacaagaggaaguugucucguucuaugacgccguaauacgacguaacuuagaacugaguguuauaaauaaaaaccacgaaaaagguugggaguucuuauuuuccaugaaacaaaaugaguucuuuauuuucccguccgacggcuucaauccacaugaaaucgaccuucuaaacccuaacaacuaccauuuaauaucaccaaacaucuucagaguccagaaaauauccaccaaaaacuacauguucaaucaccacuuagaaacaaaagccguagauggagaaauguuaaaaaguaagaaagaacuuaguaaaacaucuuaccauuuuauacaaacgccaacaaauuuaaaugggauaauuaaaguaagaauaaaucaccuaggaaaaaucguucacuuaggugaauauuga

SEQ ID NO: 5362 - RNA, 4065 nt, Artificial Sequence
  Cas9 variant
auggcagauuuugcaaaauaucaaccagguauggucgcugacgggagaaaaauuccacuagacuggacacuguauuaucuaagaaaaaaagcgcuaacucaagccauuagaaaagaagaacuagcauggauacuucucaacuucaaccaaaaaagaggauauuaucaguuacgaggugaagaagaagaagaaaauucaaccaaacaugaagaauauuaugaacuaaaaguaguuucgguagaggcggcagaagaagguaaaggagggaauacaugguacaauguaaccuuagaaaauggauggaucuacagaagacaaucaaaaauagaauuaaacgauuggguagguaaaguaagaccauucauaguuaccacggaauacgagauagauggaguaacuauaaaaaaagauaagaauggagaaguaaaaagaaguuuuagagcaccuucagaaaaugacuggggcuugagaaaaaagcguaccgaaucccuauuagaagaaucagguaaaacgguaggugcuuucauauauaaccacaucuuaucagaaccagccgacaaaauacgagguaacuucauaagaaccauagaaagaaaauucuacaaaaaagaacucgaagcaauacuucgagaacaaucgaaacaucaaaaagaauuaaaagauauugauacucuaaucgcuuguaucaaggaauuguaucccaauaacaaaccacaucaagacagcuuaaucaaaaaagacaugacauacuuguuaauuacagaccuaauauuuuaucaaagaccccuuaagucgaaaaaaucguuaauagcagacuguccauacgaauauuaugaguacguaauaaaagaaaccggugaaaauaaaagacaaucaauaaaaugcauagcuaaaaguaacccauauuaucaagaauuuagacuauggcaauucauaauaaaucuacguuuauucgaccgaaacaacgauaaagaagucacaagugaauaccuaagcucaauggaagacuacacaagauuauuuacuuaccuaaacgauagaaaagacauuaaucaagaaacacuccuuaaagauuuuuucaaacaaaaaaaaguaaaacgugguauggaaaaagaauuucccauucguuggaauuacauagaagacaaagaaaaaaaauaucccuguaaugaaacaagacaugagcuuuuaacagcacuagggaaagucggaauagaccacucgugguuagacgauaaggaacuuuuuuaccgguuauggcacuuauuauauuccguagaaagcaaagaagaagccgagggagcacuaagaaaauuaguagacaacgaugauuucgugaaugcuuuccuaaagauaaaaccuuuuaaaaaagaauacggugcauauagugaaaaagcuauaaaaaaacuauuagcaguaaugcggaugggaaacuuauggaacgagguggacauaugugaacagacaagagacagaauacagaauauaaucaaaggagauauagaugaaaaaauaaaagaccgaaugggcagaacauuuagucaacuuucagauuuucaaggacuaccagaaugguuagcaugcuaugucguuuauggacaacacagugaggccacagacauacaacgguggaccaaaccggaaaaucuaauggcguacauuaacggauucaaacagcacucgcuaagaaaucccaucgucgaacaaugcauccucgaaacacuacgcacaguccaugacaucuggaaagaagcaggccacauagaugaaauucacauugaacuaggucgcggaaugaaauccacagcugaccaaagagcaaggaugaguaaaagcauaaugcaaaacgaaaauacaaauuuaagaauuaaauccuuacuaauggaacuuaaaaaugcaaaagaauucgaaaauguucgcccauauuccccaaugcaacaagaaauauugagaauauacgaagaaggagcacuacaagaacugacaaaggaagacgcccaguauaacgaaauuagcaaaauaucacaaauggcacaaccaucagcaaaugaauugcuaaaauacagacucuggcuugaacaaaaauacuguaguccauacacaggaaaacccauaagccuauccaaacuuuuuacuagugcauaccaaauugaacacauaaucccgcaaagucgauauuucgacgauucauucacaaauaagguuauaugugaagcagaagucaaccaacuuaagucgaacauguuaggauacgaauuuauaaagaaacacgggggagagauaguccgauguacuaugauuggugacgucaagcucuuagaugccaaagaauauuauaacuucguaacagagcacuacaccaacaauaggagaaaaaaagagaaacuacucauggaggauauuccucaggaauuuuuaaacagacaaaugaaugacaguagauacauaagcaaaaagguaauggcaauauugagcaacaucguuagggaagaagaugaacaagaagcaaaaucgaaauucguaauagcguguucgggagggauaaccgauagguugaagcaagauuggggucuaaacgacguauggaauucuauaguguauccgcgauuugagcgacuaaauaaacugacaaacacagagaacuuugguagaugggaaaacaaaaaaggaaaacaaguauuccaaacaaguguccccuuggagcugcaaaaagacuuuucaaaaaaacggauagaccacagacaccaugcaauggaugcacuuguaauugccugcgccaguaacaacauaauaaacuaucuuaacaaugaaagcgcaaaaucacaagaaaaaagggaagaccuacggaaaaaauugugugacaaaaaucgaauaauaagaaaaccaugggaaacauucacgcaagaugcacauacagcucuagaaaaugugguaguaagcuucaaaaacuauauucguguaauaaacaaggcuacuaauuacuaugaaaaauaugacaaaaaugguaaaaaagaaauagcagaacaaaaaggacaagauaugugggcuauaagaaaacccaugcacaaagaaacaguauucggacaaguaaaucuuagacgaaagaucacaauaaaauuaaaagaugccuuagaaaaaauaccugccauaugcgauaaagaauuaagagacuauauaaacauacuuguagcaaaacaauuuaacaaaaaacagaucuuagcacacuucaaauccaucaacuauagauuaaauaugaaaagcgucgauaaaguagauguauggcaauuuaguaacgaaaaggagcccauggucgccacaagaaaaucuguagauacaagcuuugacaccaaaagaauagcgacgaucaccgauaccgguauccaaaaaauucuuuuaaacuacuuaaaagcaaaaaauaaugauccaaacauagcuuuuacaccagaaggaaucgcagaaaugaacaaacauauaacagaauacaauaacggcaaacaacaccaaccgauacucaaagucagaguaucagaaccaaaaggagccaaauaccaaguuggagaaacagguaacaagcgaucaaaguuugucgaagcucaaaaaggaacaaaucuuuauuuugccauauacgaagacaaagaaggcaaucgauccuauaacacaauaccacuuaacgaagugauagaaagacucaaacaagguuugagcccaguacccgacgcaaacgagaaaaguauaccauuaaaauuucacuuguccccuaaugaccuaguauauguaccaaaaacagaugaggaaaaugagauaaaaaugggacaaauauauaaauucguagacagcagugguacaacagcaaacuuugucccacacaggguaagcaaucucaucuacaacguggauaaaaaaauugcagaaaacuucugcaaccacgaaauuauucaaaaugaauacggaaucggcucaccacaauccaaaaaucaaaaaucaauuacaggagaaaugauaaaagcaguaugcuggaaacuagaggucgacagacuuggaaauauacacaaaauaauaaaguga

SEQ ID NO: 5363 - RNA, 4065 nt, Artificial Sequence
  Cas9 variant
augaagaaaauauuaggacuagacuuaggcacaacaaguauagguugggcauuuauaaaagaaccagaaaaagacguuguaggaucagaaauaguagauauggggguacggauaguaccacuauccuccgacgaagaaaaugauuuugcuaaagggaacacaauuucaauuaacgcagacagaacauuaaaaagaggagcaagaagaaacuuacaaagauucaaacaacgacgcaacgcacugcucgaaacuuuuaaagagaaaaaucuaauaccaucgaacuuccaauaugcugaagaugguccaagcucaacauucucaacauuaaaacugagagacaaagcagcuaaagagaaaauugaacuagaugacuuuguaaaaguacuucuccaaauuaauaagaaaagaggauauaaaaguucaagaaaagcuaugucagaagaagacgaagguacagcaaucgacucaaugggaauagccaaagaauuauacgaaaaugauuuaacgccaggacaauggguguaugaagcacucaaaaacggacgcaaaaacguaccugauuuuuaucgaucagaccuucaagaagaauuuaagaaaauaguaaauuaucaaagcgaauuuuacccugauauacucaacacaucuuucguagaagauuggaugggaaaagcaucgaccccaacaaaacaauacuucaacaaaagagguguacaauuagcagaaaauaaagguaaaagagaagaaagacgacuccaagaauacaaauggagagcagaagcaguaaacuuuaaaauugacuuaucagaaauagcacucauacucucccaaauaaacucgcaaauauccaauucuucagguuacuuaggagcaauaucagaccguucuaaagaauuauacuuuaaaaaucuaacggucggacaauacuuguaccaacaagucaagaaaaacccucauacacgacucaaaggucaagucuuuuauagacaagacuaccuagacgaauuugagaaaauauggucuguacaaagcaguuuuuacccacaauuaaacgaugaacuaaaacaagaaguuagagacgucacuaucuucuuucaacguagacuuaaaucccaaaaacaucuuauaaguaauugugaauuugaagaacaccauaaagucguaccaaaaagucacccaauauuucaagaauuucgcauauggcaaaaucuaaacaaccucacucuaaucaagaaagacaaccuaaaugaaaaaugcgaauuagcacuagaagauaaaacagcacucgcgaacgaacuagcuuucaagaaagaacuauccguuaaagaugccuuaaaaguacuagggcuaaaaccguccgacugggaauuuaauuuuacaaaaauugaaggaaauagaaccaaucacgcauucuucgaagccuuugcuaaaauaauagaauuggaagauggugaaccaauagaccuaggaaaucucaaagcggaugacauacuagaucaauucucugaagcguuccuacguauaggcauagauacugaacuauuacaagucaacagugacaucgaaggagcagaauaugaaaaacaaucauauauacaauuuuggcaccuauuguauaguagcgaagacgaucaaaaauuaaaacaaaacuuaauaaggaaauucggcuuuaaaccggaacacgccaaaauauuagcuucaauuucacuccaggacgaucaugccucacuaaguaguagagcgaucaaaaagauacuuccacaccuccaaagcggauuaauuuaugauaaagccugcacguaugcaggauauaaucacagcagcaguuuuacuaaagacgaaaacgagaaaagagaacuaagagcagaacuagaauuacuaaagaaaaauagccugagaaauccaguuguagagaaaauuuuaaaccaaaugauaaacguaguaaacgccauacuaaaagauccaaaucuagggagaccugacgaaauuagaguagaaauggccagggaacuaaaagccaaugcagaacaaaggaaaaauaugacgagcaacauugcgagugcaaccagagaucaugaaaaauacagagagauauuaaagaaagaauuuggucuaaagcgcguaaccaaaaacgaccuucuacgcuacaaacuuuggcuagaaacugacgggaucagucucuauacaggaaaaccaauagaagcaucgaaacucuuuagcaaagaauaugacauagagcacauuaucccuaaagcacgauuauuugacgauucguucucaaacaaaacaauaugcgaaaggcaguuaaauauagauaaagcgaacguaaccgccuucagcuucuugcaaaauaaacucucugcagacgaguucgagcaguaucaaucaagagucaagagccucuacggaaaacuguccaaagccaagauacaaaaacuccugauggcaaaugauaaaauuccagaagacuuuauagcacgccaguuacaggaaaccagauauaucucaaagaaagcuaaagagauauuauucgaaauaacuaugagaguaaguguaacaacaggaacaaucaccgacaaauuacgagaagacuggggccuaguagaaauaaugaaagaacuuaauugggaaaaauacgacaaacuaggacuaaccuauacuauugaaggcaaacauggcgaaagauugaauaaaauaaaagacuggaacaaaagaaaugaccacagacaucacgcuauggaugcauuaacuguagcauuaaccaaaccugcauacauucaauacuuaaacaacuuaaacgccaaagcaauuggaaauaagaaagguacagaaauauucgcgauugagcaaaaauaucuuaaacgagaaaacggcaaauuaugcuuuauuccucccauagaaaauauaagggcagaagcgaagaaacauuuguccaaaauccucguaucauacaaagcuaagaauaaaguaguuacaauaaauaaaaacaaaaccaagaaaaaggcagguuucaacgagcaaacugcuuugacaccaagagggcaauuacacaaagaaacgguauacggaaagagcuuccacuacucaaccaaauucgagaaaauaggagcaucauuugacgcacagaaaauaaacacuguagcaaagaaagaagaacgagaggcuuuacugaaacgccuagcggaaaacggaaacgaucccaagaaagcauuuacaggcaaaaacagcuuaaauaagaugcccauauacuuggacuuaggaaagaauauuaaacuaagcgaaaagguaaaaacagugguacuagaacaaaacuauacgauuaggaaaaacauagacccggaucuaaaaguagauaagguaaucgacguagggauaaaacgaauccucgagucaagacuagaggaauuuggaggaaacgcaaaauuagcauucagcaaucuagaagaaaauccaauuuggcuaaacaaagaaaaaggaauacccauuaagagagugaaaauuucagggguaucaaauguagaaaguuuacaugucaagaaagaucauuucggagagaaaauacuagacgaagaaggaaacgaaauaccuguagacuucguuagcacaggaaauaaccaucacguagcuauauaugaagacgaagaugggaaccuacaagacgaaguaguaaacuuuuaugaagcuguaauccgaagaaaucaaggugaaucaauuauaaaauacagacacgaagaagguuggaauuuccuauacucaauaaaacaaaaugaguucuucgucuuucccagucaggacuucaacccaaaugacuucgaccuucucgacccuaagaacuaugacuuaauaagcccuaacuuguaccgagcccaaaaguucaguaaggucauguacggaaacucagcuguaagagauuacguauuucgccaucaucuugaaacaguacuaaacgacguaaaagaauuaaaggauguugcuuauaaacaauuaaaaagccugcaauaucuuaaugguauuaagaaaguaagacucaaucaucuuggucaaauaauccaaguaggagaauacuga

SEQ ID NO: 5364 - RNA, 4065 nt, Artificial Sequence
  Cas9 variant
augacucuccauuauaacguaggucuagauaucggaacaaauaguguaggcuauacaauuguugaugacaauggaaaaauacuacaagucaaaggcaaaaacggcuauggaguacgcguauuuaaagaaggcgcaacugcagcugaacgcaggauuuuccgaacgacacaccgcagauuaaaacgucgaaaauggagacugcgcuuacuacaagacuuuuucgaaccauacauauuaccacaagaugauggauucuucauacgcagaaaagagagcaaucuaguacuaaacgaucgugaugaagauacggccucguuauucaaugacagaucagacagagauuucuaucaagcauauccaaccaucuaccaucuaagacaagcacuaaugacagaaaaacgucaauuugauguacgcgaaauauaucuagccaugcaccacauaaucaaauauagaggccacuucuuauuaaauggaaccguuaacaauuucacuaacaacaaaauagaucuccacagugauuucgaagagcucaaugcgcuacuccucaacguuauaccagaauuaaaauuccaaauagaccuagaccacucaacuauguuccaaacaacccuacuaaauacaacaauuagcaggucgggacgacaacgagauuuaguuaaaucauuuuauaacggaagugaugauaaacaguuagccaaacagcaaaaaucaguagccaccgaacuccuaaaagcaauacucggacuaaaagcaaaauuucauaaacuuuuuaaucuagacuuauuagagaccacagaaugggaauucucauucgacgcugaagacauagaugacaaauuagcuaaacuggaaccuuuaaugacugagaaccaacaacaaguaauggacauacuucaaagaauauucgccgcaauuaccuuaaacgggauugugccagaagguaagacacuaucagcaagcaaaguagacucauaucagaaacauaagcaagaccuaaaauuacuaaaagcaaucgcucaacauucugauaaaaaaacugcuaccguucuacagacagccuauaacgaauacauuaacggaauagcuucgaaaccccuaaaacaagaagauuuuuacaaacgacuaacaaacgcagucaaaaaaucaagcgacccucaaguagcagacaugcucgcucucauagaccaggaaaaauuccuaccaaaacaacgaacuaaagaaaacggagccauuccucaccaacugcaccaacuagaacuggaaaggauaauagacaaccaaaaagauuacuaucccugguuagccgaacuuaaucccaaccaagcucggcaaaaaguagcgaaauacaaacuaagcgaacuaguagcauuuagaguacccuauuacgucggaccuuuaauugaaccagaaguacaacaagccaccaguaacgcacacuucgcauggauggcucguaaggaagccggaccuauaacaccuuggaauuuugaccaaaagguagaucguaacguuagugcugaaagauucauaaaacgcaugacuacaaaagacacauaccucuuagcugaagauguccuaccgcuacauucccuauuauaucaaagauucauaguacuaaacgaauuaaacaacguccgagucaauggccaaaaauuaacaaaaaaacaaaaacaagccguuuaccaagaucuauucaaacgacaaccucacguaacaaaaaaacaauuuaaaagcuacuuaguucaaaccggggaauucgcagaauccaguaaaauugaaggccuagcaaacgaaaccucuuuuaauucuggccuaacgaccgagaaugaacuccguaaaauauuuggagcacaauuagacgaagcaagauaccaagucgacuuugaacaaauaauagaaugggcaacacuuuucgaagacgcuaaaauccuaagaaccaaacuagccgaaaucacaugguugaccaccgaacaaauugaaaaacuugcgggaauacgauaucgaggcugggguagauuuuccagaaaacuucuagccggacuacgagaucaaaacggacaacaaauaauagaccuauuaugggauacaccaaacaacuucauggucauagugucacaagcagccuucucugaagccauaacaaaagaaaaugaaaaacuaauugaucgccgcggagcgcaagacguuaucacagauuuguauacaucaccacaaaacaaaaaagcucuacggcaagugcuagcuauuguagcagacguucaaaaagcuaugggaggagugccuccucaaagaauuuuuauagaauucgcuagagaagacgaaaaaaacccccgacgaucuguagaacgcucaagacaauuggaaaaacucuaccaaacuauauccaacgaauuccucauuaauucugaagugagacaagaacuuaaagaagcaguagaucaaaaagucaauuucaaagacagacuauuccuauauuucuuacagggcggaguggacuuauacucaggaaaaaggauaaauauugaucaacuaucacauuaugauauagaucacauacuaccacaaucauucauuaaagacgauagccuagacaaccguguacucguuucacaaaaacuaaaccguagcaaaagcgauuccgugcccuuaucugaauuugcgaacuauaaguucggaccggccaugcaagccaaauggcuucaacuuaaagaagcaggucuccucagcaaacggaaauaugacaaccucacuuuagauccaacaaaacuaucaaaauucgcaccucucggauuuguaaaccggcaauuaguugaaacuagacaaguaaucaaguuagccgccaauuuacucgcauccgaagaaacaaaaguaguaacaauuaaagccaauaugacacaccagguacgaaaagaacuagauuuuccuaaaaaucgcaacgucaauaauuaccaccacgcauucgacgccuaccuuaccgcauucgucggaauauuucuaucaaaaagguaccccaaauuaaaaccauauuuuacuuacggcgacuuccaaaaaggaaacaaacuuccugaccuaaaaaauuuuaauuuccuauaugaacuuaaaaauaaagaccguagcauugacucuaauacaggcgaaaucaucugggacaagcaacgcgaccucgccuauaugaauaagauauacaacuuuaaaaaaguaacgguaguccacgagguguuaacgaaaucaggagcauuauacaaccaaacacuauauaaagcuucagaagacaaagccaguggaagagguacaaaacaacuuauaagaaaaaaagacaauaugccaaccgaacuguacgggggauauacagguuccaccucugcuuucauguccaucguaagacuauggaaaaaagacaaacccuacuacaaagucguaggaauuccuacacgaauggcagccaaguuagcaaaucaagcacaacuauuagauuacuuaacaaaaaaauuuacaacacgaaaacuaguaaaaaaaacaggugacuauaaaacaaccguagaacgguucgaacuuguaguuccuaaaguugguuuuaaucagcucguuaucgacggaggucaaccuuucaugcuugggucagcaacauaccaauacaacgcaagagaacuauuuauauccaaagaagcaguuaaagcacuaaacaaacaacucuccacccacguugaccuaguucaaguauuugaugaaauacucguccaaguuaaccgcugguuuccccuauacgauacaaauggauuucgcgaaaaacugucacacggcagagacagauucaugaaacugaaugacucauuugaagaaaaaucagacacacaaauagauguacucaacagaauccucauaggauuccacgccaacgccgccagaacaaaccucaaaauauuaggucuaggaacagaccuaggauucaugacgcaacaggcuggcauucgccuaaccgaaaaagcaauccucguacaucaaaguccuagcggacuauucgaacgcaaaguagcacuaagagacuuaaaaggccuaagguga

SEQ ID NO: 5365 - RNA, 4068 nt, Artificial Sequence
  Cas9 variant
augaccuacuccaucggccuagacauaggaacuggaagcguugggugggcuguuauaggagacgacuacagacucaaaagagcuaaaggcaaaaacuuaauuggaguacgauuauuugacucugcaacuaccgcugcugagcgaagaggauacagaaccacucgcagaagauuaucaaggcgacauuggcgccuaagacuacuuaacgacauauucgcgagcgaucucgccgaacaagaugaaaauuuccucccaagguuaaaauacagcuggguaaacccagaugacgagcaaaacccccaacugaacucagacgucgcaaauggagcacucuuuggaucgucagagacugacaaggcuuuucacaaaaauuauccuacuauuuaucauuuaagacacgaacuuaugacagacacugcgaaacaugaucugagagaagucuacuuagcaauucaccacauaguuaaauacaggggaaacuuuuuaaauaccgcugacaaaauaaaugcagaaaacagcuuuaauguagaccuuuucaucgcugcauuagaugaauacaacgaauuucuugaaacccccauaacuagcauaaaagacgcucagcuauucucagacaaacugacagauauaaaugcaaggaacaaaagcgugagagucgaaaaugcuaugucagaaacauaugacgacaaaagcaaaauauucaaggcgauacuuacagcccuagugggaaauacagcuaacuuucaaacgauauucgaccuuucagaccuagaaaaagacgaagcuaaaaauuucaaauucaaacucgacuuagaagacguagaaacgaaacucgacguaguaagggcaaaauuauccgaugaacaaaacgcauucuuagaagcaguauugauagcauacgauggaauaacacuaaaaaugauacuaggcgacuacaaaucaauaucccaguccaugauugaaucguacaaaagccaccaacgugauuggaaauauauuaaaaauaacgugagacuaaacgaacaaaagauagaacccgacaaaaacaguguaaaauucuucaaauuagaccccaagaaacuaauauauccauccaaucuagcauaucuccaaguaauauccucaaaugaagaugaacauagaaaaggauuagacuacuuuaaaacagcaauacaagacgcagauauccuacaacgaauagaaaacgacacauuccucccuagacaacgaacgaagcgaaacggaguuuuaccauaccaguuacaccucgcagaacuugaacagaucaucaaaaagcaaucaaaauacuauccuuuucucgcaaacauauacacacaagacaauaaaacagaaaauaaacuaauaggucuauugaaauucagagugccguauuaugucggaccacucguggaggcagaaaaaguaacaggagauggcaaaaaucauuggcuuaucaaaaaggaacuacaagaaaauacccccauaacaccauucaauuuugaugauguuguagauaaagauaaaaguggagaacaauuuauaaaaagaauaacaggcacggauaguuaccuaauaggcgaaccgacccuaccagagaacagucuccucuaccaaaaauacaacguacuacaagaacuaaacaaugucagaaacgaaagacaccaacgacugccaauaaaaguaaaacaagacauauuugaacaugucuucaaaauagacaaaaacguaaacgcaaagaaaguaauggcauacuuaaaauuaaauggcuauggcgacuuccaaauugccggucuuucagacacucgaaccgggaaauuuaauuccaaccuaucguccuauaacuacuuuguugauuuauuaggaagagaaaagacagagaaaauaagagaagauagguuagaagaaauaaucgaaauacaaacaguuuucgaagacaaaauacuugucgccaaacgacuaagcaaccuagacuuccucacaccccaagagaaaagcaaacuuagcgcuaaacacuacaccgguugggguagacuaagccaaaaauuauuaaccacacaauucauaaaaacagcuuuaagcgaagcaggagacaucauuccacaaucacacuccauaauagacuuauuauauuacacagauaaaaauuuaauggaaauacuaaacgauaaaacauucaaugucagaaauugguuaaccgaacaaaacaaaggcacggaaucaggaaauagucuauacgaucagauagacgcauuagcuggacccaaagacauuaaaagaggaauaacgcaaguauuuuccauuauugaugacauaaagaaagcaauggguaguaauccagaaacuguauacuuggaauuugcuagagaaacacaaacaucacgcuuaacaaauagccgauuaaaccguguacaagaaauauacaauucaccagaacuaaaaacagaguucgcauaucuagcaaagaaauuagaagcugaaaccaaagaaagcauucaugaugaccgccuauauuuauauuauuuacaagaaggacgugacauguauaccggaaaagaaauaccuuucgaucaaaucucaucaaacuaugacauagaucacauaauaccccaggcauucacaaaagacgauucauuagacaaucgaguguuaguaaacagagcaaccaaugcccgaaaaagcaacucaccaacauucacaaaugauauaauagacaacaggaaaucuugguggcaaucacucguaaaaagggguuuaaugucgaaagagaaauuugaaagauuaacggauaaaagaaaaaccuucuccgaaaaccaaacaaaccacuucauugcaagacagcuaguggaaacucgccaaaucaucaaaaacguagcugaucuaaucaaaaauaauuacgauggaacacaagccguugcaauacgagcuucauuaacgggcgaaaugagacgauaucuagacuggccuaaaaaucgggacaugaaugacuaccaccaugcgcaugacgcacuuaugauggcaacaguugggaaauacguagauagacgcggauucuucgacaauggaucaguuucagacggagcaggcaaugcauauaaccucuacacuaaagauugguuaguagcagcgagaguaggcacaagaaacgauucucaacgaguaaauccauacggauuuauaguaggaucaaugaacucaaaagcaguaagacaacaagucaacaaagaaacuggagaaauaguaugggggaaugaaaaccuagauuacuuacgacacguauuaagcuacaagaaaauacucgucacucgacguuuaucaggaucuucgggacguuuauacgcagaaacacuauuuaguccaaacccaaaagcgaaacugauagcacaaaaagcaaacaggucaguagcucuuuacggaggauuuacuaaggcugaaagcgcauacacggcccuaguagaauuuaacaaaaagggagaccgaucauacaaacugaucaaaguaccaauggcaaucgcaaacagagugaaugacaaacaaaucacaguaacagcauauauugcaucacuuaacuuaagggacuucaguaggguaguacuagaacacuugccauuagguacacucauccgagaaucugacggaagcgaauuuuacgcagcaucauccgaauauaaacacaaugcaaaagagcuuugggcucccaaagaaauucuacguuccagcaagaaauuagacaaagccaccgcggacaauuuaaucgacauuuuugauuuucugacuaacgauaaaacaaucucaaauuuuaaauucuacgaaaaagaucuucuucaucucaaaaacguaagagauaaauucguagaggcuucagacgaaaucaaaauuaaaguacuaucagauguuauuuaugaauugcacaaugaugccggauggagagacccauucaaacacauacaagaaaaaccggccuggacuaugcuccaagucaaagguggaauaaaacuuucagaaaaagccgcaauagucuaccaaucacccacgggguuauucgaaacuauaacaauagugggggaauga

SEQ ID NO: 5366 - RNA, 4071 nt, Artificial Sequence
  Cas9 variant
augaaaaaauuugaagaauacuacauuggucuugacaugggaacaggaagcguagguugggcuguaacagacucagcuuacaacaucaucaaaagacacggaaaagcacuauggggaauucgucuauuugaaucugccaagacagcugaagaaagaagaauauuucgaacaagccguagaaggacagaaagacgaaaaaaccgcuuacauuuauugcaagaaauuuuugcagaagaaauuaguaagaaagacaugggcuuuuaucaaagaaugaaggaaaguaaauauuggcacgaggauaaaaaagacauaaauggaaacaugccugaacuuccauacgcccucuuugcagaugaugguuuuacagacaaagauuauuauaaaaaauauccaacaauuuuucaucucagauaugcucucgcaacaaacacaacagauaaaccugacaucagacucuuauaccuugccuuacaucauauaauaaagcacaggggucacuucuuauuugaaggaaaaaaauuaagcgaggugaaagaauuuucuacagcaauagaagcucuaguacaacaagcggaagaacaagaaauugaccuaaagagccuaacccaagaagaagugcuaacacaauuagaacauauaaugagugaugcucaauguacaaaaucagauaaaaaaacacagguaaguaaacuuauuguaggaacagauaaacagaaacaaaaacaagagaaagcaauagcugcauuaauuacaggcuguacaguaaaauuaucagauauauuugccgacccagaacuugauaaagaagaaaucucaaaaauauguuuuucagauaacggauacgaagaaaaggaaguugaaauagaaucaguacuagcagacagauuccuucuuauagcugccgccaagggagucuaugacuggacgguauuacaugacauucuaggggacgcucgauuuuugucagaagcaaaaguaaaaaccuaugaaaaacacagagaugaucuaagaaaagugaaacaacuacuaagaauggauaaagaaguguacgaggccguuuucgguguaucagaaaaaaaugaagcuaauuacagcgcauauauuggaauggcuaagaaaaauggcaaaaaacaaccuauagaaaaaaagugcagccaagaagauuuuuacaaauuccuuaaaaagcaauuagaccgucuaaguguugaugaaaugggacaggaaauaauugaugaacuuaaagcggaaauggauuuggguacgcuauuuccgaaacaaaugauacgcgauaacggaguaauaccuuaccaauuacaugaaaacgaacucaacgccauacuagacaaugcacagaaauucuauccauucuuguuagaaaaagaucaggauggguacacaccaguagaaaaaauacaaaaaaucuuuagguuuagaauaccuuauuacguaggaccacugaauacagcacaccaagauaaaggaggacacagcuggaguguucguaagaaagaaggcaaaauauacccuuggaauuuuagcgagaugaucgaugaagaagaaucagcaacaaaauucauugaaagaaugacuaauaaguguacauauuuaauaggagaagacgucuuaccaaaggaaucuuuauuguaugcaaaauucaauguacuaaacgaacuaaauaaucuaagaauagacggcgaauugaucgcuccugaauuaaaacaggacauuuauaacaauguauuuaaaaaauaccaaaggguaacgggcaaaaaaguaaaagacuacuuaagaauaaauggugucauaucaaaagaacaagagcuaagcggauuugaucaaaacuuuaaaucuaguuuaaaagcuuaucacgacuucaagcagauaguaggaacaggcguccucagcgaaucugaacaagaagauauuguacgcgacauaacccucuucgcagauagucaaaaaaugcuaaaacaacgaauucacagaaaguaccccauguuguccgacaaacaaauugcacaauuagcgaacaaaaaauacgcaggaugggggaggcucucucgaacauucuuagaaaauauagaaagcgugaacaaggaaacgggagaagucaugaauauuauuacagcguuaugggagacuaacgaaaacuuaaugaaauuacuuaguggaaaauaugauuauacuaaacaaaucgaacaauggaaugcgaggcaaaugaaaaaaggggaaauagaauaccaagauauagaagaguuauauguaucacccgcagucaaaagaccuauauggcaaacaauaaagauugugcgagaaauuacaaauauaaugggaggagcaccaaaacgaaucuucguugaaguggcuagagaaccaggagaaaaaggaguccguaaaguaaguagaagaaaccaacuucuagaucuauacaaagcaugcaaaaaagaagcacccgaauuguacgauagacuugccaauaaggaaucugauaaugcauuaagaucagauaaauuguuccuauauuauucucaaaugggaagguguauguacucaggugaugcuauagauuuggacgaacuguuuaccaaucgauaugauauugaccauauauacccacaaucuaaagugauggaugauaguauugauaauaggguacuaguaaaacgcgacuuaaauaguaaaaaaacagacaccuuccccgucucagaggaauacaggaaagcugguaaagcauuauggagcacucuacuaaaaaaaggucuaauuuccaaagagaaauauaaacgacuaacaagaaccgaaccuuucggugaagacgaacuagcagguuucauugcaagacaacucguagaaacacgucaauccacaaaagccgucgcacacuuacuagaagaagcauauccugaugcagaaauaguuuaugcuaaagcccgcgcaguuucagaauucagacauaaauuugauaugauaaaaguaagagagguaaacgauuuccaucaugcuaaggaugccuaccuuaacauaguuguaggaaacacauacuacguuaaguuuacgaaagaugcagccugguucguaagaaacaauccaggacgcacuuacaauuuaaaaaagauguucgagaacgaaaccgucaagcggggaaaugaaacugcauggauacccggagauaauggaacgaucuguacaguaaaaaaauggaugcgaaaaaauaauguauuauuuacucggagagcuuaugaagucaaaggaggucuauuugaccaaaacauccugaaaaagggaaaaggucaaauacccauuaaaggaggugcugaugaaagauuaagaagcagagacaaauacggagcuuacaauaaagccucaggcgcauauuucauguuagucgaaagcgacggcaaaaaaggugaacgaaaacgaacaauagaauucguccccguauaccuagcuaaaucccucgaagaauccguagaacuaagaagaagguacugugaagaagaacuaggacuaguaaauccggaugugcgucuaagcaaaauaaggaaaaaugcacucauagacguagacgguuucaaaaugcaccuagucgguaggacugaaaauagguuauuacuaauaggugcgacacaacuagugcucagcgaagaugaccaacaauuaaucaaaaaaauuggaaaauacugccuagaccaucgagagaacaaagaugcaguauuaagugaaaaauacgaacugacuauggaccucuucgaaaaacuuuaugauauauuuguauuuaaacuagaacaaacaguguaugcagucaaauugagcaaacaagccaaagacuuaaaagaaguaaaagaagaauucuuagcacuggaugaugaacaaaaaugcuuauuauugauggaaauacugcauuuauuucaauguucaccacaacuagcgaaucugacaaauauagguggagggaaaagcgcaggaucacuaaaaauccucuccgauauaacaaaacaacaaucaguacuuuuaauaaaccaaaguauaacaggauuuuaugaacaagucauagacuuaaaaacuauauga

SEQ ID NO: 5367 - RNA, 4071 nt, Artificial Sequence
  Cas9 variant
auggaagucggaaacuauuauuuaggaauugaugcaggaacagacaguguuggcugggccguuacagauaaucaauacaaugugauaagaaagaaagggaaaucacuaugggguauaagacuauuugauggcgcuaauacugcccaagaaagaagaacauuccgcgcacuacgacgacguaacgaacgaaagaaacaaagaauuaauuuauugcaagaacuauucuguaaagaaauaugcaaacuagaccccaauuucuuuauaaggcucagagacucaucccuaugguccgaagauaaagaagaaaaacaaauauauucccuauuuaacgauaaaaacuuuaaugaccgcaauuaucauaauaacuacaaaacuaucuaccaccuaagagcagaccuaauuaaaaacaaagaaaaacacgaugcacgcuuaguguacuuagcaauucaucauauaaugaaaaaccgcggucacuuuuuguuuaauggaaacaucgaauccgucaccucauuugaaaauacauucaacgaauuuaaaaacugucuacuugaugaacuugaaauaaacuuagaguguccaucaauaucugaguucgaaaacauccuaaaagauagaacauucaaaggcacucaaaaauguaagaaacuaaaagaacuuugcucgauuccaaguucagauaagaaauuagauaacaucuucaaauuaauuucaggacuaaaagcugauuuaucaauaaucuuugaagacgagucuuucaaagaaaacgaacauaacaaaauaucauucgcagacaguaacuaugaagaaaccagggaaguauuaaauagugaaauacaagagaaaacacugauaauagacauauuuaauaguauauacaacuggguaauauuaucugauauacuauccgguggugaauauaacgguggacuauacuuaagcauagcuaaaguaaauaccuacaauaaacacaguaaagaccucaaaauauugaaaagcguuaucaagaaauacuucccucaaaaauacacagacaucuucgccucaaauaaagaaaauaacuacuguagcuacauaggcauguacaaaucgggagguaagaaauauucagucaagaaaugcucagacaaaccagaagaguucuauaaaacuaucaaaaacauaauaaauaaaaauacagcagaagaaauaucaaaugacaaagauguacaauacauucugucagaaauagaaaacaacucauuucuaccuuuacaaauaaauaaaaacaacggagucauaccauaucaagcaaauaaaaucgaacuagaaagcauacucaaaaacgcagaaaacuaucuaccuuuccugaaagaaauugauaccgaauguaacaaaaccacaucagagaaaauaauagauuuauucgaguucaggauuccauauuacguaggaccccuuaacacuucaaaaggugaaaacgcauggaugauaagaaaagaagauggaacaauccgaccguggaacuucgaacaaaaaguagacauagacaaaacggccgcugaauuuauuacaagaaugacgaaccaaugcacauacuuaaauaaugaaacaguauuaccaaaauauucacucuuauauucugaauacacggucuuaaaugaaaucaauaacauccguauuaacggagagaaaauuucaguagaacuuaaacaagacauauucaacauauuguuuaaaaauaacaaacaaguaaccugcaagaaauugcugucacaucuaaauucaaacggguacaacuuaaagaaagaugaucucucgggguucgacgggaacuuuaaaucaucgcuaaguagcuacauagaucugaaaaacuauaucuucggagacaacauagacaaaccucaaauauacaaucucgccgagaaaaucauccucuggauaacauuauauggagaugacucaaaacuacuaaaacggguuuuacagaaaaauuguagcgaacaacuuaaccccgaacaaaucaagaaaauaaccaaauuaaaauucaaaggauggggaagauuaucaaaagcauuccuaagugaauuacgaggggcagauagagaaaccggagaaacaaugacuauaauaaaaggccucagaaacacucaaaacaaccuaaugcaacuucuaucacaaaacuacaccuucacagaagaaugcgagaaaauaaauucaggguacuucauuaauccaaacgaaaucucauacgauuccauaguuaaaaacauaguagcaagcccaucaauaaaacgaagugucuggcaaacaauacaaaucgucgaagaaauacaaaaaguaaugggaucaaaaccacgaaaaauauucguagaaauggcacgaggagaagaagaaaaaguccgaacaacgucaaggaaacaaaaacuacuugaccuauacaaaaauauaucugacgaaugcgccaaaggaauguacgacgaaauauauucaaaagacgaauccgacuucaaaaacauuagauuauaccuauacuauacacaaaugggauguuguauguauagcggaaaacauauugacuuaagucaauuauccaacacaaauauuugggaucgagaccauauauacccacagucaaaaacuaaagacgacagccuagauaaccuaguacucguauacaaaucgauaaauucugagaaaucagacgauauaauauccccuacaauccaaaauaacaugagaaccuuuuggaaacucuuauucgacagaaaauuuauaagcgaaaagaaauaccacagacuaacaagaacaacaccacuaaccgacgaagaauuagccggauucauaaaucgacagcuagucgaaacaagacaaucaacuaaaguaauggccaguauauuuaaaagaauuuacccuaacacagaaaucaucuauguuaaagccaaaaacgucucagacuuuagacaucgaaaagacugcgaaaacggcguuaaaguuagagaguuaaacgauuaccaucacgcaaaagacgcauacuuaaacauaguaguaggaaauguuuauagcaguaaauuuaccaauaacccgcuaauguggcucaaaaauaaucgaaacgucaaauauagccuaaacagaauguacgacuucaaccucacaguaaacaaugaaaacauauggguaguagguaacgagggcacccagaaaacgguaaauaaauaucuaggcaaaaacgauauacuauauacacguuaugcaaugaccaacaagggugaauuauucgaucaaaacccacucaaagcaaccggagacaaauccaaacaaaccaccuuaguaccucucaagaaaggcaaagaaguauggaaguacggagguuacaacucuauaaccccaagcuauuucaugcuuguagaaaguaaagacaagaaaggcaauuauaucagaaccauugaaaccaugccacucuacagagagaaagaguucagcaaaaacgaagaguuccuucuaaauuauugcaaagaaguacacaagcuaaaagagcccaaaaucauccucaaaugcauaaagaaaaaugcgcuacugauaguugauggauuuccaaugcaccugaaaggaucaacuggguuacaacuaaaacugcaaggcgccguacaacuaauccuugagucagauauggugauauaccucaagaaacuaaugaaguuugugaaugaaaauaacauaaacaaaaauaaacuagaaguaacaccauauauggaacuauccgcaaaagaaaacauuaaacuauacgacauauucauccaaaaacuaacuacaggcaucuauaguaaaagacccgccaacccaguagaaaaacuaauuaacgcacgagacauuuuuauagaauuaaccguaaaagaacaaugcaucguacuaagugaaauucuacaccuuuuccaaugcaaaccuuuaaccucagcaaacuuaguaucaauaaaccucaagaaaacagugggaauaauacaaauagccaaaaauaucacagccaaaaauguaaaacuugugcaccaaucaccaacaggaauauaugaauauacaguagacuuaaacaaaauuuga

SEQ ID NO: 5368 - RNA, 4071 nt, Artificial Sequence
  Cas9 variant
augacaaaaaaggaacaaccauacaacauaggacucgauauugggaccucuucaguagguugggcagucaccaacgacaacuaugaccuccucaauauaaaaaaaaaaaaucuauggggcguaagguuauucgaagaagcacaaaccgcuaaagaaaccagauuaaauagaagcacuagacgccgauaccgaagaagaaaaaacagaauuaauugguuaaaugaaauauuuucggaagaacuagcaaaaaccgauccuuccuuccucauuagacuacaaaacucauggguaaguaaaaaagauccagaucgaaaaagagacaaauauaaccuauucauagacggcccauauaccgauaaagaauacuaucgagaauuuccaaccaucuuccaccuacgaaaagaacuaauacuuaauaaagacaaagcugauauacgacucaucuaccuggcacuccacaacauacuaaaauacagaggaaacuuuacauacgagcaucaaaaauucaacauaucuaaucuaaacaauaaccuaucgaaagaauuaaucgaacuaaaccagcaauuaauuaaauacgauaucuccuucccggaugacugcgacuggaaccacauauccgacauauuaauaggacgcggcaaugccacccaaaaaucaucaaacaucuuaaaagauuucacacuggacaaagaaacaaaaaaauuacuaaaagaggugauaaacuuaauccuuggaaaugucgcacaucuaaacacaaucuuuaagacaucccuaacgaaagaugaagagaaacuuaacuuuuccggaaaagacaucgaaucaaaacucgacgaucuagacucaauccuagaugaugaucaauucacaguccuagaugcugccaaucguauauauucaacaaucacauuaaaugaaauucuaaacggggaaagcuauuucagcauggcuaagguuaaccaauacgaaaaccacgcaauugaccuaugcaaacuucgagauauguggcacacuacaaagaacgaagaagcaguagaacaaucaagacaagcauaugacgauuacauaaauaagcccaaauacgguacuaaggaauuguacacaagucuaaaaaaauuucuuaaaguggcuuugccaaccaauuuagcaaaagaagcggaagaaaaaauaagcaaagggacauacuuagucaaaccacguaauuccgaaaauggaguagugccauaucaacuuaacaaaauagaaauggaaaaaaucauugacaaucaaagccaauacuacccguuuuugaaagaaaauaaagaaaaacuucuaucaauucuaucauucagaauuccauacuacgucggaccacuacagucagccgaaaaaaaucccuucgccuggauggaacgaaaaucaaacggccaugcucggcccuggaacuuugacgaaauaguagacagagaaaaaucaucaaacaaauuuauccgaagaaugacaguaacagauucuuacuuagucggugaaccaguccuccccaaaaauucucuaaucuaucaacguuaugagguuuuaaacgaacucaacaacaucagaauaacagaaaaccuaaaaacaaacccuauagguucacgacuaacuguggaaacuaaacaaagaauuuacaaugaacucuucaaaaaauauaaaaaaguaacuguuaaaaagcuaacaaaaugguugaucgcacaaggcuacuacaaaaaccccauucucauaggacuaucccaaaaggacgaauucaauucgacacuuaccacauacuuagacaugaaaaaaauuuuuggcaguuccuucauggaagacaacaaaaacuacgaucaaaucgaagaacuaauugaauggcuaaccauauucgaagauaaacaaauacuaaacgaaaaacuacacucaaguaaauauuccuacacccccgaucaaauaaaaaaaauaucuaauaugagauacaaaggcugggguagauuauccaaaaaaauacuaauggacaucaccacugagacuaacacaccccaacuauuacagcuaaguaacuacucaauauuagacuuaaugugggccacgaauaacaacuucauuucuauaauguccaacgacaaauacgauuucaaaaacuauaucgagaaccacaaccucaauaaaaacgaagaccaaaacauaagcgacuuaguaaaugacauacauguauccccagcacugaaaagaggaauaacgcaaagcauaaaaauaguacaagaaauaguaaaauuuaugggccacgcacccaaacauaucuucauugaaguuaccagggaaacuaaaaaauccgaaauaacaaccuccagagaaaaaagaauaaaacgccugcaguccaagcuacugaacaaagccaacgacuucaagccacaacugagagaauauuuaguuccaaacaagaagauacaagaagaacuaaaaaaacauaaaaacgacuuaagcagcgaaagaauaaugcuguacuucuugcaaaacggaaagucucuuuauuccgaagaaucuuuaaauauaaacaaacucucugacuaucaagucgaccacauccugccacgaaccuauauuccagacgacucacuagaaaauaaagccuuaguauuagcaaaggaaaaccaacgaaaggcggacgaccuacuccuaaacucuaacgucauugacagaaaucucgaaagauggaccuacaugcuaaacaacaacaugauugggcuaaaaaaauuuaaaaaccuuacuaggcgaguaaucacugacaaagauaaacuaggauucauccaucgucagcugguacaaacgucccaaauggucaaaggaguagcuaauauucucgacaauauguacaagaaccaaggaaccacuugcauucaagcccgugcuaaccuaagcacugccuuuagaaaagcccuauccggacaagacgacaccuaccacuucaaacacccagaauuagucaaaaacagaaauguuaacgacuuucaucacgcccaagaugcauaucuagcaucauuccuaggaacauacagauuaagaagauuuccaacgaaugaaauguugcucaugaacggcgaauacaacaaauucuacggacaggugaaagagcuuuauuccaaaaaaaaaaaacucccugauucucgaaaaaacggauuuauaauauccccgcuaguaaacggcacgacccaauacgaccguaacacuggcgaaaucauauggaauguaggauucagagacaaaauucuaaagauauucaacuaucaucaauguaaugugacacguaaaacagaaauaaaaaccggccaauuuuacgaucaaacaauuuacucucccaaaaacccaaaauacaaaaaacuuaucgcacaaaagaaagacauggauccaaacauauacgguggauucuccggagauaacaaauccaguauaaccaucguaaaaauagauaacaauaaaaucaaaccaguugcaauaccaauaagacuaauaaaugaccugaaagacaaaaaaacacuacaaaacuggcuagaggaaaacguaaaacacaaaaaaaguauucaaaucauaaaaaacaauguaccaauaggacaaauaaucuacucaaaaaaaguugggcuacugucucucaauucagaccgagagguagcaaacagacaacaacugauacuaccuccagagcauuccgcucuauuacgacuauugcaaauucccgacgaagaccucgaccaaauacucgccuucuacgauaaaaauauucucguagaaauccuacaagaacuaauaacaaaaaugaaaaaauucuaccccuucuacaaaggcgaacgagaauuccuuauagccaacaucgaaaauuucaaucaagcaacuacuucagaaaagguuaacucauuagaagaacucauaacccucuuacacgcuaauagcaccucggcacaucuaauauucaacaauauugaaaaaaaagcuuucggaagaaaaacacauggauuaacccuaaauaauacagacuuuaucuaccaaucaguaacaggucucuacgaaacucggauccauauagaauga

SEQ ID NO: 5369 - RNA, 4071 nt, Artificial Sequence
  Cas9 variant
augacaaaaaaagaacagccauacaauaucggccuagacaucgguacuggaucaguaggaugggccguaacaaaugauaauuaugaucuauuaaauaucaaaaaaaaaaauuuauggggaguacgauuauucgaaggcgcacaaaccgcaaaagaaaccagacuaaacagaucaacuagaagacgcuaucgaagacguaaaaacagaaucaacuggcuaaaugaaauuuuuucagaggaacuagccaauacagacccaagcuucuuaauucgucugcaaaacaguugggucuccaaaaaagacccagacagaaaaagagacaaauacaaccuauuuauugacaauccuuauacagauaaagaauauuauagagaauuuccaacaauauuccaccuaaggaaagaacucauaauaaauaagaauaaagcagauauaagacucgucuaucuagcacuccacaacauccuuaaauacagagguaauuuuacguacgaacaucaaaaauuuaauaucucgacucuaaauucaaaucuauccaaagagcucauagaacuaaaucaacaacuaauaaaguacgacaucagcuucccagacaauugcgacuggaaccauauaucagacauacucauuggaagagguaaugcaacacaaaaauccaguaacaucuuaaauaacuucacucuagacaaagaaacuaaaaaauuacuaaaagaaguuauaaaucuaauacucggaaauguagcacacuuaaacacaaucuuuaaaacaagucugacuaaggacgaagaaaaauuaucauuuuccgguaaagacaucgaaucaaaauuagaugacuuagacucaauacuggacgacgaucaauuuaccguacuagauacugcaaaucgaauauacucaacaauaacauugaaugaaaucuugaacggagagucauauuucuccauggcuaaagucaaucaauacgaaaaccaugcaauagaccuauguaaauuacgcgauauguggcacacaacaaaaaaugaaaaggcaguagguuuaucaagacaagcuuacgacgacuauauaaauaaaccgaaauauggaacaaaagaacuauauacaucccucaaaaaauuucuuaagguugcacuccccacaaaccucgcaaaagaagcagaagaaaaaauuucaaaagguacauauuuaguuaaaccacgaaacuccgaaaauggcguugucccauaccaauuaaauaaaauugaaauggaaaaaauaauagauaaccaaucucaauauuaucccuuccuaaaagaaaauaaagaaaaacucuuaucaauacuuuccuucagaauuccauacuauguaggaccacuccaaaguucagaaaaaaacccauuugcuuggauggaacguaagucaaauggucaugcucgucccuggaacuucgacgaaaucguagaccgagaaaaaagcucuaauaaauucauacgccgaaugacuguaacugauaguuaucuugucggggaacccguacucccuaaaaacucguuaaucuaccaaagauaugaaguacuaaacgaacuaaacaauauacgaaucacagaaaacuuaaaaacaaauccaacugguaguaggcuaaccgucgaaacaaaacagcauauauacaaugaacuauuuaaaaacuacaagaaaaucacagugaaaaaacuuacaaaauggcuaauagcccaaggauauuacaaaaauccgauucuaauagguuuaagccaaaaagaugaauucaauucuacucuaacgaccuacuuagacaugaaaaagaucuucggaaguucuuucauggaaaacaacaagaauuacaaccaaauagaagaacucauagaauggcuuacaauauucgaagacaaacaaauacuuaacgaaaaacuucacucaucaaauuauucauacaccucagaccaaauaaaaaagauaagcaauaugagauacaaaggguggggaagacuaucaaaaaaaauauuaaccuguaucaccacagaaacaaacacacccaaaucccuacaacuaucaaacuacucaguucuggaccugauguggacaacuaacaacaacuucauaucaaucaucucaaacgacaaauaugauuucaaaaauuauauugaaaaucauaaccuaaauaaaaaugaagaccagaauauuagcaauuuaguaaaugacauccaugucucuccagccuuaaaacgaggaaucacacaaucaauaaaaaucguucaagaaauaguaaaauuuaugggucacgcaccaaaauauauauuuauagaagucaccagagaaacaaaaaaauccgaaaucaccacuucaagagggaaaagaauccaaagacuacaauccaaauuacucaauaaggcaaacgguuuuaaaccucaacuuagaaaauacuuaguacccaaugagaaaauucaagaagaacuaaagaagcauaaaaacgaccucagcucagaacguauaauguuauacuuccuacaaaauggaaaaucccucuacucagaagagagucuuaacauaaauaaacuaucggacuaucaaguagaucacauccuaccacgaacauacauaccugacgacagccuggaaaacaaggcuuuaguuuuagccaaggaaaaucaacgcaaagcagacgaucuccugcucaacucaaauguaauagauaaaaaucuugaacguuggacuuauaugcuaaacaacaacaugaugggucucaaaaaauucaaaaaccucacucgaagaguaauaacagacaaagauaaauuaggauucauacaucgccaacucguacaaaccucucaaaugguuaaaggagucgccaacaucuuaaacucaauguacaaaaaccaaggaacaaccugcauacaagccagagcuaaucucucaacagcuuuccgaaaagcacucagugaucaagacgacagauaucauuucaaacauccugagcuaguaaaaaaucgaaauauaaaugauuuccaucacgcccaagacgccuaucuagcaucauuccuaggaacuuaucgauuacgucgcuucccaacagacgaaauguuacucaugaacggcgaauacaacaaauuuuauggccaaguaaaagaacucuacuccaaaaaaaaaaagcuaccggacucacgcaaaaacggcuucauaauaaguccacuaguuaauggaacuacccaauaugauagaaauaccggggagauuaucuggaauguaggauuucgcgacaagauacuaaaaauauucaacuaccaucaaugcaacgucacacguaagaccgaaauaaaaacagggcaauucuacgaucaaacaauuuauucaccgaaaaaucccaaguauaaaaaacugauugcacaaaaaaaagacauggacccuaacauauacggaggauuuucgggugacaacaaguccaguaucaccauaguaaagauagacaauaacaaaauaaaacccguagcaauuccaauaagacuaauuaaugaccuaaaggauaaaaagaccuuacaaaauuggcuugaagagaacguuaaacacaaaaaaagcauccaaauaaucaaaaacaacgucccaauaggacaaauaaucuauucaaagaaaguaggacuuuuaucucuaaacucagaccgcgaaauagcuaaccgacaacaacuaauauuacccccggaacacucagcacugcuacgcaucuuacaaauuccugacgaagacccugaccagauacuagcuuucuaugacaaaaacauacuaguugagauacuacaagaauuaaucacaaaaaugaaaaaguucuauccauucuacaaaaaugaacaagaauuucuagcauccaacauugaaaacuuuaaccaagcaaccacaucagaaaaaauaaacucacuagaagaauuaauaacauuacuucacgcgaauucuacuucagcacaccucaucuucaauaacauagaaaaaaaggcauucgggagaaaaacacacggauuaacauugaaugauacugacuuuaucuaccaaucuguaaccggccuauaugaaaccagaauucauauagaauga

SEQ ID NO: 5370 - RNA, 4071 nt, Artificial Sequence
  Cas9 variant
augagcaagaaagacagcgaauacuacauaggauuagacauaggaacaaacucagucggcugggcuguuacaaauggcaaauacgaccuacuuaauaucaaaaagaaaaaucucuggggcguucgucuauucgaagccgcagaaagugcugccggccgccggauaaaucgcucaacacgaagacgcuaccgcagacgccgaaauagaauuaauugguuaaacgaaaucuucgcagacgaacuaaguaaaguggauccuucuuuccuuacgcgccucaacucaucauggauaaguaaaaaggauuccuccagaacgcgugauaaauauaaucuauuuauggaugccgacuacacagacaaaaauuaccaccacaaauacccuacaauauaccaccuucgccgggaucucauguucgacgacaaacaauucgacauaagacucgucuaccuagcccuccacaauauaauaaaauacagagguaacuuuacauacgaucaucgaaaauucaauguaucagaaaugucaaguaaucuuacaaaagcccucgaaaacuuuaaucaagaauuaauggaguucgaagacgcauucccagacaauacugacuacucagcuauuucagaagucuugcuaaaauccaauaacguaucaacaaaaauagacgaaauaaucucuaauuuagaacuugauaaagauaccaagaaauaccuuaaagaagugcugaaauuaauacuaggaaauagcgcuaaucucaauacuauauuccacacuucucucgauaaagaugacgaaaaacuuuccuuaagcgcaaaagacaucgaauugaaacucaacaauuuagacucauuauuaucagacgaacaaauacacuucauaucaucagcuaaugaacuauacucaucaaucacucucaacgacauacuagacgggaaaacguaccuaucucuggcaaaaauuaaacaauacgacacccauugcucagaucuccaagaacuuaaagaaaugugguauaaaacaacaaacccagaccucauaaagaaaucuagaaaagccuacaaagaauacguacauggaucauauaauacagaagauuucuauaaagcaauauccccuuuucucaaaauagccauaccugaagaccucgccaaagacgcacugaagaaaauagacgccaauaccuaucuuccaaaacaacgcacuucaaauaauggagucauacccuuccaauuaaaucuuauagaacuagagaaaauaauagauaaucaaucuaaauauuaucccuuuuuaaaagaaaaucgggagaaaauaaucaguauacucuccuuucgcauaccauacuacguaggacccauccaagcaccaaccgauaaaaacuucucuuggaugguaaagaaaauccaagccaaagcucgccccuggaauuuugacgaaguaauagaucgagaaaaaucuaguaacaacuuuauaaaacgaaugaccacgaccgauacauaccuaguaggcgaaccaguacuaccgaaaaacuccuuaauauaccaaaaauucgaaguacuaaacgaacuaaacaacauaagaauaucuaaaaaccuuagucaagauccacuuggaaguaaacucucuguagaagugaaacaacaaauauucgaagaauuauuuaaacguuacaaaacaguaaaaucugaccaacuaaagaaauggcugauaagaaacucuuacuuuacagaucccacaauuauaggccucucuaaacccucagaauuuaacuccucacuauccacuuucauagauaugaaagcaauauucggaauggauuucgucaacaacccacgcaacagcagucaacucgaagaacuagcagaaugguuaacaguuuuugaagacaaacaaauccuaucagagaaaauaagacauucaaacuauccauauagcgaccaacaaaucagaaaaauaagcaacaugagauacagaggcuggggacguauaagcaagaaacuacugugugacaucaaagucgaaaguacgauauauaaaucacaucaacuucaucccuauucaauccuagaccuaauguggucaacaaauaacaacuuuuacuccauacuucauaaagacaaauacaacuuugaaucaauccuugaagauuauaaucuagggacagacgauaaaacagauauaaacgaguuaguagacaacauacacacaucaccagcacuaaaacggggcaucauccaaaguauaaacauaguaaaagagcuagucaaauucaugggacacgccccucaacauauuuuucuggaguucacaagagaagacaaaacuucaacacuaucagaaaguaggaagaaacgacucaagaaacucuacaacaaucugucugaagacacuaagaaauuuaaacuagaccuaagagauuaccucguaccugauaaaucaauucaaaaagaguuagaaucacaugauaaagaccuaucaaaagaaagacucaugcucuacuuuuuacaaaaugguaaaucauuauauuccgacgaagcauuagauaucaauaggcuuucggaauaccaaguagaccauauucucccgcgcacuuacauaaaagaugacucacuagaaaacaaagccuuaguacuagccaaagaaaaucaacggaaagcagacgaccuauuauuacaacccucaauaauaaacaaaaacauggaaagauggauauauaugaaagaucauggaaugaucucaccaaagaaauuuaaaaaccuaacacgcacuacuauaacagaagacgacaaaguacauuuuauuaaccgacagcuaguacaaacaucgcaaauaaucaaaaacguagccaauauacuagacaacauguacaaagaacaagguacaaccugcgucgaaaccaaagcaaaccuuucaucggccuuuagaacagccuuuagcgaacaagacgacaaauaccacuuuaaacacccugaauuuauuaaaaacagagaugugaaugacuuccaccacgcucaagaugcauaccuggcaugucuauuagguuuauacagaauccaacgcuucccaucagacgaaaugcuacugauaaagaaagaauauagaaaauuuuucgcacaagcacaaaacucaguaaagaaccacggaaagauuccagacucucaaaagaauggauucauacucgcaccccuaguaaauggugaaacgcugauaaacaauaaaacaauggaaaccauauggaauauggacuauaaacguaaagucauaaaaauuuuuaauuauaaacaauauaacaucaccaaaagaacagaaaucaaaacaggagaguucuacaaacaaaccuuauacagcccccacgaugaaaauguuaaaaauccuauuccacaaaagaaaaaucuagaccccaaaaucuacggagguuacagcggcguacaaucaaguuaucuggccauaaucaaagucgaccaaaagaaacccacuaugguuucagucccuauacgauucucgaaaaugaucgacgauggaaaacuaucccuccaaucaugguuagaaaauaacauaaaacacaagaaaacaauagaaguacucaaaaccaaaauccccauuggucaauuaacauacaacccgaaaaacgguuaucuuucaguacaaucugaaaaagagaucgcuaaugcgcaacaacucuuccuaccuuucgaacacguugcucuccuaaccuuacuccaugcgccaacuucugaauacgaccaaauucuauccuuuuaugacacagauauccuccuugaaauauuugaugaaauuacaaauaaaauaaaaacauucuuccccuuuuauauagaugagcaagaauacuuagucucaauucgggaaaacuuccaauccgccaccguuauagaaaaagucaacgucuuacaacaauuacuaauaauguuacaugcuaauucuucaagaauaucgauaaaacucggagaaguuagcaaaaaggaucucggaagaaagaagaaacgaauaccacuugaaaacacugaucuagucuaucaaucagucacuggacuauaucaaacaaaauuucacauugauuga

SEQ ID NO: 5371 - RNA, 4074 nt, Artificial Sequence
  Cas9 variant
augaacgaccgcaacaaaaaauacaauaucggacucgacauaggaacuggcuccguagguugggcuguaacggauaacaacuacaauuugcugcacgcaaaaaagaagaaccuuuggggcauucgauuauucgauggagcagaaaccgcagcauccagacgaacguuccguuccacacgccgccguuacagaagaagaagaaauagaaucaauugguuaaacgaaauuuuugccgaugaauuagccaagaaagaccaaucauucuuaguaagaaugaacucaagcuggguaucaaaaaaagacaaaauucgacaaagagaccaauacaauuuauuuauggacucagacuacacagacgucgaauaucaccgugaauucccaaccauauuucaccuaagaaaacgucuaauugaagauaaaucccaagcagacauucgucuugucuaucuagcacuccacaacauaauaaaauaucguggaaauuucacuuacgaacaccagaacuuugacguaucacacauggacagcggccucgcacuacuccuaaaucaacucaaccaacaauuacaggcauuugaaguugcguuuccugacgaaaccaauuuugaaucaaugucuacaauccuacuagaaaaaaagaccccaacccaaaaaauagaugagaucgucgaucaaauucaaccagagaaagacuuacuacaaauuacuaaaaacauaaugaaaauguuacuaggaaauaaagcagaucuuguaaaaaucuuuucucucgauagcgaugauaaaauaacuguagaauucucuagcaacucaauugagcaagaucuaagcaaccucgaagaaacacuaucugacgaacaauuuaauauaaucacucuagcaaauucuaucuauagcucaauaguacuaaacgauauucuaucuggcgaaacauaccucucguuugcaaaagcuagacaauacucagaccacaaaaaagauuuagccaaacuaaagacuauguggagagaaagcccggauagaaaagcaguuggcaaagcgaaaaaagcguacgaugacuauuuacacucgggaaaauauggaaucgaagacuucuauaaagacaugucuaaauuucuagaaacagcaacaccagucgaauuagcaaaagaggcaaaugaaaaaauacuaaacaaaucauauuugcuaaaacaacgaaacaacgaaaacggagugaucccauuucaauuaaauaaaaaugagaugauugaaauuaucaauaaccaagcaaaauacuaucccuuccucgccgaaaauaaggacaaauuacugucuauauuaucguucagaaucccauauuaugucggaccccuccaaucaaaaaaagacaacccauucgcauggauggaaaaaaaaucucaaggaaaaauccgaccauggaacuucgaugaaauuguagauagagaagcaucauccaauaauuuuauuagacgaaugacaucaacagauacauaucuaaucggagaacccgucuuaccucuaaaaagcccaauauaccaaaaauacgaaguucuaaacgaauuauccaacguacggauaaacgcagaugaaguagacaauccucuaggagacaaacuauccguagauuuaaaacaagccauauauaacgaacuauuucuaaaacauagaaguguaagcaaagcucuacuuaccaaauggcucaucaaccaauccuacuuccaaaauccgcaaauaucuggauuagcagacagcaaaaaauucaauucaggacuaaccacuuaccacgauuucaaaaagauauucggagaagacuucgucaacgaccccacaaaccaaagccaacucgaacaacuugccgaauggcuaacaauauuugaagacaaaaaaaucuuaaaaauaaaacuagacgauagccaauucaauugcacacccgaacaaauaaaaaaaauugcagguaugagauaccaaggauggggucgcuuaucaaaaaaacuccucugcgauauaaaaaccacaacagugaccuccaaaaaucaucaacaagcuucuuacucaauauuagaucuaauguggaacaccaaucgaaauuucauauccguccucaagaacgauacauauaaauuugaagauaaaauacaaacuuucaaccuggacaaaaaugaagcggccacaccacaagcuaugauagaugaauuacaaacaagcccagcgcuaaaaaggggaaucagacaaagcguaacuauaauacaagaacuugucaaauuuaugggacacgcaccagaacacauauuucucgaauucacuagagaagacgacguaaguucauuaaccaaaagccgagacucccgauuaaauaaauuauaugcacgaauagcuaaaaacacgaaaaaaacugacgacgagcugaaaaagucauuacuaccuucauccgacauuaaagccacauuaaaagcaaacaaaaacaaucuuucaaaugacagacuaauguuauacuauuuacaaaugggcaaaucacuauacagcaaccaaccuuuagacaucaaccgucucagugaauaccaaaucgaucauauacuuccccaaucauauauaaaagacaacucauuagagaauagagcacuuguacucgcaucugaaaaucaacacaagucaagugaccuacuacuuaaaccagaaauaauaaaccaaaacauugcucgauggcguuacaugaaggacgccggccuaaugggaccuaaaaaauucaaaaauuuaacaaggauacaaauuacagauucagaccaaaauaauuuuaucaacagacaauuagugcaaacuucacaaauaauaaaacauguauccaacauauuagauucuauguacggagaccaaggaacucaaugcguagaaacuagagcccaucuaucaacagaauuuagaaaagccuuuuccaaugaagacgauaacuaucacuuccaacaucccgaauucguaaaaaacagaaacauaaacgacuaccaccacgcucaagaugcauaccuagcaugucuauugggacucuaccaaaugaaaaaauauccgaccgacaacaugauucuguuaaaaaaagaauacaagagauuuuuuaguaauacaaaaaaaauauacgacaaaaagcaucauuuccccgacuauguaaaaaauggauggaucauuggcucuauguucaacggagaaaaguacgucgacgaagagacaggacaaaucaucugggaccaacaaaccaaagacaugguaucuuguauuuuucaauauaaacaauacaacgucacaaaacgcacagaagcugcaaacggagaauucuacaaucaaacuguauauaaaaaagaccccaacgaaaaaagaaagcucauaagccuuaaacaaggccucgauacaaaauuauacggaggcuauaguggugacaacccggcauacaucguacuugucaaaaucgaugacaaaaaaaacaaauuaguaaaaaugccaauucgacuagcggaacaaguugacaacaaaacaauagacuuacaaacuuggcuugaagagaaugucccucauaaaaaaggaauacaaguacuuaagaccaaaauuccccuaggacaagucauauauaguaaaaaaaacggauaccucgcacuaaaauccgauacagagauagucaacgcacaacaacuaguucucccauacggcuacguugcccucuuaacccuguuacaaaaaaugccagaaaacaaguacgacgagguguuagccuguuaugaugacggaauccuggacaacaucuuuguagcaauuauugacaaaaugaaacauuuuuauccuuauuacagcggcgaacuaaaaacacuaagcgauaauauagauaauuucaaagaaucaccugacguaaacaagauaaaaacacuccaacaacuacuucuacuccuccacgccaguucaacaacagcgucgaucgaauuuaacaauguuaaaaaaaacuccuuagguagaaaaccuaauucaauaaauauacaaaauacagaucuacuaagcuuuucagcuaccggauuauacgaaucucgcauccacaucgacuga

SEQ ID NO: 5372 - RNA, 4074 nt, Artificial Sequence
  Cas9 variant
auggcagcuaaaaauuauaauauuggccucgacauaggaacuagcucuauaggcugggcaaucguugacgauaauuaccaauuaaugcaugcuaaaggaaaauacggauacggaacuagaauuuauucagaaggucaaacagcugcagacagaaggggauucagaacaacuaggaggcgacuuaaucgcagaaaauggcgacugagacuacuccaagauuucuuugaaccauacauucucccacaagaugaagcauucuuuauccggcaaaaacaaucuaauuuaguaccacaagacacuaaaaaacaauacccagaaucaguccuauucgaugacacuucggauaaggauuuuuauacugaguacccaacaaucuaccaccugaggcaagcccuuaugaccgaaaaucgccaauucgacauucgagaagucuaucucgcaauacaccacauuguuaaguacagaggacauuuccuaaauaaugccccagucaaaaccuuuaaaucuggaaaccuugacuuagccauaaaauuuaacgaacuaaacgaagaauucaaaucuguuuauccugaucuagaguuacaauuuaacuuagaccaaauagaugaaauaaaaaaaauacuucuggauaguacaaaaaguagauuugacagacaaggcgaagcaguaaaauuaauauauacaguuagcgaaguaaaaacaauagaaaaauuacaaaauaaaauaguaaaacaauuucuuuccggaauuuuaggcuuaaacacaagauucgacguauuaacgaacaccgagagugaugauucaauguggaaauucucauuagacucagaauccucagacgaugcacuagacgaaauaauugcccaacuugaugaccccgccauacauguaguagaacucguaaacgaaauacauaguucuauuacccuagcagguauaguuccagagggucaaggucuaucagagagcaugguagaaaaauacgaagcacacaaagcucaccuccaauuacuaaaagcagucgaaaaauuaguagacaaaaaagccgcugacaaacuggaaguugcauacgaccaguauauaaacggaaaggacucaaaacaauucauuaaagaagacuucuacaaagcaguacaaucagaaauuaaagggguugcaggagaugaaguugcugagauaaaucaacuuauagaguuagaccaauucaugccaaaacaacgaacaaaagaaaacggagcaauuccccaccagcuucaccaacaugagcucgacguaauaauagaaaaccaaaguaaauacuacgauuggcuuggcgaaaaaguaggaaacgaauacaaacuagacaaacucguaucauuccgaguuccuuauuacguaggaccccuaguggacacagcaaguaaggaaaaaaaagacgaaacaagauucgccuggaugguuagaaaaaacccagaaaguacagaagcaauaacucccuggaacuuugaggauauuguugacaaaaacgcaucagcugaaaacuucauuaagaggaugaccacuaaagauaaauaccuuuuaaaugaagauguauuaccaaaaugcucauuacuaacccaagacuucgaagucuauaaugaacugaauaauauccgugugaacggagaaaaguuuaccgccgaacaaaagcagcuaauccaugacgaacuauuuacaaaacacgcaucuguaucaaucaaacaauuaaaagauuuccuaguaucggaacuaauguauguccgcgauaauuuaaaaguugaagguuuagcagaugaaaaaaaguuaaugagcagccuaucaacacaauuugacuaucagaaaauaauccccgaccaaauuaacgacguaaaauaccgcgaagauauagaacaaauaauagaauggagcacuauuuuugaagacgcagccauauuuaaaacuaaauuaaaagaaauagacuggcuaaccgaugaacaacgaaacaaacuagcaaauaagagauaccguggcuggggaagccuaucaaaaagacuauuagccugucuuguagacgaaaacgggcaacgaauaauagauauuuuacgagauucaagugauaacuucaugaugauaguaaacagaccugaauuuaaacaagcaaucuuugacgaaaacgcuaauuuaacugaaacuaauucaaaaaaagacauguucgaaaugauagauaauuucuauacgucgccacaaaacaaaaaagcaauuaggcaaguacuguuagucguacaagauauccaaaaugcgaugggcgguguagccccacaaaaaaucuucaucgaauucgcuagggaggaugaaguaaacggcagaagaacaaacucaagauauucucaaauaagagaaauguauagcaaaguaacagaugauguuauaaauaaaacaguccguggagaauuagaagcaaacaaaggaucacuuaauaaagaaaagcuauucuuauauuuuuugcaaggaggcauagaucuauacucaggaaagacaauaaacauagauaauauaaguaguuacgaugucgaucacgucuugccacaaaguuuuauaaaagaugauagcauaaauaauaaggugcuaguaaaugcaaaagguaauagagucaaaaacgacaauguacccauggaauuauuuggcgcaaagauguauccgaccuggaaaaggaugguagauacaggaauaauguccaaggccaaauucaaaaaccuuacuuuaaaccccgauaacguggauaaguuuaaagcagagggguuuaucaaccgacaauuaguagagacaaggcaaaucaucaaauuagucgcacaaauacuaaaugauaaauuaggagaugauacaaaaauagucucagugaaagccaaccuaacacacgauaugcggguauucuuugauuucccaaagaauagaaaugucaauaauuaccaucacgcauuugacgccuauuuauccgcauucguagggacuuaucuauauaaacgcuauccuaaauuacaaccauacuuuguauauggagaguucaaaaaaauggacaaauuaaaaaacaugacaaguuucgacuucuuaagagacuuaaaacacacagacaaaguuguagacaaagacacaggagaaauaaucgccgacaaacuagcgguaaucacaaauaugaauaagauauaugacuuuaagaaaguauuaguaacccacgaaguccacgaaaauucaggagccauguacgaucaaacacuauacccagcuaaguuggauaaaagucuagguagaaaaggagccaaacaacuaauaccaaaaaaagacgacaugccaacggcucucuauggaggauacacaggaaguaaggacgcauuuaugaguaucguaagacuaaaaaagaaagacgaaguauauuauaaaguaauaggaauaccaguaagaauagcagauagcguacaacacgguaaagaagucgacgucgaagcauuaacucaauuuaucgagacgaaauuuaccaaagaaaacuuaaacaaaaaaacaggagaaauuaccagaaaaguagaaugguucgaauuaguauuaccaaaaguacuauuuggucaagccguauuugacggaggacaaccauucaugcuaggaagcucaacguacccgcacaauuuacgagaacugguuuuaaccaaagauucaguaaaaaaaaucgcaggcaaggaaaguaacaagucauaucuggacgccuacgacgaaauaauggaagccaugaauaaauacuuuccccucuaugauacaaauaaauuuagagaaaaagucauagaaggucgaucuaaauuuauagaucuaccagauaaggaugaauaugaaaauaacaaacuuguacaaguaggaaaaucaacuauaauagacagaauguuuauaggacuacaugcaaacgcggcuagaacagauuuaaaaaauauaggcaucacuacuccauucggauucaugcaacaagcaagugguauuaaacucacuaaagacacaguugucuuauuccaaucaucuacaggacuguucgaaagaaaaguagcauuaaaggaucuauga

SEQ ID NO: 5373 - RNA, 4077 nt, Artificial Sequence
  Cas9 variant
augaaagagccuuacggaguagguuuagacauagguacaaauucugugggauggacuguaguugaugcgaguggucaugucagaaaaaucaaaggacaaacaggaauuggaguaagguuguuuaaagaaggggcagcggccgcugauagacgcgguuucagaaccacaagaagacgucucaaaagaguuaaauggagacuaagacuacuaagagaauuuuucgaucagccaauaucaaaaguagacauaaauuucuuugcaaggagaaaauacucagacgugucgccacgagauccuaauuauaauggccuugagaaaaccuuauuuaaugauagaucagaucaagauuucuaccaugauuauccaacuauauaccaucuacgagaagcccuaaugacacaacauagaaaauuugacguaagagaaaucuaccucgccauacaucacauagucaaauaccgaggaaauuucuuaaggaaugacgcagccacagcuuacagaucagguacauuagaucuacaacaacauuucgaaaccuuaaaucaucuguucucucaagccgauuuagaacuaaaccucaaccuuacuacagacgucgcauugcucgacucaauaaaacagacuuuaguuagaacagacauaucgagaagugauagacaaaaacuaaucaugccacuauuagcaguccuaacuggugcaacaaccgcugaaaagaagcgccaaaaagcaguaguaaccgaguucgcuaaagcccuagucggaaacaaaacaaaaauagacguucuaacccuaacagauauagaugcaacagaagccaaagacugggcuuucucccuagaagaaaaucaagauaaguuaccaggaaucgaggaccgguucucagaaguaggccaacaaauuauagacgaagugauaagauuauacgccucggucaaucuagcucaauuaauuccugagggaaaacgauucucacaaucuaugguagaaaaauauaaaagacacggagaagaccuuaaauuacuaaaagccuacauaagaucccaaagcgaugcuaaacgaggacgcgcgauacgcgcaacauaugaccaauauauagacggcguaaaauccaagcaaguaacacaagaagcauuucaaaaagcccuuggcaaauuuguugacgcagauguugaucuaaacucaugggcagcacaaaucaaacaagcuauagauucagaacaauuuaugccaaaauuacgaacaaaacagaacggcgcgauacccuaucaaguccaacaaaaugaguuagaucaaauuauuaguaaccaaaaagaauauuauccaugguuaggugaagaaaacccaguaauuaaacgaagaggaaaauucccauauaaacucgaugaacuguucggauucaggguccccuauuacguaggaccauuaauaaccaaggagaugcaagcagcaacugcuaacgcggguuuugcuuggaugguacgaaaggcagacgguccgauaacuccuuggaacuucgacgacaaaguagauagaguagcuucggcaaccgcauuuauacaaagaaugcaaacgacagacacguaccuaauaggcgaagaaguguuaccagcaagaagucuuauauaucaaagauuuaugguuuuaaaugaauuaaauaauaucagaguagaugauggccaauuaacacccagacaaaaacaacgacuauacaaucaaguauuuaagaaacacaaaagaguuacagcuaaaaauauacaagauaauuuaguugcggcaagagaguucccaacagcuccaagaauuacuggguuagccgaucccaaagucuucaacaguucacuaucaacuuaucacgacuuaaaacaaguucuccccgaagcaaugucagacguaaggaaacaagcagauauagagaaaaucauacucuggucaacaauuuucgaagauuccacaauauuuaaacaaaaauuaacugaaauaucauggcuaacagcugcucaacuuaaacaauuaggccaacuaagauauagaggauggggucaacuauuaagaaaacuacuaacuggucucaaggaugauaauaauagaaguaucauggacggacuaugggaaacaaaugcaaauuucaugcaacuaagaagucaaccugcgaucgagaaccagauuaaaucugcaaaucaagcgaaucuaacuacggcagaccuccaagauacuauaaacgaauuauacaccucaccacaaaauaagaaagcaauaagagaggucauggucguccuggcugauauuaaagaugccaugcaugggcaaacuccaaacuggauuuucguagaagcugcccgcgguggcggcguugcaggaagacgaacacagagccgaucaaaacaaaucgucgcagcauaucaagggacagcacaggcaauuguucgugaucaaguacaacgggaacuaaaagaaaagaucaaaaauaaagccaauuuuaacacucgauuaguacuauacuuuuuacaaaacggaagagauuuauauacaggugacgcuaucaacauagauagacucuccgaauacgauauagaccauauuuuaccacagagcuuaguuaaagaugacagccuagauaacagagucuuaacuaaugcaagaauaaaccgugagaaaaacgauacauuugcuuccgaaaaauuugguaagaaaaugggugcgaaauggaaagaaaugcauaggaugggcuuaaugacaaaaagaaaacuugaccauuuacuuaugagaccagacgaaauuucgaaauacgcaacaggauucauaaacagacagcuaguggaaaccagacaaguuauaaaauugguagaagaacuaauaaacgcagaauauccaaguacagcuauuguaagcgucaaagccaacuuaacacaccaauuccgacaaacuuuugacuuccccaaaauacgugaaguuaacgauuaccaucaugcauucgacgcagcacuaaccgcauucaucgguacauaucuauuaaaaagauacccaaaacuagagagauuuuucguauauggaaaauucgcaaaacaaccgguaaaucuuacucgcuucaacguaauacgaaaacuagcaaaaaccgacaccccaaucacagacauagauacaggagaaguguuaugggacaaauuaacagauauaaaguacuuugaaacacuuuaugauuacaaacgauugcuagucacucgcgaaguaucagaaaacuauggugcaauguucgaucaaacucuauugaaagcuagcgacaaugguaaaagauuaauucgcaaaaagcaaucauucgacaccgcaauauauggaggauacacaggaaaaaccuuagcauacauggccaucgucaaagugucaacuaagaaagacguacaguaccaaguagucggcguacccacuacaauggugacccaaauagaacaacuggagcagcaagguaugacaaacaaacaagcuguuacuaaaguaaucgaaccgcuuaucgccgccaauaacaagaaaaugcuuacauaugagguacuauuaccaaaaguaagauuugaacaagucguuagagauagaauuaaaggccaaacucaucgauucgcacuuggcacagacacguacuaucacaauauccaagaacuauaccuaccucucacucugcaacgagcauuucuaggcaaacaaaaugaaucagaaguucaauuaaaccaaaaccuacuuaccguauucgaugcgacccuagcgcaaguuaaccgauacuucccacucuacgaaaugaauaaguuuaagaaaauacucaauagugcgagagaccaaauagaacuccuagaagcuaaaaaucaauucgucaaaaauaaauuaguauuaggaaaacagggaauauuaaccaauauguuuauuggacuacaugcaaaugcuucuuacggagacuugaaaguacucggggugaaaauagauuucggaaaacuccaaguaccuggcggaauaaaacuuacaggggaugcagaaauaauauaucaaucuccaacaggacuauucgaacgaaaaauugcacuaaaagaccucuga

SEQ ID NO: 5374 - RNA, 4077 nt, Artificial Sequence
  Cas9 variant
augaacgaaccauacggaguaggccuagacauaggaaccaauucuguaggauggacagucguggauaugaacggcaggguuaggaaaguuaaaggaaaaacagcucucggagccagauuguucaaagaaggagcaacagcugaggacagaagaggauuccgaacuaccagaagaagauuaaaacgaguuaaauggcgauuacgacuauuaagagaauuuuucgaccaaccaauaucaaaaauagacccgaacuucuuugcaagacgaaaauacucagauauaucuccaagagacccaaacuacaacggucuagcaaaaacauuauuuaaugacaggaccgaucaggaauuuuaucacgauuacccaacaauuuaccaucuacgagacaaacuaaugacuucagacagaaaauuugacauaagagaaauuuaccuagcaauacaccauauagucaaauaucgaggaaacuuucuccgaacaggaccagccucucaauauggaucugcgucccuacaccuugcgacauccuuucaaaaauuaaaugaccuguucgcacaaagugaagaaucucuaaacuucaagcuaguuacagaugaagcccaacuucaacaaauacaacaaauacugguaaggacagacuuaucgcgaucagaacaacaacgacaaaucuggccacugaugguuguacuaaugggagcaacagcagcagaaaagaaaagacaaaaagauuucgcuaaagaauuagcuaaugcacuugucggucuaaaagcaaaauuaaaugucguaacuuuaacaaacgucgacacaacaguagucaaagauuggacuuuuacucuagaagaaucucaagacaaacucccagaaauugaagaacaauugucugaagucggccaacaaauaauggacgaaguaauucaacuauaugcuagcguaaauuuagcgcagcuaauaccagccggaaaaagauuuucucaacauaugguugaaaaauauaaucaccaugagaaaaaccuagaacuucuuaaagcauauauccacucacaaagcgauagcaagcgagguagagaaauccgagcaacauacgacagauacauagauggaguaaaaucaaaaccuguaacccaagaaauguuuuauaaagaucugaugaaauacguagaagcagaugccacuucaaaucaucucgcagcggaaauaaaagacgaaauagacuccgagcaauuuaugccaaagcuacggaccaaacaaaacggaucaauacccuaucagguucagcaauaugaauuagaccaaauaauaagccaucaaaagaaauauuauccuugguuaggugaagaaaacccgguugcugaacgaagagguaaauucccauauaaacuagacgaguugguaggauuuaggguuccauacuacguaggcccccuaauaaccaaagaagaccaacaagcgacaaguggugcuggcuucgcauggaugguaagaaaagcagacggaccaauaacaccauggaauuucgaccaaaaaguugaccgcaucgcauccgcaacggccuuuauacaaagaaugcaaaccacugacacauauuuaauuggugaagacguccugccagcccguagucuaauauaucaaagauuuaugguauuaaaugaauuaaauaacaugagaguagaagaccaaaaacuagcaccacggcaaaaacagcgccucuacaaccaagucuucaaacaacaccaacauguuagugugaaaaacauucaacaaaaucugauggaugcaggagaauacagagaaacacccaaaaucacaggacucgccgacccuaaaggguuuaacucaaguuuaaguacauaucaugauuucaagaaaauacucccagaagcaauagcugacgaacauaaacgcgcggauauugagaaaauaauacuauggagcacaacauuugaagacucggcuauauuuaaacaaaaacuagaagaaguggcguggcuaacagacgcacaaagaaaacaacuaucgggacuucguuaccgcggauggggucaauuaucgcauaaacuucuaaccgcuuuuaaagacgauaacggcagaucuguaauggauggacuuugggaaacaucugacaauuucaugcaacuacgaaaacagcccgcaauagaaacacaaauaaaagaagcaaaucaagcuaaucuaacagaugcggauauacaagauacaauaaaugaauuguauacaaguccacaaaauaagaaagcaauaagagagguaauguuaguucuagacgauauuaaaaacgccaugcauggacaaaccccaucauggauauuuauagaagccgcucgcgguggaggugucgccggcaggagaacucaaucaaggaguaaacaaauuguugaagcauacaaaagcacagcuaaagaaauugucucugaaaaaguccaacacgaacuuaacgagaaaauuaaagcaaaagcggauuuuaauacgagauuaguacuauacuuccuccaaaacggucgagaccuuuacacaaaugaagcuauaaauaucgaccgacuaucagaauacgacaucgaccauauccuaccucagagccuaguaaaagacgacucacuagauaaccgcguguuaaccucagcacgaauaaauagagagaaaaacgauaccuucgcaucggaaaaauuuggcagaaaaaugggugcucaauggcgggaauuacacagaaauggauuaaugacacaaaggaaacuaaaacauuuauuaaugagaccggaugaaauuuccaaacaugccacagauuucauuaauagacaauuaguagaaacacgacaagucauaaaacucguagaagaacuaauaucaucagaguaucccucagcaucaauaguagcagucaaggcaaauuuaacacaucaauuucgacaaacauucaauuuuccaaaauuaagagaaguuaacgauuaccaccaugcauuugaugccucauuaacggcuuuuauugguauguaucuauuaaaacaauacccuaaauuagaaagauucuucguauacggaaaauucgcaaaacaaccgauaaaccuuacaagguuuaauguuauucgaaaauuagcuguggcagaggaaccaauagcaaauauugaaacaggagaaauacuaugggauaagaccgccgauaucaaguguuucgaaaaacucuauaauuacaaaagauuacucgucacgcacgaaguacgugaaaauuauggugcaauguuugaucagacaauuuuuaaggcgacugacucaagaaagaggcuuauacagaaaaagaaaggauucgcaacugaaacuuauggcgguuauacaggccgaaccuuagcauauuuagccauuguuaaaguaguaacuaauaaagauacccaauaccaaguaguaggcauccccacuacaaugguaacacaaauacaacaacucgaagcaucaggacuuaccucaaaacaagcuguuacuaaagcaauaggugcaaugaucaacgaaaacaacaagaaauuacaaucuuacgaaguacuucuaccaaaaguaagauuugaacagguuguaagggaugaaguuaaaggacauauccaucgauuugcacuuggcacagauacauauuaccacaauauccaagaacuauaccuaccuuuaaccauacaaagagcauuucuaggaaaaagaaaugacacagaugcacaaacagagcaaaaccuccucacaguguucgagacuacacuagcgcaagucaauagauacuucccauuauaugaaaugaacaaauucaaacagauauuaaacucagcccaagaaaaauucgcagcuuuaccaacuaaaaacaaaacaguuaaaaacaagcuaguaaccggaaaagacggaguacuaaauaauuuguuuauaggccuacacgcaaaugccagcuuaggugaccuuaaaaucuuaggaaugaaaaccggcuucggcaaauuacagguaccaggaggucucaaauuaacagaucaagcagaaauaauuuaucagucuccaaccggauuauucgaacgaaaagucgcccucaaagauuuguga

SEQ ID NO: 5375 - RNA, 4077 nt, Artificial Sequence
  Cas9 variant
augaacgagcccuauggaguaggacuagacauuggaacaaacaguguaggauggacggucgucgacaugaauggucgaguccgcaaagucaaagguaaaacagcacuaggcgcacgacucuuuaaagaaggagccacagccgaagaccgcagaggcuucaggacaacuagaagaagauugaaacgaguaaaauggcgccuccgcuuacuaagagaguucuuugaccaaccaauaucgaagauagacccaaacuucuuugcaaggagaaaauauagugacaucucgccccgggauccaaacuacaauggcuuagcaaaaacacuguuuaaugaucgaacugaucaagaauuuuaccaugauuacccaacuauauaucaccuuagggacaaacuaaugaccucagacagaaaauuugauaucagagaaauauaccuggcaauccaccauauaguaaaauacagagggaauuuucuaagaacagggccagccucucaguacggaagugcgucauuacauuuagcaacuagcuuucaaaaacuuaaugaccuuuucgcacagagugaagaaucacugaacuuuaaauuagugaccgacgaagcacaauuacaacaaauccagcagauucuaguacgaacggaucucucaagaagcgagcaacagagacaaaucuggccauuaaugguaguucuuaugggugcaacagcagccgagaagaaacgucaaaaagacuucgccaaagaacuagcgaacgcccuagugggucucaaagcaaaauuaaacgugguaacacuaacuaauguggauacaacaguaguaaaagacuggacauucacacuagaagaaucacaagacaaacuuccagaaauagaggaacaacuaucagaaguuggacaacaaauaauggaugaaguaauacaacuauacgcauccguaaauuuggcacaacucauuccagcgggcaaacgauucucccaacacaugguagaaaaauauaaccaucaugagaaaaauuuggaacuauuaaaggcuuauauacauagucaauccgacuccaaaagggguagagaaauaagagcuacauaugacagauacauugacggagucaaaucaaaaccaguuacacaagaaauguucuauaaagaucuaaugaaauacguagaagccgacgcuacaucaaaucacuuagcugcugaaauaaaagacgagauagauucagaacaauucaugccaaaacugagaacaaaacaaaauggaucaauaccguaccagguucaacaauaugaacucgaccaaauaaucagucaucaaaagaaauauuacccuuggcuaggcgaagaaaaucccguugcagaaagacgcggaaaauuuccuuacaaacuagaugaacugguagguuuuaggguaccauacuacguaggaccucucauaacaaaagaagaccaacaggcaacuucuggagccggauuugcauggaugguaagaaaagcagauggaccaauuacgccuuggaauuucgaucagaaaguagaucgaauagcaucagcaacagcguucauccaacgcaugcaaacgacagauacguaucuaauaggggaagauguacugccggccagaucauuaauauaccagcguuucaugguccuaaaugaacuaaauaauaugagaguagaagaucaaaaauuagcaccacgacaaaaacaaagauuguacaaccaaguauucaaacaacaucaacauguuuccgugaaaaacauucaacaaaauuuaauggaugcaggagaauaccgggaaacaccaaaaauaacuggacuugcugaucccaaaggauucaauagcucacuaucaacauaucacgauuuuaagaaaaucuuaccugaagcaauagcggacgaacacaaaagagcagacauagagaaaaucauacuauggucuaccacguuugaagauuccgcgauauucaaacaaaaauuagaagaaguagccugguuaacggacgcucaacgaaaacaauugagcggacuuagauauagagguuggggccaacuaucacauaaacuuuugaccgcuuuuaaagacgauaauggacgaucaguaauggauggauuaugggaaacaagcgauaacuucaugcaacuccgaaaacaaccagcaauugagacucaaauaaaagaagcuaaucaagcgaaucuaacugaugcagauauacaagacacuauuaacgaauuauacaccucaccacaaaacaagaaagccauacgugaaguuauguuagugcuagacgacauuaaaaacgcaaugcauggacaaacuccauccuggaucuucauagaagcagcacgggguggaggaguugcaggaagacgaacacaaagccggucaaaacaaauagucgaagcauauaaaucaacggcaaaagaaauaguaucagaaaaaguccaacaugaauuaaacgagaaaauuaaagcaaaagcggacuuuaauacgagauuaguuuuguauuuccugcaaaacggcagagaucucuauacaaaugaagcaauaaacauugacagacuaucugaauacgauaucgaccauauacucccccaaucuuuaguaaaagacgauucacuagauaauagaguauugacaagugcuaggauaaaccgagagaaaaaugauaccuucgcuagcgaaaaauucgguagaaaaaugggugcccaguggagggaauugcacagaaacggccucaugacacaacguaaacucaaacaccuauuaaugagaccugaugaaauaucgaaacacgcuacagauuuuaucaauagacaacucguggaaacucgacaaguaaucaaauuaguagaagaacuuauaucuagugaauauccaucagcuucaauaguugcaguaaaagcaaaucuuacgcaucaguuucgacaaacauucaacuucccaaaguuacgggaaguaaacgauuaucaccaugcauuugacgcaagccuaacggcauuuauagguauguaucuuuuaaaacaauauccaaagcucgaaagauuuuucguauacggaaaauucgcaaaacaaccaaucaauuuaacaagauucaaugugauuagaaaacucgccguugcugaagaaccaauagcaaauaucgaaacaggggaaauccuaugggacaaaacagccgacauuaaaugcuucgaaaaauuauauaacuauaagagacuauuagucacacaugaagucagagaaaauuacggcgcaauguucgaccaaacaauauuuaaagcaaccgauucuagaaaaagacuaauucagaaaaagaaaggcuuugccacagaaacguauggaggauauacaggaagaacacuagcauaccuggcuauaguuaaagucguaacaaauaaagauacccaauaucaaguuguagguauaccaacuacaauggucacucaaauacaacaacuagaagcaucaggcuuaacaucaaaacaagcaguaacaaaagcuaucggagcaaugauaaaugaaaacaacaagaaauuacaaucguacgagguacuauuaccaaaaguucgguucgaacaaguaguuagagacgaaguaaaaggacacauacacagauucgccuuggguacagauacuuacuaccauaacauacaagaacuauaccuaccauugacaauacaaagggcuuuucuaggcaagcgaaacgauacagaugcacaaacagaacaaaacuuauuaaccguauucgaaacaacucuagcccaagucaauagauauuuuccacuauacgaaaugaacaaauuuaaacaaauacuaaauagugcccaagagaaauucgcugcauuacccaccaaaaacaaaacaguuaagaacaagcuaguaacaggaaaagacggugugcuaaacaaucuauucauuggacuacacgcuaacgcaucauuaggugacuuaaaaauauuagggaugaaaauuggauucggaaaacuacaaguuccuggaggcuuaaaauuaacagaucaagcagaaauaauauaucaaaguccaacaggcuuauucgaacgaaaaguagcgcugaaagaccuauga

SEQ ID NO: 5376 - RNA, 4077 nt, Artificial Sequence
  Cas9 variant
augaaagaaccauaugggguagguuuggauauaggcaccaauuccguaggcuggacaguaguagaugcuaguggccacgugaggaaaauaaaagggcaaacaggaauuggaguaagacuauuuaaagaaggcgccgcagcggcggauaggagagguuucagaacaacccgaagacgccuaaaaagaguaaaauggaggcugagauuauuacgagaauuuuucgaccaacccauaucaaaaguagauaucaacuuuuucgcaagacgaaaauauagugauauaucaccuagagacccaaacuauaauggauuggagaaaacauuauucaaugauagaucagaccaagacuucuaucacgauuacccgacaauauaucauuuaagagaagcgcuaaugacgcaacauagaaaauucgaugugcgcgaaauauaucuugcaauccaccauauuguaaaauaucguggaaacuuccuaagaaaugaugcggccacggcuuaccgaagcggaacauuagaucuacaacaacauuucgaaacguuaaaccaccuauuuucgcaagcugaccuugaacuaaaccuaaauuuaacaacagacguagccuuacuugauuccauaaaacaaacguuaguacguacagauauaaguagauccgauaggcaaaaauuaauaaugccacuacuagccguauuaaccggugcgacuaccgccgaaaagaaaagacagaaagcuguuguaacagaauuugcuaaagcguuaguaggcaacaaaacuaagauagauguucuaacacuuacagauauugacgcgaccgaagcaaaagacugggcuuucucacucgaagaaaaucaagacaaacuaccagggauagaagacagauuuuccgaaguaggacaacaaaucauugacgaaguuauuaggcuauacgcuagcgucaaccuagcacaacucauacccgaaggcaaaagauuuagucaauccaugguugaaaaauacaaaaggcauggagaagaccucaagcugcuuaaagcauauauaaggucucaaucagaugccaaacgagggagagcuauaagagcaacuuacgaccaauauaucgaugguguaaaauccaaacaggugacacaagaagcauuucaaaaagccuuaggcaaauucgucgaugcagauguagaucuaaauucuugggcagcucagaucaaacaagcaaucgauagugaacaauucaugccuaaauuacgaaccaaacaaaacggagcaauaccguaccaagugcaacagaacgaauuagaucaaauuauaaauaaucaaaaagaauacuauccaugguuaggagaagaaaauccugucauaaaaagacgaggcaaauuuccuuauaaguuagaugagcuagucggauuccgaguaccauacuauguugggccuuuaauaacaaaagaaaugcaagcugcaacugccaaugccgguuuugccuggauggucagaaaagcugacgggccuauuacaccauggaauuuugaugacaaaguagacagagucgcaucugcuacagcauuuauacagcgaaugcaaacaacugacacauaucuaauaggagaagaaguucucccagcaagaucccuaauauaccaaagauuuaugguucuaaacgaauugaauaacauaagaguagacgacggucaacuaacaccuagacaaaagcaaagacuauacaaucaaguauuuaagaaacacaaacggguaacagcgaaaaauauacaagacaaucuaguagcugcgggggaguucccaacagccccgaggauuacgggacuagcagacccuaaaguuuuuaauaguucacuaucaacauaucaugauuuaaaacaagucuuaccagaagcuaugagcgacguaagaaagcaagccgauauugagaaaauaauacucuggucuacaauuuucgaagacagcacaauauucaaacaaaaacuuacugaaauaaguuggcuaacagcugcacaauuaaaacaauuaggucaauuacguuauagaggauggggucaacuaucuagaaaguuauugacaggucuuaaagacgauaacaacagaucaauaauggaugggcuuugggaaacaaaugcaaacuuuaugcagcuaagaucgcaaccagcaauagaaaaucaaauaaaaucagcgaaucaagccaaucuaacaacagcagaucuucaagacacuauaaaugaacuauacacaucaccacaaaauaagaaagcgauuagagaagugaugguaguccuugcagauauaaaagaugcuaugcaugggcaaacccccaauuggauuuucguugaagcagccagaggcgguggagucgcaggaagacguacacaaucaagaucaaagcaaaucguugcagccuaccaaggaacagcccagguaaucguaagcgaccaaguucaaagagaacucaaagagaaaauuaaaaacaaagcaaauuucaacacaagauuggucuuauacuuuuuacagaaugguagagauuuauacaccggagacgccauaaacauagaccgauuaagcgaauaugacauagaccauauauugccacaaucuuuagugaaagaugauucacuagacaauagaguauuaacuaacgcucgaauaaacagggagaaaaacgacacauucgccagcgaaaaauucgguaagaaaaugggugcgaaauggaaagaaaugcacagaaugggucucaugacgaaaagaaaauuggaucaucuacuaaugaggccugaugaaauaagcaaauacgcgacagguuuuauuaauagacaauuaguagaaaccaggcaagucauuaaauuagucgaagaacuaauaaaugcagaauauccuucaacagcgauaguuuccguuaaagcaaaucuaacacaccaauuuagacaaacuuuugauuucccuaaaauaagagaaguuaaugauuaucaccacgcauucgaugcggcuuuaacagcguuuauagguacauaucuguugaaaagauauccaaaacucgaaagauucuuuguguauggaaaauuugccaaacaaccaguaaacuuaacccguuucaacguaauaagaaaacuggcaaaaacagacacaccuaucacggacauagacacaggagaaguauuaugggacaaauuaacagauauaaaauacuucgaaaccuuauaugauuauaaaagacuacugguuacucgagaagucagugaaaauuacggcgcaauguucgaccagacccuacuaaaagcaucagauaaugguaagcggcuaauuagaaagaaacagagcuuugacacagcaauauacgggggcuauacaggcaaaacucuggcauacauggcaauaguaaaagugucaacuaagaaagacguacaauaucaaguagucggaguaccuacaacaauggucacucaaauagaacaacucgaacaacaaggaaugacuaacaaacaagccguaacaaaaguaauugaaccacuaaucgcagcgaauaauaagaaaaugcucacauaugaaguucuccuccccaaaguucgauuugaacaagucguaagagauagaauaaaaggacaaacccauagauucgcucuaggaacagauacauacuaucauaacauccaagaacuuuaucuaccacuaacauuacaaagagcauuucugggaaaacaaaaugaaagcgaaguacaacuaaaucagaacuugcuuaccguauuugaugcuacacucgcacaaguaaacagauacuuucccuuguaugagaugaacaaauuuaagaaaauauuaaauucagcacgcgaucaaauugaacuucuagaggcgaaaaaccaguuugugaaaaauaaauuaguacuaggaaaacaggguauccuuaccaauauguucauaggacugcaugcaaacgcgagcuucggcgaccuuaaaagucucggaguaaaaacaucauuuggccaacuacaaguaccaggcggaauaaaacuaacgggagacgcagagauuauuuaucaaucaccuacaggacuauuugaaagaaaaauagcacucaaagaucucuga

SEQ ID NO: 5377 - RNA, 4077 nt, Artificial Sequence
  Cas9 variant
augaaacaaggaaaaaggggauacuacuuagguuuagauauaggaacagacucaaucggcuacgcggucacagacgaacaauaccacuugcuuagauuccacggaaaugaugcaugggguagccauguauucgacucagcaucacuuugcgacgaaaggcgaggauuccguagcgcuaggagaagacuagaccguagacaacaaagaguaaaacuccuacaagaaauuuucgcaaaagaaauagccaauaucgauccaagauucuuuauuagacucucagaauccuaccgauggcgcgacgauaccgacgaucgcuacauauauuucaacgaagaggaauacacagauauacaauacaugcgagauuaccccacaauccaucaucuuauaugugaacucauggagaaugaggaagaacacgauauaagacucguauaucuagccugcgcauggcuaguugcacaucgcggucacuuuuugucacaauuaaguguagauaauauagauucauuaauagauauagaauccgucuaccaaaaauuucuacacuuuuucauagauaacggaugcgaaaaucccuggauccaggaugcagaauugguuggggguauccuaaaagaacauauaggaguuacagaaaaacauaaucgacuaggagaaauaauguuggguaauagaaaaccaaguaaagauguaagagauaccuuuuuauauucagaauacuguaucauuagacuauuagcuggagggacuugcaaauuaagggauuuauaugguaaagaagaauacgaagacuuuggcucaguaucacuagaaauggaugacgauaaacuagcagaaauaaugaucaacauuggagaagauuacgaacuuauagcaguacuaagaucacugcacgacuggucaguacuugccgauauacucgacggacaaaauggucuuacuaauauauccacagcgaaaguagcaauauaugaacaacauaagaaagaucuagcaacacuuaaauauuucauaagaaaauacuguccagaaaaauacaacgcuaucuucaaagacgcgcgagaggacaauuacguugcauauuccuaccacuauaacaacaaacuugacgggcagauuaaaaagaaagcagacacggaaaccuuuaguaaauuucuaauaaaaauaauccacucaauaaaaccagauaaagaagacgaaauuaucuaccaagacauggacaaucggcucggcuuaagacaguuuuuacccaaacaacguaacacagauaacaggguaauaccccaucaauuauaugaauaugaauugaagaaaauucuagagaacgcagcaaaauaccuaucguuuuuaaaccaaaaagaagacggcauaaguaauacagagaaaauaauaucaauuuuuaaauuuaaaauacccuauuacguuggaccacuaaauaaacacucugaauuugcauggauagaccgaaaaaguggaaaaauauugccuuggaauuacgaaaauaugauagaugaugacgcaucagaagaggcuuuuauaaagaaaaugacuaaucaaugcacuuaccucccaggugaaagcguucuuccuaaagacucauuauguuaccaaaaguucaugguuuuaaaugaaaucaacaauauuaaaguagacggaaggaaaauuucuguaggugcaaaacaaggcaucuacagugaccuauucuuaaaauacaagaaaguaaaaagaucacagauagaagaauaccuuauuuccaacggacaauuagagaaaaacagaagagaaacacuauccggaauagacauucaaauuaagucaucuuuaucuucacauaucgcauuuagaagacuucuagaacagaaaaucuuaaaugaagcggauguagagcgcauaauagagcgagcaaguuaugcagaggauaaaggucgagucgccaaaugguuaagagcaaaauacccucaccugacggaagccgacauaaaauacauauguaagguaaaaauuaaagacuucggacgacuaaguagaacauuucuaacaggaaucgaaggagcauguaaagaaacaggagaggucgccacuauuauuaguaugaugugggaaaguaacgauaaucugauggaacuauuaagcgaacguuauacguuugcugauacaauacuugaguucaaaucggacuacuauacagaaagaaaacaaacccuuagcgaaagacuggaugaaauguacguaucuaaugccguacgacgaccgauauacagaacauuagacauagugaaagaucucgaaaaagcauuuggaaaaccugagaagauauucauagaaaugacacggggagccaugcccgaacuaaaaggaaagcguacaaaaucacgacaacaacaauuacuugaauacuaugauaaauguaaagaagaagacguacgagacuuaaaacaacaauuagaagcauuaggagaauauguagauaacaaacuucagucagaccgacuguuucuauauuuuaugcaauuugguaaaugcgccuacucuggcaugccaaucucacuagaacgacuaauggcaggaucaaaagaauacgauauagaccauaucuacccgcaagcauacguaaaggaugauaguauaauuaauaacaaaguauuaguacuaagcguagcuaauggagaaaagaaagacguauauccaauuaaaagcgaaauacgcaacaaaaugcagaaaacauggaguuucuggcaccauguagguacuauauccgaugaaaaauauaaaagacucauaagaaguacaccauucacugaagacgaaaaauaugguuucauuaacaggcaacuaacagaaacaucucaaucaaccaaaguaguagccgaauuauuaaaagagagauauccagaagccgaaauugucuacucaaaagcugguuuaauaucugacuuuagacaugaguucgaccuauacaaaucaagaaguuacaaugauuuacaucaugcuguugaugcauaccuaaauauuguagucggaaacguauaccacaugagauucucaagacaaugguucaacgucaacucaucauacaguauaaaaacaaaaacucuuuuuacccacacaguaaacuguaacggaaaggaaguauggaacaaagauaugcuaccaggaguucuaaaaaccgcuaagaaaaacaccgcgcauuucacaaaacaugcaacauuuaaaacaggcgguuuauuugaccaaaauccgguuaagaaagcaccuggauuaacaccuuuaaaagcaggacuacccacagaaaaauacggagguuauaauaaagcuggcguaauguucuucauaccagugagauauaaauccgggaagaaaacaguauugaugguacuaucaguagaauuacuuuauggaaauagauuuuuagaagacgagauauucgccaaagaauaugcaaaagacagauuacaaaggaugauaggaaaaagcguagaugaaauagauuucccaauuggaaugcguccauggaaaguaaacacaaucuuaaguuuagacggauucagaauauguauaacuggaaacgcauccgggggaaaaugucuaauugcacaaccaauaaugcaauuuucaucagacgaauauuggaaauacuaccuaaagaaaguugaaaaauuuguagaaaaagucaaaaauaauaguucguauguauaugauguugacuacgaugccguccaacaugaagacaauuuaaaacuguaugauuuauauuuagauaaacugcaaaacagcauuuaucguaaaagaauaaaugcuccaauacaaacacuaauagaaggaagagaaaaauuuauugacuguucaguaauagaacaaugccagguacucuuaaacauacaccaaguauuuggucguaugacaucaggcugugaucuaacauuaauuggugguaaaacaagaucagcaaguacaguaaacuuuaguaguaucaucuuaaauuggaagaaaaauuacacagacguaagaauuauagaccaaagugcuagcggcuuaugggagguuguaucagaaaacauacuagaguaccuuuga

SEQ ID NO: 5378 - RNA, 4077 nt, Artificial Sequence
  Cas9 variant
augggaaaaauguauuaucuugguuuagauaucgguacuaacaguguaggauacgcaguuacugauccaagcuaccauuuauuaaaauucaaaggagaaccaauguggggugcccauguguuugcagccgguaaccaaucagcagaaagaagaaguuucagaacaaguagacguagacuagauaggagacagcaaaggguuaaauuaguacaagaaauauuugcuccaguaauuagcccuauagauccaagguuuuucauaagauuacacgaaucagcacuauggagagacgauguagccgaaacggacaaacacauuuucuuuaaugacccaacuuacacagauaaagaauauuacucagacuauccuaccauucaccaccucauaguugaucuuauggaaucuucagaaaaacacgauccaaggcuaguauauuuagcagucgcauggcuaguagcccauagaggacacuucuuaaaugaaguggacaaagacaauauaggugacguucuaucuuucgacgcauucuaccccgaauuucuagcauucuuaagcgacaauggaguaucaccguggguuugugaaucaaaagcacuacaagcaacccuauugucucguaauucagugaacgauaaauacaaagcacuaaaaagccuaauuuuuggaagccaaaaaccagaagauaacuuugacgcaaacauaucagaagacggccuaauacaacuccuagcugggaagaaaguuaaagucaauaaauuauucccucaagagucaaaugaugcaucauuuacacugaaugauaaagaagaugcuaucgaagagaucuuagguacacucacuccugaugagugcgaauggauagcacauauaaggcgacucuuugacugggcaaucaugaaacaugcacuaaaagauggccgaacuaucucagaaaguaaaguuaaacuauaugaacaacaucaccacgacuuaacccaacuaaaauacuucguaaaaacuuaccuugccaaagaauacgacgauauauuccggaauguagacucagaaaccacuaagaauuacguagcauauaguuaccacguaaaggaaguaaaagguacacuuccuaaaaacaaggcaacucaagaagaauuuuguaaauacguacugggaaaagucaaaaacauugaauguucggaagccgauaaagucgauuuugacgaaaugauacaacgccuuacagacaacagcuucaugccaaaacaagucucaggugaaaauagggugauuccauaccaauuauacuauuaugaacuaaaaaccauauuaaauaaagcugcauccuaucucccauuucugacacaaugugggaaagaugcaauuagcaaucaagacaaacugcuaaguaucaugaccuuuaggauucccuauuuugugggaccacuuagaaaagacaacucagaacaugccuggcuugagagaaaagcaggaaaaauauauccauggaauuucaacgauaaagucgaccuugacaaaagcgaggaagcauucauacguagaaugaccaauacaugcacauauuacccaggcgaggauguuuuaccccuugacucucuaauuuacgaaaaguucaugauauuaaaugaaauaaauaacaucaggauugacggcuacccaaucuccguagacguuaaacaacaaguauucggacuauuugaaaagaaacgcaggguaacgguaaaagauauucaaaauuuacuacucucauuaggagcauuagauaaacauggaaaauuaacaggcauagauacaacuauacauucaaacuacaauacauaucaccacuucaaaucucugauggaacgagggguacuaacaagagaugacguagaacgaauaguagaaagaaugacauauucagaugacacaaaacgcgugagacuaugguugaauaauaauuauggcacacugacagcggacgaugucaaacauauaaguagacuuagaaaacacgauuuugguagauuaaguaaaauguuucuuacaggacugaagggcguucacaaagaaaccggagaaagagcuucaauuuuagacuuuauguggaauacaaaugauaaucuaaugcaacuacugucagaauguuauacauucucggaugaaauaacaaaauuacaagaagcauauuaugcuaaagcacaacucagucuaaacgacuuucuagacuccauguauauauccaacgcagugaagcgaccaaucuacagaacuuuagcgguugucaacgacauacguaaagccuguggaaccgcaccaaagcgaauauuuauagaaauggcaagagacggagaauccaaaaagaaaagauccgugacaagacgagaacaaauuaaaaaccuauaucgcucaauacgaaaagauuuucaacaagaaguagauuuccuggagaagaucuuagaaaauaaaucggacggacaacuacagucggaugcucuuuaccucuacuucgcccaacuuggaagagacauguacaccggggacccaauuaaacucgaacacaucaaagaucagagcuucuauaacauagaucauauauauccacaaucaauggugaaagacgacucauuagacaacaaaguccuaguacagucagaaauaaacggugaaaaaucuaguagguauccacucgaugccgcgauacgaaacaaaaugaagccauugugggaugccuacuacaaccauggauuaauaucucucaagaaauaccagaggcuuaccagaucaacaccauucacggacgacgaaaaaugggauuuuauaaauagacaauuaguagagacacgacaaagcacaaaagcauuagcaauucuauuaaaaagaaaauuuccagacacugaaauagucuacucuaaagcaggacuaucaagcgacuuccgacacgaauuuggauuaguaaaaaguagaaauaucaacgaccuacaucaugcuaaagacgcauuccuagcaauagugacuggcaacguuuaccacgaacgauucaacagaagaugguuuaugguaaaucaaccauauaguguaaaaaccaaaacgcuauuuacacacucaauuaaaaacggcaauuuuguggcauggaacggagaagaagauuuagggagaauagugaaaauguuaaaacaaaacaaaaacacaauacacuucacacgguucucuuuugaccgaaaagaaggccucuucgauauacaaccacucaaagcguccacagguuuaguaccccgaaaagcuggacuagauguagucaaauacggcggcuacgauaaaucaacagcagcauacuaucuucuaguacgauucacgcucgaagacaagaaaacucaacacaaacugaugaugauacccguagagggguuauauaaagcaaggauagaccacgacaaagaauuucuuaccgacuaugcgcaaacaacuauuucugagauccuacagaaagauaaacaaaaagucauuaacauaauguuuccuauggguacaagacacauuaaauuaaauaguaugauuucaauugauggcuucuauuuaaguauaggcggaaaaucaucaaaagguaaaucgguucuaugucaugcgaugguaccccuaauaguuccgcacaaaauagaaugcuacauaaaagcaauggaauccuuugcaagaaaauuuaaagaaaacaacaaacuaagaauaguugaaaaauucgacaaaauaacaguagaagacaacuuaaaccuuuacgaauuauuuuugcaaaaacuccaacauaauccauacaacaaauuuuucucaacucaauucgaugucuugaccaacggccgaucuacauucacaaaacuuucaccagaagaacaaguacaaacauuacuaaacauuuuauccauuuuuaaaacaugcagaaguucaggaugcgaucuaaaaucaauaaacgggucggcucaagcagcuaggauuaugauaagugcagacuuaacaggacuuucgaagaaauacucagacauacgacuuguggaacaaagugcaucaggacuauucgugucuaaaucacaaaaucuuuuagaauaccucuga

SEQ ID NO: 5379 - RNA, 4083 nt, Artificial Sequence
  Cas9 variant
augacaaaacuagguaaaccauacggcauugggguagacauugguagcaacucuauugguuucgcugcuguugacgaaaacucacaucuaauaagacuaaaagguaaaacgguaauaggcgcucgacuauucgaagaaggaaaggcagcagcagaccgacgagcuucacgcacuacucgacgacgcuuaucaagaaaccgauggaggcucucuuuccuucgagauuucuucgaaucacacauaaccccuacugacccaaauuucuucaugagacaaaaauauuccgaaaucucaccaaaagauaaagcuagauacaaauacgaaaagcgauuauucaacgacaggacugacgcagaauuuuaucaacaauauccuacuauguaccauuuacgaacccgacuguugaccgacccaucuaaagcagauguccgagaaauauauuuugcuauacaucacaucuuaaagagucgaggacauuuccucaccucaggguaugcaaaggacuucaauacaaacaaaguugcccucaaugagauauuuccagcccuacaagacgcauacgcacaaguuuauccagaccuagacauaaccuucgaugaaaacaagguuaaugaauuuaaaacagucuuauuagacgaaaaagcaaccccauccgacacccaacgagcuuuaguaaaucuacuauuagccgaagacggugacaaagacauuuuaaaacaacaaaaacaaguacucacagaauuugcaaaagcuguaguaggacuaaagacaaaguuaaauguugcuuuggggacugaaguagauucaucugaagccacagcauggaauuuuucguuggggcaauuggacgacaaaugggcuggaauagaaagugcaaugacugaugaagguacagaaauuuuagaucaaauaagagaucuauacagagccagacuauuaaauggcauagugccagcaggcaaaacucuaucacaagcaaaagucgaugauuacgaacaacaccaugaagaccuagaacuuuucaaagacuaucuaaagcaacuugaagaugacggaauggcaaaagcgauaagacaauuauacgacagauacauagauggagacgaugccaaaccauuugucagagaagauuuuguuaaagcauuaacaaaagaagugaccgcccacccaaacgcuaaaucaccagaacuauuagaacgacuuguucaaccagacuucaugcuaaaacaaaggaauaaggcaaauggggcaauaccuguccaaaugcaacaacgagaauuagaccaaauaauuaaaaaccagucuguuuauuacgauuggcuagcagcuccaaacccugucgaaaaacaucgucaaucaaugccauaccaauuugaugaacuauuaaauuuuagaauaccuuacuacguaggaccacugguaacagcaaaagagcaaaaagccgcacaagggggaguauucgcguggaugguaagaaaggacccagaugggaauauaacaccuuauaacuucgacgaaaaaguagaucgugaagcaucagcaaacaccuuuauacaaagaaugaaaaccacagacaccuaccuaauuggagaagauguauuaccgaaacaaagccuccucuaucaguccuacgaaguauuaaaugaauuaaacaacgugcgaguuaacgauaacaaauuaucauucgaccagaaacaacaagucuuaggagaacuauucgaaaggcauaauacaguaacaauuaaacaauucgucgacaacuuacuagcucauggagauuacgaccgaaucccugaaguaagaggacuugcugaugagaaaagauuucuaaguagcuuauccacauauaaccaguugaaaggcauucuacaugaagcaauagacgacucagauaagcaaacggacauagagaaaauaauugcauggagcaccauauucgaagacaaagccaucuucaaaacuaaacugaaugaaauaaguuggcuuaaugcugguaugauaaauucacucgcaaacauuagguacagaggauggggccaauucucacacaaauuauuaaacgaacuaacccuauccacagguaggaccguauucgaagaacuacuaauuaguucacauaauuuaaugcaaauacuaacagacgaaguacuaaaacagaaaauagcagaauuaaaugcccacgaacuaaaagcaagcggaauauaugcagcaauagaugacgcuuauaccucacccucaaauaagaaagcacuacggcaaguccuaucaguaauagaugacauaaccaaugcugcuggacaagcaccaaacuggcuauauauagaaacagcagauggugacggaguaccaggcaaaagaacaaacucucgccagagaaagauucaggaaauauaugugaaugcugcacaagaacucauaacuggaagcguacggggugaacuugaagacaagauagcaagcagagcagauuucacagaccgauuagucuuauauuucaugcaagggggaagagauauauacacaggcgaaccacuuaauauagacaaucuauccucuuaugacauagaccauauucuaccacaauccuuaauuaaagauaacucacuugacaauaggguauuaguacaucccuuaguaaaucgagaaaaagacacaaucuucgcauccacucgcuuugcaaaacaaaugaauggaauguggcgacaguggcacgcagcagguuuaauuagcagucgaaaacuacgaaacuuacaaaugagacccgacgaaauugacaaauaugccucugguuucguagccagacagcuaguagaaacuagacaaauuauaaaauuaacagaacaaaucguugcugaccaauacccagacgcaaaaauuauagcuguuaaagcaggacuaucaucucaacuacggaaagagcuggacuuccccaaaaacagggaagucaaccacuaccaucaugcauuugaugcuuuccuagcagccagaaucggaacauaucugcuaaaacgcuacccaaaccucgaaccauucuuuacauacggaaaauuuaagaaaacagaaguaaagaaauuaaaaaguuucaauuucauaagagacaugacacaugcaaaagauaaaauugucgccaaagaaaccggagaaaucguaugggauaacgcaucagauauaaaugaacucgauagaauauauaauuucaaacguaugcugauuacgcaugaaguaagauuugaaacagcgucauuauucaaacaaacauuguaugcagccaaaaacaguaaaaauagaggaggcucaagacaauuaauaccgaaaaagaaaggauauuuaguagauaucuauggagguuauacucaagaaacaggaucauacuuaucuguagucaggcuaacuaagaaagcaauguacgccguagugaaaguuagcacccgagaugccgcgaaauuagcaguagccaaaucuauaucggaacaaaaagaaaaugaaacacuaaagaaaauaauugacgguaaauuaucuaaaacauccaaaaaggguaaaaccacucaucaauuauuugaaauuguauuaccacgcgucggacagaaaacuuuauuuaaaaauucuaaauacaaucaauuccuaguaaacagugauaccuacaugcacaauuaucaagaauuauggaugccaagagaauaucaaaggauguggaaagacauacuucuaaguaaccacggagaugcucaauuagaaggccaauuagaucaaauauucaaauucauagucagucaaguaaauaguuacuuuaauuuauaugacaucaaucaauuccgaaagaaaauugcagaugcuacugacaaauuugccaaauugccuacccacgauacagauaaugcccgagguaaaauagccacaaucggacaacuuuuaauaggacuccaagccaaugcaaugaggucagaucuaagaaacuuggauauaaaaacuccuuucggccucuugcaaaucgguacaggaauaacccuugauuuagauacauccauaauauaucaaucuccaacaggacuauuugaacgagaaguacccuuaacugacuuguga

SEQ ID NO: 5380 - RNA, 4083 nt, Artificial Sequence
  Cas9 variant
augacaaaacuuaaucaaccguauggaauagggcuagacauaggaucaagcagcauaggcuuugcuguaguugaugcuaacagccaucuauuaagacuaaaaggagaaacagcaauaggagccagauuauucagggaaggagaaucagccgcagguagacgcgccaguagaacgaccagacggagacucucacacaauagauggagauuaagauuccuucaagacuuuuucgauccacauaucucuaguauagacccagacuucuuucuccgacaaaaauacagcgaaauaucaccaaaagauaaagaacgauuuaaauaugagaaaagguuauuuaacgacagaaccgaugcacaauuuuauaaacaauauccuacaauguaucauuugagacuacaccuuaugaaugaugcaaguaaagcugacccacgagaaaucuucuuugccauacaucauauacuaaaaucacguggacauuuucuaaccccaggugacgcuaaaaauuuuaauacagacgacguagacuugaagcauauauucccagcacuaacagaagccuacgcacaagcauauccagaccuaacauugaguuuugaaccaaguaaagccgagaaauucaaaaguauuuuacucgaugaagaugccaccagcaacgauacucagaaagcccuagugaaacuucuacuaucggacgauggagacaaagaagucuuaaaacaacaaaagaagguucuaacagaguucgcaaaagccguagcuggacuuaaaguaaaauuuaauguagcacuagguauagaaguuacugaugcugauguugaaaaauggcacuuugggauggcacaacuagaagauaaauggagcgacaucgaacccagccuuacugaucaagguauggaaauuuuugaacaaauacaggacuuauacagagcuagacuacuaaauggcauagucccagccgguaaaacauuaucacaagcaaaaguagacgauuacgaucaacacugcaaggaccuaaaacuuuucaaagaauaccuaaaacaauuaaaugaucaugaucuagcaaaacgcauacgauuacuuuacgaucgauauauagauggcgaugaugcuaagccguuuuuacgcgaugacuuuguuaaagcauuaaagaaagaagugacagcgcaucccaccgaacucgccgaaucacuauuagagagaauggaacaagacaacuuuaugcuuaaacaaagaacuaaggcaaaugggucaauaccuguacaaaugcaacagcgagaacuagauaaaauaauugcaaaucaagcagaauacuacucuuggcuagcagcagaaaacccugucaaagaacauagagacucgaaaccguaucaauuagacgaacuauuaaacuuuagaauaccauauuauguagguccaaugauaaccaagaaacaacaagaaaaaucaggccaaaacguguucgcauggaugguacgaaaagauccuaguggaaauauaacaccuuauaacuucgacgaaaaaguugacagggaagccagcgccaaugccuuuauacagagaaugaaaacaacagacacauauuuaauuggagaagacguacucccaaaacagagucuacuauaucagaaauacgaaguacuuaaugaauuaaauaacguacgaguaaacggcgaauccuuaagcacagaccaaaagaaaagauuaauaagagaacuguucgaacgacacucauccguuacauuaaaacaauuuguagaaaacuuaguggcacauggagauguggcaaaacgaccugacguaagaggacucgccgacgagaaacgauuuuugagcucgcuuucaacauaucaucaacuacgaggaauccuacacgacgcaauagaugauaggggaaaacaauccgacauagaaaauauaauaacauggagcacaguauuugaagaugcaagcauauuuaaaucuaaacuaggagaaauuucauggcuggauucaaaaacacgaacaacguuaucuaauauacgauaucguggauggggacaauucucuagaaaauuacuugacggccuaaaacuagggaacggacacacaauuauacaggaguuaaugcucucaucaagaaauuuaaugcaaauauuaaccgaugaaacacucaagaaagagauggcuacacuaaaucaagaacgauuaaaacccgacagcauaaaugaagccauugaugcugcauacacaucucccucaaauaagaaagcgauacgucaaguuuuaaaaguagucgaugauauuaagcaugcagcgaacgaccaggcacccaguugguuauacauagaaacggccgauggagggggacauccaggaaagcgaacacuaucucgccaaaaacaaauacaagcaauauaugagaacacagcuaaagaauuaauugauuccgcuguaagaggggaauuaaaagacaaaauagcagacaaaacaaauuucagugacagguugguacuauacuuuaugcaagguggacaugacauuuacacuggaacagcuuuaaacaucgaccaauuaucuaguuacgauauugaccauauauuaccucaaucacuaauaaaagacgacucucuagauaaccgaguauuaguucaugcaaaaauaaaccgagaaaagaacgccgaguucgcaucaacccuauucgcagcaaaaauggcaucaacguggcauagguggcgugacgccgggcuaauuucagggagaaaacuuaaaaauuuauuaaugaggccagaugaagucgacaaauaugcgaaaggauuuguugcucgacaguuagucgaaacaagacaaauuauaaaauuaaccgaacaaauuguagccgcacaauaccccgacacaaaaauaauagcuguaaaagcuggauugagccaccaacuacgacaagaacuugacuuucccaaaaauagagaugucaaccacuaucaucacgccuuugaugcauuuuuggcagcaagaauaggaacauaccucuuaaaacgcuauccaaacuuggcgccauucuuuacguauggagaauuuacgaagacuaauuuaaagaaacuacaaucguuuaauuuuauaggcgcguuaacacacacagacgguaaaaucacuucuaaagacacaggggaaguccuaugggacaaccaaagagauauagaggaacuagaccaaauuuacaauuuuaaacguaugcuaauuacacacgaaguuuacuucgaaacagcagggcuauuuaaacagacaguauacgcagcaaaagacucuaaagagcguggcgguucgcgucaacuaauaccaaagaagaaaggauacagcacaggaauuuauggcggguauacacaggaaacaggguccuauaaugcucuaguaaggcuaacaaaagcagguaaaguuguuuacagagucuucaaaauuagcacacaaaacgcagcugaaauugcagccgcaagaaguuuauccgccgaagaaggaaaugaaagauuaugccaaauacuugaacaaucuuuacuaaaaacgaauaaagacaagaaaaacaccguugaccuuuucgauguaguuauuccacgauuagguaaagaagcacuauuucauaauaguaaauauggcuuguuucucgugaauagcgacacguauuaucauaauuaccaagaacuauggcuaucacgcgagaaccagaaaauccuaaagaaacuauuuucaacaaaauacgaucaaagugaaauggacagagacgcauuacauuuauucgaaacaauagcuaaacaaguagaacaauucuuuaaacuauacgauauaaaucaauucagaacaaaaauuagcucugccuuugaugccuuugaaaaauuacccguugaaggagaagaagggaaaguggagacacuaaaacaacuacucauuggacuacaugcaaauccuguacgaucagaucuuaaaaaucuagggauaaaaacacccuuuggguuuuuacaagcaggaaaaggcauacaccucgaugaugauacugaaaucauacaacaaucaccagcaggacuauucaaacgacgaguaaggcucgcggauuuauga

SEQ ID NO: 5381 - RNA, 4086 nt, Artificial Sequence
  Cas9 variant
augacaaaauuaggaaaaccauauggaauaggaguagauauaggaucaaacucuaucggauuugcagcuguagaugaaaauagucaccuaauaagacuaaaagggaaaacaguaauaggagccagguuauuugaggaagguaaagcagcggccgaccgccgagcuagucgcaccacuaggagacgacuaucuagaaacagauggcggcuaucauuccuucgggacuucuuugaaucccauauaacaccuacaggaccuaacuuuuucaugcgccaaaaauacucagaaauauccccuaaagauaaagcaagauauaaauaugagaaaagauuauuuaacgauaggaccgacgcugaauuuuaccaacaauaucccacuauguaccacuuaagaaaucgacuucuaaccgauccaucuaaagcagauguacgggaaauauauuucgccauccaccacauacuuaaaucaagaggacacuuuuuaacgagcggcuaugcaaaagauuucaauaccaauaaaguugcacuuaaugaaauuuuuccagcgcuucaggacgcauaugcacaaguauauccagauuuggauauaacauucgaugaaaauaaagucaacgaguucaaaacaguacuauugaaugaaaaagcuacaccaucugacacacaaagagcacucgugaauuuacuccuagccgaagauggugauaaagauaucuuaaaacaacaaaaacaaguacuuacugaauuugcaaaggcuguaguaggucucaagacaaaauuaaacguugcucuuggaaccgaaguagauagcuccgaagcaacaguuuggaauuuuucacuuggacaacuagaugauaaaugggccggcauugaaucagccaugacagaugaaggcaccgaaauacuagaccaaauaagagaccuauaccgagcuagacuacuaaacgggauagucccugcaggaaaaacccuaucacaagcgaaaguugaugauuacgcacaacaucacgaagaccuugaacuguuuaaagacuaucuaaaacaauuagaagacgacgguacugccaaagcaauaaggcaguuauacgacagauauauagacggagacgacgcaaaaccuuuuguccgagaagacuucguaaaggcauuaacuaaagaaguuacagcucaccccaaugcaaaaagcccagaacucuuagagaggcuagcacaaccagacuuuaugcugaaacaacgcaauaaagcaaauggggcaauucccguacaaaugcaacaaagagaauuagaccaaauuauuaaaaaucaaaguguauacuacgauuggcuagcugccccaaauccaguagagaaacaucgaaaaaguaugccauaucaauuagacgaacuauuaaacuucagaauaccauacuacguaggcccccuaguaacagcaaaagaacaaaaggccgcacaggguggcguguucgcguggaugguuagaaaagauccagacggaaacauaacaccauauaacuucgaugaaaaaguagaucgagaagcaagugcaaauacguucauucaaagaaugaaaacuacagacacauaccuaaucggcgaagauguacuaccaaaacaaaguuuauuguaccaaagauacgaaguacuaaacgaauuaaacaauguacguguuaauaaugaaaagcuaucaauugaacaaaagcaacaagugauaagagaacuuuuugaaagacauaauaguguuacuauuaaacaauucgccgaaaaccuacgcgcacauggagacuaugcccauauuccagaaauaagaggccuagcggacgaaaaacgguuccucucuagcuuaucaacauaccgccaauuaaaaucauuguuacccgaugccauagaugauccagcuaaacaagcagauaucgaaaauauaauagcauggagcacaguuuuugaagaugcagcaauuuuuaaaacaaaacuuaaagaaauaaauugguuagauagccaaacaauaacuaaacuuaguaauauaagguaccgagguuggggucaguuuucucauaaauuucucaauggacuuacacuagguaaugggcacacuaucauucaagaguuguuucuuaguaauaauaauuuaaugcaaauauuaaccgaugaaacucuccaaaagaaaaugacagaacugaacgcagauaaacuuaaagcugccaacauuaaugacgcgauagaugaugcauauacgagccccucaaauaaaaaggccuuaagacaagucuuaaggguaauagaagauauuaaaagagcagccgacggccaagauccaaguugguuauacguugaaacagcagaugguggagggaccccagguaaaagaacacgagcacgucaacaccaauuacaagaaaucuacgcaaaugcagcucacgaacucauagacagcgcaguuagaggugagcucgaagauaaaauagcugauaaagcagacuucaacgauaggcuuguacucuacuucaugcaagguggccgugauauauacacagguacaccacuaaauauagaccaacuauccucauacgauauagaccauauucuaccacaaagucuaauaaaagauaauucauuagauaauagagugcucguacacgcuauaauaaauagagagaaaaaugccacuuuugcaucaacgauauacgcacaaaagaugaaugcaacuuggcggcaauggcaugaagcuggucucauuaguggacgaaaauuaagaaaccugcagaugaggccggaucaaauagacaaauacgccucuggauuugucgcuagacaauuagucgaaacccgacaaauaauaaagcugacagagcaaauuguagccgcacaauauccugaaacaaaaauaauugccguaaaagccggauuaagccaccaacucagggaagaauuagaauuuccuaaaaaucgcgauguaaaucauuaccaccaugcguucgaugcguucuuagcagccagaauaggcaccuaccuccucaagagauucccaaacuuacaggcauucuuuacauauggcaaauuuaagaaagcugauguuaagaaacuucgcggcuuuaauuuuauccgugauauaacacaugcagaagauaaaaucgucgugaaagauaccggcgagguuaucugggauaagaaaagagacguugaugaauuagaucgaauuuacaacuucaaacggauguuaauaacacaugagguccacuuugaaaaagccgaccuguuuaaacaaacuguuuauggagcaaaagacucaaaagaggcugggggaaagaaacaauuaauaagcaagaagaaaggauauccaguagacauauauggaggauauacacaagaaacuggcagcuaucuaucaguagucaggcuaacaaagaaagccauguacgccguuguaaaaguaagcacaagagacgcagcuaaacuagccguagccaaaucaauuagugaacaaaaagaaaacgaaacucuuaaugauauaaucgaugaaaaacuaucaaaaauaaguaaaaacggaaaaauaacucaugagcuauucgaaguaguacuaccacgggugggucagaaaacauuauuuaaaaauucaaaauacaaucucuuccucguaaauucagacacguacaugcacaauuaccaagaacuauggaugccacgagaauaccagaaaauguggaaagauauaucacuaucgaaauauggagacgcacaaacagaagaucaacuugaucaaauauucggcuuuauagucagucaagucaacucuuauuuuaaucuauaugacauaaaucaauuuagaaagaaauuaaaugacgcagcagauaaauucgcaacccuaccaaugcgagauacugaugacaugcaagggaaaauagcaaccauagggcaacuacuaaucggacuucaagccaaugcagcucgaagcgaccuccgaaauuuagauauaaaaacaccauuaggauuauuacaaauaccaaacggaauaucauuggacagugacacuuccguaguuuaucaaagcccaacaggacucuuagaacgggaaguccauuuaagugacuuauga

SEQ ID NO: 5382 - RNA, 4086 nt, Artificial Sequence
  Cas9 variant
augaagaaacccuacagcauuggucuggauauaggaacaaacucagucggaugguccguagugaccgacgacuacaaaguaccagcgaagaaaaugaaagucuuggguaauacagauaaagaauacaucaagaaaaacuuaauaggagcacuauuauuugauaguggggagacggcugaggcaacucgaaugaaaagaacagcacgcagacgauacaccagaaggagaaacaggauauuauauuugcaagacauauuuuccccugaacuaaaccaaguugacgaauccuucuugcacagguuggaugauucguuucucguugcagaagauaaaagaggugaaagacauguuauuuucgguaacauugcggaugagguaaaauaccauaaagaauuuccaacuauauaccauuuaagaaaacauuuagccgauucaagcgaaaaagcggacuuaagacuuguuuaccuagcacuagcacauaucauaaaauaucgaggacacuucuuaauagacgaaccaaucgauauaagaaacaugaacucacagaaccuuuucaaagaguuuuuguuagcuuuugaugguauacaaguagauuguuacuuagcgucaaaacacacugacauauccggaauaaucacagcaaaaauaucgaaaucucgaaaaguagaagcaguccuagaacaauuuccagaccaaaagaaaaacuccuucuucgguaacaugguuagucuaguauucggucucaugccaaauuucaaaucaaacuuugaauuagaugaagaugccaaacuacaauucucaagagauucauaugacgaagaccuggaaaaccuccuaggaaucauaggagaugaauaugccgacguauuuguggccgcuaagaaaguauacgacucaauucuauuaucuggaauauuaaccaccaacaaucacucuacaaaagcuccacuuagcgccucaaugauagaccgcuacgacgaacacaacucagauaagaaacuacucagagacuuuauuagaacaaacauagguaaagaagucuuuaaagaagucuuuuacgauacgagcaaaaacggauaugcaggauauauagauggcaaaacaaaccaagaagacuuuuacaaauauuugaaaaaccuacuacaaaaaguugauggaggagauuacuuuaucgagaaaauagaaagagaagauuuccuacguaaacagagaacauuugacaauggaucaauaccacaccaaguacaucuugacgaaaugaaagcaauauuaagacgacaaggagaguucuaucccuuucucaaagaaaaugccgagaaaauacaacaaauacuaacguucaaaauaccauacuauguaggaccgcuggcuagagguaauucacguuucgcaugggccagcuacaacagcaacgagaaaaugacccccuggaacuucgauaacgucauugauaaaaccucaagugcacaagcguucauugaaagaaugacaaacaaugauuuauauuuaccugaucagaaaguacucccaaaacauucacuauuauaccaaaaauucgcgguauauaacgaacuaacaaaaaucaaauauguaacagaaacaggagaagcaagauuauucgacguguucuuaaagaaagaaauauuugacggacuauuuaagaaagaacgaaaagugacgaaaaagaaaauuuuaaacuuccucgauaaaaacuucgacgaauuucgcauaacagacauccagggcuuagacaaugaaacaggaaauuuuaacgcuucauauggaacauaucacgaccuuuugaaaauaaucggcgacaaagaauuuauggacuccuccgacaacgucgacguauuagaagauauagugcuuagccuaacuuuauucgaagaucgugaaaugauaaaacaacgacuucuaaaauaugaagauauauuuagcaagaaaguuaucgcaaaucuuacucgaagacauuauacgggcuggggacgucucagugcaaaacugaucaauggaauaaaagauaaacauaguagaaaaacgaucuuagacuauuuaauagaugacggucacucaaauagaaacuucaugcaacuaaucaaugacgauaauuuaucuuuuaaagacgagauagcaaauagucaagucauaggagauggagaugauuuacaccaaguuguacaggaacuagccggcucaccagcgauaaagaaagguauauuacaaucucuuaaaauuguagacgaacucguaaaaguaaugggauacaacccagaacaaauaguugucgaaauggcacgugaaaaccaaacaaccgcucgaggaagaaacaacucacaacaaagacuaggaagccucacaaaagcuauacaggauuuugguucagauauacuuaaaagauacccaguagagaacaaucaacuacaaaacgaccaacuauaucuauacuaucuccaaaaugguaaagauauguauacaggugacacgcuagacauacauaaccuaagccaauacgacauagaccauauaauaccacaaucauucaucaaagauaauagucucgauaacagaguauugaccaauucaaaaucaaaccgcgggaaaagcgacaauguaccaucaaacgaaguagucaaaagaaugaaaggcuucuggcucaaacaauuagaugcgaaauuaauaagucaaagaaaauucgacaaucuaacaaaagcagaacgaggaggacuaagugcagaagacaaagcgggcuucauaaaacgacaauuaguagaaacccgccaaauaacuaaacacgucgcucgcauacuagacgaaagguuuaacagagauuuugauaaaaacgacaaaagaaucagaaacguaaagauuguaacacuaaaaucaaacuuaguaucaaacuuccguaaagaauuuggauucuauaaaguucgcgaaauaaacaacuuucaccacgcacacgaugcauaccuaaaugccgucguagcaaaagcucuguuaauaagguaccccaaauuagagccagaguucguguauggagaauauccuaaguacaauagcuacagagaacgaaaaucagcuacagagaaaauguucuucuacaguaacaucaugaacauguucaaaacuacaauaaaacuagcagacgguagagucguugaaaaacccguaauagaagcaaacgaagaaaccggagagauagcuugggacaaaacaaaacauuuugcaaauguaaagaaaguucuaucauacccccaaguaaguauagugaagaaaguagaagaacaaacugguggauucuccaaagagucgauauugccuaaaggaggaucagacaaacucaucgcuagaaagaccaaaaacaacuaucuaucaacacaaaaguacggaggauucgauucaccuacaguagcauauaguauaauguucguagcggacaucgaaaaagguaaaaguaaaagacuaaaaacaguaaaagaaaugauuggaaucacaauaauggaacggucaagauucgaaucuaauagcguaacauuccuagaagaaaaaggauacagaaacauaagagagaacacuauaauaaaauuccccaaauauucauuguuugaacuagaaaauggucguagaagacuauuagcaagcgcaauagaacuacaaaaagggaacgaaauguuuuuaccccagcaauuuguaaacuuacuauaucaugcacaacaugcuaacaaagaagacucaguaauauauuuagagaaacauagacacgaacuaucugaacuuuuccaccacauaauaggcguuagcgagaaaaccauuuuaaaaccuaaaguagaaaugacguuaaaugaagcauucgaaaaacacuucgaauuugacgaaguaagcgaacucgcccaaucauucaucuccuuacucaaauucacagcauucggugccccuggaggauucaaauuuuuggacgccgacauaaaacaaaguaauuugagauaucaaacaguaacagaaguucuuucaucaacccuaauacaucaaagcguaacgggauuauacgaaaccagaauagaccucucaaagcucggaggcgaauga

SEQ ID NO: 5383 - RNA, 4086 nt, Artificial Sequence
  Cas9 variant
augggaaacuauuaucuaggacuagacaucggcacuaacucuguuggaugggcugucacugaugagaauuacaacauagaacgguucaaaaagaaaaauauguggggaauccgacucuucgacgaagcuaaaaccgccgaaucaagacgcauacauaggcaagcucgcagaaugagacaaaggaaaauccaacgacucaacuuacuaauggaacuauuugacguagaaauauccaaggucgacgaaagcuucuucauacgaaaaaaagaaagcgaccuccauuaugaagacaaaagucaagacucccgauacgcauuauucaacgauaaagaauucaaugacaaggauuaucacaacaaauauccaacuauauuccaccuaauaauggaccuuauagaaaacgacgaaaaaaaagauaucagacuucucuauuuagcaugccauuaucuaauaaaaaaucggggacauuucauauucgaaggucaaaaauucgacgugaacucaucuuuaaacaauaacauaaacaaauuaaaaucacacuuagaccaauucuauaauauaugucuagauuucgacaacgacaaacuaauagaaauacuaguuaaccaaaaucucaacauaucagaaaaaagcaaaaaaaucaaagagcuacuacgaaaaaccaaccuugaaguaggaauugcgaaccuaauagcaggaggaucaaucaaauuauccaauauguucgacgacgacgaacuaaaaaaccuugauuauaacucauuaaguuucaaaaauucuaacuucgaugaaggaagagaguuauuugaggaaguacuagaagaucgcuucgaacuuguagaaaucuuaaaagacauucaugacgcuagcguauuagaaacaaugcuauccagugcaucaauaagcccagacgguggaaaauacauaucuucaagcaugaucaacagcuacaacaaacauaaaagggaccucaaauuacuaaaaaaaauaauaaaaaaauauaaaaaaucagaauaugauaauauauuucgggacgagaauauaaaaaacaauuacuuaucauauaccaggacaggaauaaacaaaaauaaaaaaguccaagccgaagacaauacagauagcgacgguuuuuacaaauauauagugaagauccucaaagauaucaaagaaaaugauucagacgaagacaucaaauacauccucucagaaauagacaaaaaaaauuuuguucccaaacaaaggacaaaagaaaacuccgucauaccauaucagcuacgagaaauagaacuaagaaaaauaauugacaaccaaucaaaauaucacaaauuucucaacgaaguagaugaaaaaggaauaagcgucaaagaaaaaauaauaucucucuugaccuuccgaauaccuuacuauauuggaccucuaaacccaagcuacaaugaagaaaagaacuucaccaccucuuggguaaaaaggcuagcaaaagguaaagucacaccguggaacuuugaagauaugguagacaucgacgcuagcagagaggcauucauagaaaacaaacuuaacaaaugcucauuucuuuuagacgaaacaguucucccaaaggacucauuauuauaucaagaauacaugguccucaacgaacucaacaaccuaaaaauaaacggacagucaauaaacaccgacuuaaaaaaauccauauacgaagaacuauucaaaaaauacaaaaaagugacacgcaaacgauuaauaaguuacauaaaagaaaaagaaaauaugagcggcgauauaguaauaacaggaauagauggggacuuuaaacagggacugaaaagcuauauugccuucaaagacaucauuggugaaaaaauagacgacgacauuuaucgcaaagaaguagagaaaauuauuagggauauaucauuauauggagaugacaaaucuuuuauucaaaagaaaauuaaaaaugaaaacaagcuagacuuauccgaugaucaaaucuccaaaauagccaaauuaaaauuuaaagauuggggacgcuuuucuaaaaaacuucuaguagggauaaaggcaucagacaaaaacacuggcgaaauagacaauauuauaggauuuaugcguaauuauaacuacaacauuaugcaacuaauggcaaacgucuucaccuuuaaagaugaaaucgaaaaauuaaacaguaaauauuacacagacgaaaaaaucaacaucgacuaucuagacgacuuauaucucucaucaccagcaaaaagaauguuauggcaaagcuuucaaauuguagaugaaauuaaaaacaucaaaaacucggacccaaaaaagaucuuuauagaaauggccagaagcaaagaagauaagccaacaagaaaaaugucucguaaaagccgcuuagagaaacucuauaccgacaguaagaaacaauuuauuaagcuauucggaccagaugaauaugacaaacuaaacaaugaaauuaaaaauaaaagcgaaagugacuuuagaugggacaaucuuuaccucuacuauacacaauuuggcagaugcauguauagccuagauccaauugauuuagaagaacuguccaacaaaaauuuauacgaccaagaccacauauauccaaaaucaaagauauacgacgauuccauagaaaauagaguuuuaguaaaaaaacaacucaaucuagauaaaagcaaugaauacccaauaccagaucgaguauugaacaaagauaagaauaaacuauuagcauuuuggaaaauguuaaacgaaaaggaauuaauaggagacaaaaaauaugcaagacuaauaagaaaaagccccuucacagacgaagaacugggggauuucaucgccagacaacugguagaaacacgacaagcaacaaaagagaccgcaaauauguuaaaacgcuuaugccccgacaguaaaauaguauauguuaaagcaaagaauguaagugacuucagaagaaaauuugacaucuuaaaaugcagaucaaucaaugaccuacaucaugcacaugacgcguacuuaaacauagugguagggaacguauucgacacaaaauucacaagcaacccucuaaacuuuauaaagaacaauucgaaaaacaggaguuauaaucuagaaaaaauuuacgauuaugauguaauacgaaaugaaaaaaucgcaugguuagcugaaagaaaagaagaaaaccaagacggcucaaucgcaaccgugcucaaaaacuuauccaagaacgauauaagaguaacacgacgaacguacaucaaaugugaggaucuauucgaugaaaauaucgugcgaaaaggcaauggaaaauucccaauaaaagaaaauaauaauaaaucagauaccaauaaauacgguggauacucaggaaucaaaaaugcauacuuugucuuacuagaagacgaaaaacauaacagaauucuagaagcuaucccaucauucauauacaaaaaagagaaaaacggcgaaaaaggcucagucauuaacuacuugcaaaacauauuaggaauaaaauccgcaaaaauccuaagagacaaaauaaaaaucggaagcuugcucaagaucgacaaauuucccuacaaccuagcaggaaaauccggaaacggcauccuuauaucaggcggaguacaacuuauacucgacaagaacacuagcaaauacauaaaaaaaaucgaaaauuacaaauacaaacucgaugaaaacaaggauuaccagaucaauauauuugauaagcuaagcaaagaggaaaacauuaaauuauuugaccuauucguagauaaauuugaaaacagcauauacaaaaaucgcguaaacauuaaguuaaaggagauaaaacucgcacgccccaaauuugaacacuuaucuauagaagaacaaauaaaaacauuaacacaaauguuaauauuauucggaagagaaaauaaugcuguaaaucuugaauacauuggauugccaaaaaacacaggaaaaacaaagauaaacaaaaaaauaaauaacaaggacaucaaaauaaucaaucaaucaauaaccggacuauacgaaaccgaagaagaccuagcuaacaucuga

SEQ ID NO: 5384 - RNA, 4086 nt, Artificial Sequence
  Cas9 variant
augacuaaauuaaaucaaccuuauggcauugguuuagacauagggagcaacagcauuggauuugcaguuguugaugcaaacagucaucuauuacgacuaaaaggagagacugcaaucggagccagacucuuccgagagggacaauccgcagcagaacgaagagaaucacgcacgacaagacgaagauuaagcagaacacgauggcgucucucuuucuugcgcgacuuuuucgcaccacacauaacaaaaauagauccagauuucuuucuuagacaaaaauacagugaaaucaguccaaaagauaaagacagauuuaaguacgaaaagagauuguuuaaugauaggacagaugcugaguucuaugaagacuacccaagcauguaccauuuaaggcuacaucuaaugacacauacucauaaagcagauccacgagaaauauucuuagccauccaccacauacuaaaaaguagaggccacuuccuaacacccggagcagcaaaagacuucaacaccgacaagguagaucuagaagauauauucccagcauuaacagaagccuaugcacaaguuuaucccgaucucgaauuaacguuugaccuagcaaaggcugaugauuucaaagcgaaauuacuagaugaacaagcaacaccgagugauacgcaaaaagcgcuaguaaaccucuuacuaucaagugauggagaaaaagaaauaguaaagaaaagaaaacaaguacuuacagaguucgcaaaagcuauuacuggauuaaaaacuaaauucaaucucgcauuagggacugaaguagacgaagcugaugcuucuaacuggcaauuuagcaugggacaacuggacgauaaauggaguaacauugaaaccagcaugacagaccaagguacggaaauauuugaacaaauccaagaguuauauagagcccgacugcucaauggaauaguaccugcagggaugucuuuaagccaggcgaaaguagcugacuacggacaacacaaagaggauuuagaauuguucaaaacuuauuuaaagaaauuaaaugaucacgaauuggcaaaaacaauaagaggacuauaugauagauauauuaacggagaugacgcaaaaccauuucugagagaagacuuuguuaaagcucuaacaaaagaaguaacugcacacccaaacgaaguuucagagcaacuauugaaccgaaugggacaagcaaacuuuaugcuuaaacaacguacaaaagcaaacggugcuaucccugugcaacuccaacaaagagaacuagaccaaauuauugcgaaccaauccaaauauuacgacuggcucgcaaaaccaaaccccgucgaaaaacauagagcaucgaaaccauaccaauuagacgaacuucuaaccuuccgaaucccauacuacguuggcccacucauaacuccgaaagaacaagcagaaagccgcgaaaacguguuugcguggaugauaagaaaagacccaucagguaauauuacaccguauaauuuugacgaaaaggucgauuguccugcuagcgcuaacauguucauacaaagaaugaaaaauacagauacauauuugauuggcgaagacguacugccaaaaagauccuuacucuaccaaaaauaugaaguucuaaaugaacugaacaacgucucaauagacgguaggagauuaggagcagaucaaaaacaaagauuaauaagagaaguauucgaacgccacuccagugucacaauaaagcagguagcggaaaaucuaguagcgcauggagacuucgcaaaaagaccagagauacgaggauuagccgacgagaaaagauuucuaucaucccuuaguacuuaccaucaacuaaagaaaauacuacaugaagcaaucgacgauccuacaaaagaacacgacaucgaaaacaucauaacauggucgacaguguuugaagacgcagccauauuuaaaaccgaauuagcaaaaauauccuggcucgacucugacacuaucaaagcauuaagcaacauccgauacagaggcuggggacaauucucaagaaaauugcuagacggccuaaaacuaggcaauggacauaccguaauccaagaacuaaugcuuaguaaucauaaccuaaugcaaauauugaccgacgaaacacucaagaccacaauggcagaauugaaucaggacaaauuaaaagcagaugacauagaagacgucauuaaugaugcauauaccucacccucgaauaagaaagcauuacgacagguauuaagaguuguagaagacauaaaacacgcggcaaacggccaagauccaagcugguuauauauagaaacugcugacggaccaggaacggccggaaaaagaacccaaucgagacaaaaacaaauucaaaccguauaugcaaacgcagcacaagaauuaauugacuccgcaguuagaggugaacuggaagauaagaucgcagacaaagcaucuuucacagaucgucuaguacuauacuucaugcaaggaggaagagacauauauaccggugcaccacuaaacauagaucagcuaagucauuacgacaucgaucacauucuuccacaaucauuaauuaaagacgauucacucgacaauagaguucuaguaaaugcaacgauaaacagagaaaagaacaacguguucgccuccacacuauuugcaagcaaaauggcggcaaccuggcgaaaauggcacgaagcagggcuuauaagcggacgaaaacuaaggaaccuuauguuaagaccagacgaaauagauaaauuugcacauggauuuguugcaagacaauuaguugaaacacgacagaucauaaaacuaacugaacaaauagcagcagcccaauauccaaauacaaaaauaauagcagugaaagcaggucuaagucaucaguuacgagaggaacuagacuuuccuaaaaauagagauguuaaucacuaucaucaugccuuugacgcauuucuugccgcucgcaucgguaccuauuuauuaaaaagauacccaaaacuugcaccuuucuuuacauauggugaguuugcgaagguagacgugaagaaauuccgagaguucaauuucauaggagcacuaacccacgccaagaaaaauauuguugcgaaagauacaggugaaauagucugggauaaagaacgggauauacaggaauuagaucgaaucuauaacuuuaaaagaauguugauuacucaugaaguauauuuugaaacagcagaccuuuucaaacaaacaauauaugcagccaaagauagcaaagaacgggguggaaguaaacaacuaauaccuaagaaacaaggauaucccacgcaaguauaugggggauacacaagagaaaacacagcauaucuagcaguuguaaaaaccgucgaaaagaaagccgacguguaucgagucguucgaaucgccacaucacaggucgcugcauuaaaagaagccagagcccaaucaacaguaaaagaacgagaauugcuaaagaaauucuuaacgacaaaauuuacaaaaaucggcaaaaauggaaagaaagccauaaccccauucgauaucguaauuccgcgugugccuagagaacaauuauuucauaauaaaagguauggguucuuuaugguaaauagcgacaccuuaaugcauaacuaccaggaauuauggaugagccgaucggaccaacaaaucuugucgaaacucguaaaaucugcaaaaacuguugaaaauggucaaguaggcagacuauuugaaaacauaguugaacaaauuaacaaauacuuuccauuauaugauauaaaucaauuuagaaagaaauuagaccaaagcaaagacauauuuuccaaauuaccccuagaaggcaauggaacaaccucugguaaaagggaaacuauucaaaacauauuaaccggagcaggaacaggagccaaaaauggugaccucaaaaaccucgguauaaaaacaccauuuggauuucuacaaguccccagugguauuguguuagaugacgacacaacacuaauauaccaaagcccaacuggcauguuaaaccgaauagugagacucucagaauuauga

SEQ ID NO: 5385 - RNA, 4086 nt, Artificial Sequence
  Cas9 variant
augaaaaaugaagaaaacauauaucuuggacuagacauaggaacagauucaguaggauacgcaguaacagaugacaaauauaaaauaaugaaauaccauggaaacgcagcauggggauccacgauauuugacgcgggagcauugggugcagauagaagaguauuucgcagugcaagacgaagacuugacagaagacaagaacguauucaauugcuacaagaaauauuugcaaacgagaucgcaaaaguagacgaaagauucuuuauuagacuucuagaaucugggcuauggagagcagacgccgaagauagguacguauucuucaacgacaaagaauacaccgacgugcaauacaugagagacuacccaaccauacaccaccuaauuugugaacuaauauacaacccaaauaaacaugauguuagguuagucuacuuagcaugcgcauggcuaguaacucacagagggcacuucuuaaguaacauaaauacugaaaauauagccgauuuaguagauauacauaacguauauaacggauuuaugagauucuuugaagaaaacgaaauaauaugcgacuggagggaaguuaaugucgaagaacuagguagaguucuugcagcgaacauaggaauaaaugaaaaauacagaaacuuaaguacaguacucuuugcuacuagaaaaccggacaagaaagcaaaagaaggauuccccuacuccgaagacgcuauaguuagauugcuagcgggaggaacaugcaaauuaaaagauguauacauaaaagaagaauaugaugaauuuggaucaauaacauuaggaauggacgacgagaaaaugaccgaaaucauggccgacauaggagacgacuucgaucuaauaaaagcacuacgaucccuauaugacuggggaauacuagcaaacauuuuaguaaaugaaaauaacagcccauuaauaagucaaucaaaaguuaaaguauacgaacaacaccgagaagaccuggccaaccuuaaauauuuaguacacaaauauauuccccacaaauacaacgaaaucuuucgcgaaauccgaggugauaacuauguagcauacuccuaucauuacgagcuuaaaaaugacgagaaaauggguaagaaagcagacguugaaaaauuuucaaaauuucuacuaaaaauacuggaaggaauaucaguugaugaacaagacaaagucguauaugauaauaugaucgagagacuuaccuuaagacuauuuuugccaaaacagaaaaacacugacaauagaguaauaccacaucaauuguaugaauacgaauuaaaaucuauucucaaaaauaccaaaaauuacuuacccuuuuugaaagaaaaagacagugacggaauaaguaaugaagacaaaaucauaagcauauucaaauuuaaaaucccauauuuuguagggccucuaaauuguaauucacaauucgccuggauacaacgaaaagcagacgguaaaauauuuccauggaauuuugaagauaaaguagacuuugaugcaucugaacaagccuuuauccaaagaaugaccaaucaauguaccuauuuacccgaagaaagcguacuaccaaaacaaucauuauacuaucaaaaauucaugguacuuaacgaaauaaauaacauaaaaaucgacggaagaaaaauauccgucgccaugaaacaagaacuguacaaugaaauauucgagaaaaagaaacgcgucaggaagaaagauguaauagacuucuuuguuagcaacggauaccuagaaggaggaaaagaagcauugauaucgggacuagacgaacaaauacacacaaaccuaagcagcuuccacgcuuuccgaagauuacuacaaaaccacauauuaucaguagaagacgucgagagcauaaucgagcgagcaucauauuccgaugacaaacgaaggguuuuauuauuccucaaaaauaaauacucuuuccucacagacgaagauauuaaauauaucuguaaaaucaaaauaaaagacuucggacgauuaucgaagaaauuuuuaguugacuuugaggguacauguaaagaaacaggagaaaucaguacaguuuugcggcuuaugugggaaacgaauaacaaucuuauggaauuacugucagacaaauacacguuugccaauggaauaaaagaaaauagaaagaaauauuauacagaacaacagaaaacgcucgaugaucguuuagaugaaauguacauaucaaauagugugaaaagaacaauauacaggacucucagcgucguaaaagacguaacaaaagccuucggaguccccaagaaaauauucguagaaauggccagaacuaauaacccagaccugaaaggaaaaagaacucgaaccagacaacaacaaguaauagaacuauacgcaaaaugugacgaagaagacguaagagaauuaaaacaccaaauggaaagucuaggagaauauguagauaacaaacuacaaucugauaaauuguuucuauauuuuauccaauucggcaaaucagcauauucugguaaaaugauagaccucgaaaaacugaugagcggaucuaaaguuuacgacauagaacacauauauccacaagcauacguaaaagacgacagcaucauaaauaauaaagucuuaguauuuucagaagagaacggagcaaaacaagacaucuauccuauaaaaaccgaaauacgaaaacaaaugagcgggauauggaccacuuggcaccauguuggugcaauuuccgaugagaaauacaaacgacugacccgcucaaccccguuuaaugaagaugaaaaauacggcuuuauaaaucgacaacuaacugaaacaagccaaucaacaaaagcaauagcacaaauccuuaaugaaaaauacccagaaacugagauaguauacgucaaagcuggccuaguaagugacuuccgacaugaauuuggccuuuguaaauguaggagcuacaaugauuuacaccacgccaucgacgcauaccuaaaugucguaguaggaaacguuuacaacaugaaauuuaaucgaaaaugguuuucaguugauaguaaauauucaaucaaaacaaaaacaaucuuuagccacagccuaguaugcaacggaaaaauaauaugggauaaggagaaaaugcuacccaugguucucaaaaaugcuaagaaaaauaaugcccacuucacaaaguaccaauuuaugaaaaccgguggauuuuucgaccaaaugcccugcaaaaaggcauccggccuagucccgcgaaagaaaggauuagauacagaaagauauggaggauauaauaaaucagggauaauguuccuaacaccaaugcguuauaaaauagggaagaaaucagacauaauaauacuaagcauagaguuacucuaugguaaauuauuccuaaaagacgaaguauuugccaagaaauaugcggaagagagacuacagaaaauaauaggcaagaaagcagaugaaguaucauuuccaaugggaaugaaaccuuggaaaauaaacacagucuuaucauuagauggcuucaauguuugcauaacuggcauagguggcggaggcaaaugccucagugcacaaccuaucaugcaacuuucccugccauacgaacuagcaaaauauuugaagaaaauagaaaaauucguagagaaaaacaaaaauaacgcaaauuauauauaugaugaacaauaugauucagucucaguugaugaaaacauaaaacuuuaugaugucuaccucgauaaauuagaaaacucaauauacaacaagagaauaaacaguccagaagcaauucucaaaaauggaagagaaaaauuuuguaaacuaaacguauuagagcaagcaguaaccuuaauaaauauccaaucgaucuuuggccgaaugacagguggaugcgaucuagaaaauauaggaggcaagaaacauucagcagccacaguaaauuuuucaucaaauguuuccaacuggaagaaauacuauaacgauguaagagucguauaucaaaguccuagugggauaugggaaagaagaucucaaaacauacuagaacuucuuuga

SEQ ID NO: 5386 - RNA, 4086 nt, Artificial Sequence
  Cas9 variant
augaacgaacccuaugguguagguuuagacauagguacuaauaguguaggauggacuguaguugauaugaacggaagaguuagaaaaguaaaagguaaaacagcgcuaggagcacgccucuuuaaagaaggugcaacugccgaggaccgcagaggcuuccgaacgaccagacgaagacuaaaacgcgucaaguggagauuacggcuuuugcgagaauuuuuugaccaaccaauaucaaagauagauccaaauuuuuucgcuagacgaaaauacucagauauaucaccaagagaucccaauuacaauggucuagcaaaaacucucuucaaugaucgaacugacaaggaauuuuacgaugauuaugcuacaaucuaucacuuaagagacaaauuaaugacauccaacagaaaauuugacauaagggaaauauaucuggcuauacaucauauaguuaaauauagaggaaacuucuuacgcacaggaccagcaagccaauauggcuccgccucacuacaccuagcaacaaguuuucaaaaacuaaacgaucuguucgcucaaagcgaagaaacucuuaaucuaaaauuggugacagaugaagcauuauuacaacaaauacaacaaauacucguaagaacugauuuaaguagaagcgaacaacaacgacaaaucuggccccugauggcuguccuaaccggagccucagcagcggagaaaaaaagacaaaaaaacguuguaguagagcuuaguaaagccuuaguaggacuaaaagcuaagaugaaugugguaacuuuaacugaaguugacgcugcaguagucaaagauuggacguucaccauggaagaaagccaagacaaauuaccggagauugaagaacaacuaagugaagucgggcaacaaauaauggaugaggucauccaauuguaugcaucaguaaaucuagcucagcuaauaccagcugguaaacgauuuagucaacauaugguagaaaaauacaaacaucaugaaaaaaaccucgaacuacuuaaagcauacauacauucacaauccgacagcaagaggggccgggaaaucagagccaccuaugaucgauauauugauggcguagauucuaaaccaguaacucaagaaauguuuuauaaggauuugaugaaauauguagaagccgaugcgaccucuaaccaccucgcagcugagauaaaagacgaaauugauagugaacaauucaugcccaaauugcgaaccaaacaaaaugguucgauccccuaucagguucagcaauaugaacucgaccaaauaaucucacaccaaaaaaaauauuaucccuggcuaggagaagaaaauccaguggcagaaagaagaggcaaauuuccguauaaacuugaugaacuaguuggauuuagaguacccuacuacguuggaccacuaaucacaaaggaagaucaacaggcaacaucaggagcuggauuugcauggaugguuagaaaagcagauggaccaauaacacccuggaacuucgaucaaaaaguagauagaauugcaagugcaacagccuuuauacaaagaaugcaaacaacagauacauaucugauuggcgaagacguacuaccagcacgaucacuuauuuaucaacgauuuaugguacucaaugaguuaaauaacaugagaguugaagacagaaaacuugccccccaacaaaaacagagguuauauaaccaaguauuuaagcaacaccaacacguaucaguaaagaacauacaacaaaaccuaauggaugccggggaauauagaaaaacuccccaaauaacaggccuugcagauccaaagggauuuaacucuucucucaguacauaccacgacuucaagaaaauacuucuugaggcaauugcugacgaacauaaaagagcugauauagaaaaaauaauacuauggagcaccacauuugaagauucugcaauauucaaacaaaaacuagaagaaguugcauggcuaacagacgcacaaagaaaacaguuaucgggcuuaagauaccgcggauggggucaacuaagucauaaacuucuaacagcauuuaaagaugauaaaggcagaucaauuauggauggacugugggaaacuucugauaauuuuaugcaacucagaaaacagccagcaauagaaacacaaauaaaagaagcaaaucaggcaaacuuaacugacgccgauauccaagauacuauaaaugaauuauauacuaguccgcaaaauaaaaaagccaucagagaagucaugcuaguauuagacgacauaaaaaacgcaaugcacggccaaacacccaguuggaucuuuguugaggcugcuagaggaggaggaguagcaggccgaagaacacaaucccgaagcucucaaauagucgaagcauauaaaggaaccgcaaaagaaauugugucagaaaagguacaacacgaauuaaacgaaaaaauuaaagccaaagcugauuucaacaccaggcucguauuauauuuuuugcaaaacggucgagaucuauacacaaacgaagcaauaaauauagauaggcuuucagaauaugauauagaucacauuuuaccacaaucuuuagugaaagaugacucacuagacaauagaguccucaccagugcacgaaucaauagagaaaaaaaugacacauuugcaucagaaaaauuugggagaaaaaugggugcacaauggagagaauuacaucgaaauggccuaaugacacaaagaaaauuaaaacaucuauugaugagaccugacgaaauaagcaaacaugccacagauuucauaaaucgccaacuuguugaaacacgacaaguaauuaaacuugucgaagaacucauaucaagcgaauacccugcugccaguauuguagcaguuaaagcuaaccuaacgcaccaauuucgucaaaccuuuaauuuuccuaaacuuagagaagucaacgauuaccaucaugccuucgacgcuucacugacggcuuucauaggaauguaccuauuaaaacaauauccgaaacucgaaagauucuucguauauggaaaauuugcuaaacaaccaaucaaccuaacuagauuuaauaucauacggaaacuugccgucgcagagaaaccaaucgccaacauagagacaggcgagauauuaugggauaagacagcagacauuaaauacuucgaaaaacuuuacaauuauaagagacuacuagucacccacgagguaagagaaaacuacggagcuauguuuaagcagacauuauucaaagcaucauauaacaaauccaaaacuuuaguaccaaaaaaaaaucacauggaaaccuccgucuacggcggguacucaaaccaagaaacggcauacuuagccaucguacggauacccuuuaaaaguggauucaaguuuaucguagucggaauaccaacaagaaugguagcuaaaaucaaacauuaucagucacuaggggcaacucucaaucaagcaacccacaaaguaauagaaccaaaauucacaaaaauuucuagaaaaacaaaacaaacagugauaagugauuaugagguuguccuaccaaaaguuuaucuugaccaaguaguucgcgaccaaguaaaaggucaaauguaucgauucucuuuggguucggauaaagaauaccauaacguacaagaacuauauuuaccucuaagcauacaacaagcuuucguuggacauuacgaugaaucggacgaucaacgaucaaacgaccuagucaaaguuuacgacgcagcauuaaaacaacuccaacgauauuucccuuuacacuuauccaggaacuuugaucaaguagccucgcaggcgcaccaaucguucgagggacuaaaaaauaacguacaaacaagugauaaacaauuagguaaaaaggaaguacuaaauucacuauuuguaggucuacacgcuaacgcaacaaggucuaaucuaucaguccuagguaugaguaaagacuucggccgcauuaaaaguaauggcauuacacuaacugaccaagcagaaauuauuuaucaauccccuacaggauuguucgaacgcaaagucgcauuaaaagauuuauga

SEQ ID NO: 5387 - RNA, 4086 nt, Artificial Sequence
  Cas9 variant
augggaaauuauuaccuuggccuugauaucggaacaaauagugugggcugggccguaacugaugaaaacuacaacauagagagauucaagaaaaaaaauauguggggaaucagacuauuugaugaagcaaaaacugcugaaucaaggcggauacaccgacaagcaagaagaaugagacaacgaaaaauucaaagguuaaaucuccucauggaauuauuugaugucgaaaucucaaaaguugacgaauccuucuuuauccgcaaaaaagaaucagaucuccacuaugaggauaaaucucaagacucccgcuacgccuuauucaacgauaaagaauucaacgacaaagauuaccacaauaaauauccaacaaucuuccaccuuauaauggaccuuauagaaaaugaugaaaaaaaagacaucagauuacucuacuuagccugucauuaccuaauaaaaaauagaggucauuucauauucgagggacaaaaauucgauguaaacaguagccucaauaacaauaucaacaaacuuaaaagccaccucgaucaauucuacaauauaugccuugacuucgacaacgauaaacucaucgaaauacucgucaaccagaaccuaaacauaagugaaaaaucaaaaaaaauuaaagaauuacuaagaaaaacaaaccuggaaguaggcauugcgaaucugauugccggcggcuccauaaaacugagcaauauguucgacgacgacgaacucaaaaacuucgauuauaauucccuaucauuuaaaaauuccaacuucgacgaagguagagaacuauucgaagaaguuuuagaagauagauucgaauuaguggaaauacuaaaagauauucaugaugcaucuguacuagaaacaauguugucaucugccagcaucucuccugauggaggaaaauauauaucuucaucaaugauuaauucauacaacaaacacaaacgagaccuaaaacuacuuaaaaagauuauaaagaaauauaaaaaguccgaauacgauaauauauuucgcgacgaaaacauaaaaaacaacuacuuaucauauacacguacaggaauaaauaagaauaaaaaaguccaagcaaaagacaauacugauagcgacggcuuuuauaaauacauuguuaaaauuuuaaaagauaucaaagaaaaugacucagaugaagacaucaaauacauauugucagaaauagacaagaaaaacuucguuccuaaacaaagaacuaaagaaaacucuguaauaccauaucaacuaagggaaauagaauuacggaaaauaauagauaaccaaagcaaauaccacaaauuucuaaacgaaguugaugaaaaaggaauaagcguaaaagaaaaaauaauagcauuacuaaccuuucguauaccauacuauauugguccacuaaauccaagcuauaaugaagaaaaaaauuuuacuacuagcuggguaaaaagacucgcaaaagggaaggugacacccuggaacuucgaagacauggucgauauugaugcgagccgcgaggcuuucauagaaaauaaacucaacaaauguagcuuccuccucgacgaaacaguauuaccaaaagacuccuuacuauaucaagaauacaugguauuaaacgaacuaaauaauuuaaaaauuaacggucaaagcaucaacaccgaucuuaaaaaaucaauauaugaagaacuuuuuaaaaaauacaagaaaguaacaagaaaacgacuuauuucuuacauaaaagaaaaagaaaauacuaguggagacauaguuauaacagguaucgauggagauuucaaacagggacuaaaaagcuacaucgcauuuaaagaaauaauaggcgaaaaaaucgauaaugauaucuauagaaaagaagucgaaaaaauuauaagagacauaucacuguacggggacgacaaaagcuucauacagaagaagauaaaaaacgaaaacaaacuugaccuaucugacaaccaaauuagcaaaauagcaaagcuaaaguucaaagacugggguagauucagcaaaaaacuacuaguaggaaucaaagcaagcgacaaaaacacaggugaaauugacaauauuauuggcuucaugaggaauuauaauuauaauauaaugcaacuuauggcgaauguuuucacauucaaggaugaaauugaaaaacuaaauucaaaauauuacacuuaugaaaaaaucaacguagauuaucucgaugaccuauaucucucagcucccgcaaaaagaaugcuauggcaaaguuuucaaaucguagaugaaauaaagaauauaaaaaacucugcacccaaaaaaauauuuauugaaauggcaagaucuaaagaagacaaaccuacaagaaaaaugucucgaaaaagcagauuagaaaaacuuuauacagacagcaaaaaacaauucaucaaacuauucggucccgacgaauacgacaaacuaaauaacgaaauuaaaaacaaaucagaauccgauuucagaugggacaaucuauaucuauauuacacacaguucggcagaugcauguauucauuagacccaauugaucuagaagaauuaucgaacaaaaaucuauacgaucaagaccacauauaccccaaauccaaaauauacgacgacaguauagaaaaucguguauuaguuaaaaaacaacuaaaucuagauaaaucaaacgaguacccaaucccagacagagugcuaaacaaagauaaaaacaaacuucucgcauucuggaaaaugcugaacgagaaagaacuaauaggcgacaaaaaauacgcccgacuuauccggaaaucgccauuuacagacgaagaacucggagauuucauagcaagacaauuaguagaaacuagacaagcaaccaaagaaacagcaaacaugcuuagacgccucugcccggacuccaaaauagucuacguaaaagcuaagaauguuucagacuuuagacgaaaauucgauauauuaaaaugcaggagcaucaacgauuuacaucacgcucacgacgccuacuuaaacauaguuguagguaacguuuucgacacaaaauuuacaucaaacccauuaaauuucaucaaaaacaacucaaagaacagaagcuauaacuuagaaaaaauuuacgacuacgauguaauacguaacgaaaaaaucgcuuggcuagcggaaagaaaagaagaaaaucaagauggcucaauagcuacuguacuaaaaaaccugagcaagaaugauauaagagucacgcggagaacauacauaaaaugcgaagaucuauucgacgagaacauaguccguaaaggcaacggaaaauucccacucaaagaaaacaacaacaaaucagauaccaauaaauacggaggcuacucaggaauaaaaaacgcguacuucguacuccucgaagacgagaaacacaaccgcauaaucgaagcaauaccaucauuuauauacaaaaaagaaaaaaacggagaaaaagguucugucauaaauuaccuacaaaacauauuaggaauaaaaucagccaaaauauuaagagacaagauaaaaauaggaucacuauuaaagauagauaaauucccauacaaucuagcuggaaaaucaggaaacggcauucuaauuagcggaggaguacaacuaauacuagauaaaaacaccucaaaauacauuaagaaaaucgaaaauuacaaauacaaguuagacgaaaauaaagauuaucaaauaaacauauuugacaaauuaaguaaagaagaaaacauuaagcucuucgaccuauuuguagacaaauuugagaauucaauuuauaaaaaucgcguaaacauaaagcuaaaagaaauuaaacuugcccgaaguaaauucgaacaccuaucaauagaggaacaaaucaaaacucuaacacaaaugcuaauacucuucggucgagagaacaacgcgguaaaucucgaauauauaggacucccgaaaaauacggggaaaacaaaaaucaacaaaaaaauaaauaauaaagauaucaaaauuauaaaccaaucgauaaccggauuauacgaaacggaagaagaccuagcaaauauauga

SEQ ID NO: 5388 - RNA, 4089 nt, Artificial Sequence
  Cas9 variant
augaaaaaaccauauagcauaggucuagauauaggaacaaacucagucggaugggcaguaaucacagaagacuacaaaguaccagccaagaaaaugaagguauuagguaacacuucccgagauuuuauuaaaaaaaacuuauuaggugcacuauuauucgacagcggcgaaaccgcagaggccagaaggcuuaaacgaaccgcucgccgaagauacacuagaagaagaaaccgauuaagguaccuacaagagaucuucuuagaugagaugaacaaauuagacagcgguuucuuucacagauuagacgauaguuuccuuguacccgaagaaaaaagaggcuccagauacccuauauuuggaacauuacaagaagaaguaaauuaccacgaaaauuucccaacuauauaucaucugagaaaaaaacuagcagacuccaaagaaaaagcagaucugcgauuaaucuacuuagcccucgcccacaugauuaaauacagaggucauuuucuauaugaagagucauuugacuccaacaacaauagcauacaagaaauuuucaaugaauuuacagcugaauaccauaauaccauagaaggcucuugcuugucgggccagaucgaacaaguagaagcaaucuuaacagauaagauuaguaaaucagcuaaaagagaaagaaucuuaaaacuuuucccagcagagaaaaguacaggccuauucagugaauuucuuaaguugauuguaggaaaccaagcagacuuuaaaaaacauuucgaccuagaagaaaaaacaccguuacaauucucgaaagauaccuaugaagaagaccuggaaaauuuauuagaacaaauaggugaugaauucgccgaucuuuuccuauuggcuaagaaacuuuacgacgcaacacuucuagcuggaaucuuaacagccacugacguauccacaaaagcaccacuuuccgccuccaugauuaacagauaugaaacacaccaacaagaccucgcagcacuuaagcaguuuauaaaaaauaaacucccugaaaaauacuccgaggucuuuagugaucugucaaaagauggauacgcgggauauaucaacgggaagacgacgcaagaagcguucuacaaauacauaaaaaacuuacuaauuaaauucgagggggcuguagacuuucuggaaaaaauagaaagagaagauuuuuuacgaaaacaacgaacuuucgacaauggaaguauaccacaucaacuacaccuacaagaaaugaacgcaauacuaagacgacagggugaucauuacccauuccuaaaggaaaaccgagaaaaaauagaaaaaauucuaaccuucagaauaccauacuacguuggcccacucgcuagaggcaaucgcgauuucgcauggcuaacacgaaacagugaccaggcaauccgaccguggaauuuugaagaagucguagacaaaaccucaucagcagaagacuuuauaaacaaaaugacaaauuacgaucuauaucuuccagaagaaaaagugcuaccaaaacauucaauacuauaugaaacauucgcuguauacaaugaguuaacuaaagucaaauucauagccgaaggccuaagagacuaucaauuucuagacaguggacaaaaaaaacaaauaauuaauuuacucuuuaaagauaaaagaaaagucacagaaaaagauauaauacacuaccuacauacaguggacggauaugacggaaucgaauuaaaagguauagacaaacaauuuaacgcaucccucucaacauaccacgaucuucuaaaaauaauaaaagauaaggauuuuauggaugaugcagacaacgaagcaauacuagaaaacauaguacacacauuaacgaucuucgaagaucaggagaugauaaaacaaucacuagcccaauacgaugcuauauuugauagaaaaguaaugaaagcccucacacgcaggcauuacacaggauggggagaauuaagcgcaaaauuaauaaacggcauuagagacaaacaaacuggaaaaaugauauuggaauaccuuaaagaugauggugaaauaaacagaaacuuuaugcaguuaaucaacgacgauucgcuaucauuuaaagaaacaauucaaaaggcucaaguaaucggcgaaacagagaauaucaaacaaauaguacaagaacucccuggaucaccugccauaaaaaaaggaauacuucaaucgaucaaaauaguagaugaacuaguugaaauaauggguuauaauccagaauccauaguaguagaaauggcaagagaaaaccaauuuacaaaccaaggaagaagaaauucgcaacaacgacuuaaaaaacucacagacucgauaaauaaacuaggcucaaguauauuagaagaacacccuguagauaacagucaguugcagaacgauaggcucuuuuuauacuaucugcaaaacggaaaagacauguacaccggagaagcgcuugaacucucaaaauuaucgucguaugauguagaucacauaauaccucaagcuuucauaaaagacgacucauuagauaauagaguauuagucaguuacgcaaaaaauagagggaaaucagaugaugucccaucauuagaaaucguccaaaaacgaaaagcauuuuggaggcaacuauuggacagccaacuaauuuccgagcgcaaauucaauaaccucaccaaagccgagagaggcggacuaacagaagacgacaaagcaggcuuuaucaaaagacaacuaguagaaacaaggcaaauaacaaagcauguggcccaaaucuuagacgcacgauucaacacugaagugacagaaaaaggcaaaaaaaaaagagccguaaaaauaauaacacuuaaaagcaacuuaguaaguaauuuccgcaaggacuuugaacucuacaaaguacgcgaaauaaaugauuaccaccaugcgcaugacgcauacuuaaaugccguaguaggaacagcacuccuaaagaaauaccccaaacucgagccagaguuuguuuacggagacuacccgaaauacaacuccuacagagagagaaaaacagcuaccgaaaaaguauauuucuacaguaauauaaugaacuucuucaaaacuacaguaaaacucgcagauggcucagaaaaaaaaagacaucaaauagaaacuaacgaagaaacaggagaaaucguaugggauaaaacaaaacauuucgaaauagucagaaaaguuuuaucguauccacaaguaaacaucguaaaaaagacggaagagcagacuguuggccaaaacgguggacuuuucgacaacaacauuguaucaaaaaauaagguaguagacgcaaguaaacuaauaccaauaaaaucgggauuaucaccagaaaaauauggcggcuacgcacggccuacaauagcauacaguguccuuguaauugcagacauagaaaaaggcaaagcaaaaaagcuaaaacgaauaaaagaaaugguuggcaucacgauacaagacaaaaaaaaauucgaggcaaacccuauugcuuacuuagaagaauguggauucaaaaacauaaauuccaaccacauaaucaaauuacccaaauacagcuuauuugaauuugacgacggucaaagaagguuauuagcauccucgauagaacuucaaaaaggcaaugaauuaauacuaccuuaccaucucacagcacuauuauaccaugcccaacguauaaauaaaauuucagaaccaauacauaaacaauacguagaagcacaccaaaacgaauuugaagagcuucuaacuacaauaaucucacuaaguaaaaaauauauacaaaaaccuaacgucgaaagccuacuccaacaagccuuugaccaaacugacgaagacaucuaccaguuaagcgaaucauuuauaucacuucuaaaauuaaucucauucggggcgccaggugccuuuaaguucuuagggguagacauuagucaaucaaacgugagauaccaauccgugaguucuuguuuuaacgcaacucuaauccaucaaucaaucacaggauuauacgagacaagaaucgaucuuucuaaauuaggagaagacuga

SEQ ID NO: 5389 - RNA, 4089 nt, Artificial Sequence
  Cas9 variant
augaacgaaccguauggaguaggccuagacaucggcacaaauaguguggguuggaccgucguugauaugaauggcaggguuagaaaagucaaaggaaaaacagcuuugggugcuagauuauuuaaagaaggagcaacagcggaggacaggagaggauuccgaacaacuagaagacgacuaaaaaggguuaaguggagacucagacuccuuagagaauuuuucgaccaacccauaucaaaaauugacccaaacuuuuucgcaaggcguaaguauagcgauauaagcccgcgugauccaaauuauaauggauuagccaaaacccuguuuaaugaucgaacagacaaagaguucuaugaugacuaugcaacaaucuaccaccuaagagauaaauugaugacaaguaacagaaaguuugauauaagagaaauauaucuugcaauacaucauauagugaaauacagagguaacuuuuuaagaacaggcccagcuagccaauauggaucagcaucccuccaucucgcuacauccuuucaaaaacuuaaugaucuuuucgcccagucagaagaaacuuuaaaucuaaaauugguaaccgaugaagcucuauuacaacaaauacagcaaauauugguuaggacagaucuuuccaggucagaacagcaacggcaaauauggccguuaauggcaguacuaaccggagccagugcagcugaaaagaaacgccagaaaaauguagugguagaacuauccaaagcgcuagugggacucaaagcaaaaaugaauguagucacacucaccgaaguugacgcagcaguaguaaaagauuggacauucacgauggaagaaucacaagacaaauuaccagaaaucgaggagcaacucucagaaguaggacaacaaauaauggaugaaguuauacaacuuuacgcauccguuaauuuagcacaauugauuccagcaggaaagcgauuuucacaacauaugguagaaaaguauaaacaccaugaaaagaaccucgaauuacucaaaacauacauucauucgcaaagcgauaguaaaagagggagagaaauaagagccacauaugacagguauauagacgggguagacuccaaaccaguuacacaggaaauguuuuacaaagaucuaaugaaauacgucgaggcagaugccacaucaaaucauuuagcagccgaaauaaaagacgagauagauagugaacaauuuaugccgaaacuacgcacaaaacaaaacgguucaauaccauaucaaguucaacaauaugaacucgaucagauaaucagucaucagaagaaauacuauccaugguuaggagaagaaaauccagucgccgaaagacgcggaaaauuucccuauaaauuagacgaauuagugggcuuuagaguuccauauuauguaggaccauuaaucacaaaagaagaccaacaggccacgucuggagccggauucgcauggaugguuagaaaagcagauggaccaauaacaccauggaacuuugaucagaaaguagacagaaucgcaucagcaacugcauuuauucagcgaaugcaaacaacggacacauaccuaauaggcgaagacguuuuaccggcaagaucacuuauauaccagagauuuaugguauuaaaugaacuuaauaacaugcgcguggaagauagaaaacuagcuccccaacaaaaacaaagguuauauaaccaaguauucaaacaacaccaacacguaucaguuaaaaacauucaacaaaaccucauggaugcgggugaauauagagaggcaccgaaaaucacaggccuggcggacccaaaaggauuuaauucaagucucagcaccuaccacgacuucaaaaagauacugccagaagccaucgcagaugaacauaaacgagcagauauagagaaaauuauuuuauggagcacaaccuucgaagauucagcuauuuuuaaacaaaaacuagaagaaguugcauggcuaacagaugcgcaaagaaaacaacuaucgggcuuaagauaccguggauggggacaauuaucacauaaguuacuaauagcguuuaaagaugauaauggaagguccauuauggaugggcuaugggaaacaucagauaacuucaugcaacuuaggaaacaaccagcaauagaaacgcaaauaaaagaagcaaaccaggcaaacuuaacagaugcggauauucaggauacuauuaaugaauuauauacaucaccgcaaaacaagaaagcgauaagagaaguaaugcuuguccuagacgauauuaaaaaugcaaugcacgggcaaacuccuucauggauuuuuguagaagcugcaagaggcggcggagucgccggacgaagaacacaaaguagguccagccaaaucguagaagccuauaaaggaacagcaaaagagauugugucugaaaaaguucaacaugaacuaaaugagaaaauuaaagccaaagcagacuucaauacgcgguuaguucuauauuuucuacaaaacgggcgagaccuuuacaccaacgaagcaauaaacaucgaucggcuauccgaauacgacauagaucacauauuaccucaaagucuaguaaaagaugauucacuagauaacagagucuuaaccagugcaagaauaaauagagaaaagaacgauacuuuugccagugaaaaauuuggaaggaaaaugggagcucaauggcgagaacuacaccgaaacggccuaaugacacagagaaaacuuaaacacuuacuaaugagaccagacgaaauaaguaaacaugcgaccgacuucaucaaccgacaauuaguugaaacaagacaaguaauuaaauuaguagaggaacuuauaaguucugaauauccggcagcgucuaucgucgcaguaaaagcgaaccuaacacaccaauuucgucaaacuuuuaacuuuccaaaacuccgagaaguaaaugauuaccaucaugcauuugaugcuucauuaacugcauuuauaggcauguaucuucuaaaacaauauccaaaauuagaaagauucuuuguauacgggaaauuugccaaacagccuauuaacuuaacuagauuuaauauaauuagaaaacuugcaguagcagaaaaaccgauugcuaauauagaaacuggagaaauauuaugggauaaaacagccgauauuaaauauuucgaaaagcuauacaacuauaagagacuacuugugacacaugaaguaagagaaaauuacggagcaauguucaaacaaacuuuauuuaaggcuuccgacaacaaaagcaaaacgcuaguaccaaagaaaaaucauauggagacauccguuuacggaggcuauagcaaccaagagacggcuuaccuagcgauaguaagaauaccauuuaaaucgggcuucaaauucauaguaguagguauaccaaccagaaugguagcaaaaauuaaacauuaccaaaguuuaggagccacuuuaaaacaagccacacacaaagucaucgaaccaaaauuuacuaaaauaagucgaaaaacaaaacaaacagugauaucggauuacgaaguaguauugccaaaaguauaccuagaucaaguagucagagaucaaguaaaggggcaaauguauagguucucauuaggauccgacaaggaauaucauaacguucaagaacuauacuuaccauuaucaauacaacaagcguuuguggggcacuacgacgaaagugacgaccaacgaucuaacgacuuaguaaaagucuaugacgccgcauugaaacaacuacaacgauauuuuccccugcaucuaagucguaauuuugaucaaguagcaaaucaagcucaucagucauuugaaggucucaaaaauaacgugcaaaaaucggacaaacaguuaggcaagaaagaaguauuaaacagccuauucguaggacuacacgcuacugcaacacgaaguaaccuaucaguccuaggaaugucuaaagauuucggacgcuugcaaagcagaucaggaauaacacucaccgaucaagcagagauaauauaccaaucucccacuggucuuuuugaacgaaaaguagcgcugaaagacuuauga

SEQ ID NO: 5390 - RNA, 4089 nt, Artificial Sequence
  Cas9 variant
augacaaaacucgguaagccauacgggauaggagucgauauagggucuaauucgauugguuuugcagcaguagacgaaaauucccaucuaauaagacuaaaagggaaaaccguaauuggcgcaagacuauuugaagaaggcaaggcggccgcuaaaagaagggcuggaagaacuacacgacgaagauuaucacguaauagauggagacuaucauuuuuacgcgauuucuucgaaucacacauaaccccaacagauccaaauuucuucaugcgacaaaaauauucagaaauaucaccgaaagacaaagcucgauauaaauacgaaaagcgauuauuuaaugaccgaacugaugcagaauuuuaucagcaauacucaacaauguaucauuuaaggaaccguuuaaugacagaucccucaagagcagauguaagagaaauauacuucgcuauucaucauauucucaaaagccggggacacuuccuaacaccaggcgacgcaaaagauuuuaauacaaacgauguagcguuggacgaaauauucccagcauugcaagaugcguaugcccaaguauaucccgacuuaggcauaacauuugacgaagacaaagcaaacgaguucaaaacuauacuacuaaaugaaauagcgacauccauagauacgcaaagagcauuagucaaacuacuacuagcggaggaagaugacaaagacauacuuaaacagcaaaaacaaguauuaacggaguucgcaaaagcuguaguagggcuaaaaacaaaacuaaauuuagcacuugguacagaaguugacucaucagaagcaacagccuggaacuucucauuagggcaacuagacgauaagugggcggguauagaaucagcuaugacagacgaagguacagaaauucucgaucagauucgagaucucuauagagcaagacucuuaaacggaaucguaccuacaggaaagacguuaagccaagcaaaaguggacgacuacacacaacaccacgaggaccuacaauuauucaaagcauaccuaaaacaauuagaagacgacggaacagcaaaagccauuagacaacuauacgaucgauacauagauggagacgaugcagcacccuuucucagggaaaauuuuguaaaagcccuaacaaaagacgugacagcccacccuaacacuaaaagucccgaguuacucgaaagauuagcacaaccagacuucaugcuuaaacagcgcaauaaagcaaacggagcaauaccaguacaaaugcaacaaagagaauuagaccaaauuauuaagaaucaagcgguauauuacgacuggcuagccgcaccaaacccuguagagaagcaccguaaaagcaugccuuaccaauuagaugaacuucucaauuucaggauaccuuauuacguaggaccacucguaacagcuaaagaacaaaaggcugcccaaggcggcgucuuugccuggaugguccgaaaggaucccgaagguaacauuacaccauacaacuuugacgaaaaaguugacagagaagcaucagcuaauacauuuauccaaagaaugaaaacuacagacacguacuuaauaggagaagacgugcuaccgaagcaaucauuacuauaucaaagguacgaaguccuuaaugaacuuaauaauguacgagucaacaacgaaaaacuuucaauugaacaaaaacaacagguaauacgugaacuauuugaacgacacaacaguguaacaaucaagcaauuugcagaaaaucucagagcacacggcgauuaugcacacaucccagagauaagggguuuggcugacgaaaaacgauuccuaagcuccuuaaguacguauagacaguuaaaaucgcuucucccagaagcaauagaugacccagccaaacaagcagacauugaaaauauaauagcauggucaacuguauuugaagacgcagcaauuuucaaaacaaaacuaaaagaaauaucguggcuugguagcgaagcuauaaccaaacucagcaacauccgauacagaggauggggucaauucucacgcaaauucuuaaacggacuaacucuagggaaugggcacacaaucauucaagaauuacuucuaagcacaaauaauuuaaugcaaauucuaacagacgaaacacuucaaaagaaaaugacagaguuaaacgcugauaaauuaaaaacagcgaauauaaaugacgcgauagauaaugccuacaccagcccaucuaacaagaaagcccugcgacaagucuuaagaguuguugacgacauaaaaagggcagcugacggacaagauccaagcuggcucuauguggaaaccgcugacggaggaggaacgccaggcaaaagaacgagagcuagacaacaccaacuacaggaaauuuacgcaaacgcagcccacgaacuaauagacacagcaguaagaggugaauuagaggacaaaauaucagacaaagcagacuuuaaugaucgccuuguacuauauuuuaugcaaggaggaagagacauuuauacaggcgcaccacuuaauauagaucagcugagcucauacgauauagaccacauacucccccaaucauuaauaaaagauaauucauuagauaacagaguauuaguacacgccauaauaaaucgagagaaaaacgcaacuuucgcaucuacaauuuaugcccagaaaaugaaugccaccuggagacaauggcaugaagcaggccuaauauccggucguaaacuaagaaaucuucaaaugagaccagaccaaauagacaaauaugcaucgggauucguagcaagacaacuuguugaaacuaggcaaauaauaaaauuaacagaacaaauagucgcagcacaauauccagacacaaaaauaauugccgugaaagcagguuuaagucaucaauuaagagaagaauuagaauuucccaaaaaccgagauguaaaucauuaucaucaugcauucgacgcuuuccucgcagcacgcauagguacguaccuacuaaaacgauuucccaaucuacaagcauucuuuacauauggaaaauuuaccaaggcagacguaaagaaauuacgaggcuuuaauuucauacgagacauuacgcaugccgaagacaaaauaguugccaaagauacaggcgaaguugucugggauaaacaacgggaugucgaugaacuagaccgaauauacaauuucaaacgaaugcucauaacucaugaaguccgauuugaaacagcugaucuauucaaacaaacuguauacggggccagagacagcaaggaagcaggaggaaguaaacaauuaauaccaaagaagaaaggcuaccccguagacauuuauggaggauauuucagagaaaauacugcauaucuagccgucguaaaagucacgaagaaaacagaaacaauauucaaaguaguuaaaauugccacaucccagguagcugcauuaaacaaagcgagaaguagaucuacagcagaagaauuaucagucuuaacagaauugcuaaaaccaaaauuuucaaaagucggcaaaaauggaaaaauaacagacacaccguuugaaguuguguuacccagaguuccaagagagcaauuauucuauaacgcuaaauacggauucuucaugguaaacagcgauacuauguuucauaauuuccaggaaauuuggguaucaagaucagaccagaaaauauugcaacaaauacgaaaagcaaaaauagacuacccaaacguagaucaagauuuggauaaucuuuuccauaaccuagcagaccaaauaguuaaauacuucgauuuauacagcauugcaggauucaaagagaaaaucagucaaagucaaaacaccuuuaaugaucuagcaguagaugacaccgaccaaaguguaggcaaaauaacgguaauuaaugaacuauuaaaaggagcucaagcaaacggaaugacuggaucuuuaaaaguauuaaaaauaucaacgccuuucgguuuuacccaagauaaaucagguguucuaacaaaagacaguaguauaauauaucaaaguccaacgggacuauuugaacguagcguaagacuaacagacuuauga

SEQ ID NO: 5391 - RNA, 4089 nt, Artificial Sequence
  Cas9 variant
augacaaaacucggaaaaccuuauggaauaggaguagacaucggcagcaacucuauaggauuugcugcuguagaugaaaacucucaccugauaaggcuaaaagguaaaacagugauuggugcacgacuauucgaagaaggcaaagcugcagcgaaaagacgcgcaggucgaacaacuagaagaagguuaagccguaacagauggagacuguccuuucugagagauuucuuugaaagucauauaacaccaaccgauccuaacuucuuuaugagacaaaaauacucagaaauuucaccaaaggacaaggcuagguauaaauaugagaaaagacuguuuaacgaucgaacagaugccgaguucuaccagcaguauucuaccauguaucaucuuagaaauagacuaaugacugacccgucacgugccgacguaagagaaauuuauuuugcaauacaucacauauuaaaaucaaggggccauuuucuaacaccaggugacgcaaaagauuuuaauacgaacgacguagcacuagacgaaauuuuuccugcauuacaggaugccuacgcgcaaguguacccagaucuagggauaacauuugacgaagauaaagaaaacgaauuuaaaacaauauuacucaaugaaauagcaacaucaauugauacacaacgagcucuaguaaaacuccucuuagcagaagaagaugacaaggauauacuaaaacaacaaaaacagguguuaaccgaauuugcuaaagcagucguaggcuuaaaaaccaaacugaaccucgcacuuggaacugaagucgacucuagcgaagcaacagcauggaauuucucauuaggccaacuagaugauaaaugggcuggaauagaaagcgccaugacagaugagggaacagaaauuuuagaccaaauuagagauuuauaccgagcaagacuucuaaauggcauaguucccacaggcaaaacccuaucucaggcaaaaguagacgacuauacacaacaucaugaggaucuacaacuauucaaagcauacuuaaaacaacuggaagaugaugguacugcaaaagcaauucgacaguuauaugacagguacauagacggcgaugaugcagcaccguucuuaagagaaaacuuugucaaggcuuuaacaaaagaugucacagcacauccaaacaccaaaaguccggaacuuuuagaacgcuuagcacagccugacuucauguuaaaacaaagaaacaaagccaauggggcuauaccaguccaaaugcaacaaagagaauuggaccaaauaaucaaaaaccaagcuguauauuaugacuggcuagcagcacccaauccaguagaaaaacauagaaaaucaaugccuuaucaacuugaugaacuacuaaacuuccgaauaccauacuauguagggccauuaguaaccgcaaaagaacaaaaagcggcacaaggagguguauucgcauggauggugagaaaagauccagaagguaauaucacaccuuacaacuuugaugaaaaaguagauagagaagcguccgcaaacacguuuauacaaaggaugaagacaacggauaccuaucuaauaggcgaagauguuuugccaaaacagagcuugcuguaucaaagauacgagguacuuaacgaacuaaauaauguaagaguuaauaacgaaaaacuaucuauagaacaaaaacaacaaguuauuagagaauuauucgaaagacacaacagcguaaccaucaagcaauuugcagaaaauuuacgagcacacggagauuaugcacacauaccagaaauaagagguuuagcggaugagaaaagauuucuaagcucacuaucgacuuauagacagcuaaaauccuuacuacccgaagcaauagaugauccggcaaaacaagcagacauagaaaauauuaucgcauggagcacaguauucgaagacgccgcaauauucaaaaccaaacuaaaagaaauaagcuggcuaggaagcgaagccauaacgaaacuaucaaauauaagauauagagggugggggcaauucuccaggaaauuuuuaaacggauuaacacuugguaacggccauacaauaauacaagaauuguuauuaucaacgaauaaucuaaugcaaauacuaacagaugaaacauuacaaaagaaaaugaccgaauuaaacgcagauaaacuuaaaacagccaauauuaaugaugcaauugauaaugcauauacgucgccaucaaauaagaaagcauuaagacaagugcuacgagugguugaugacauaaaaagagcagccgacggccaagaccccaguuggcuauauguagaaacggcagacggaggaggaacuccgggaaaaagaacgagggccagacaacaucaauuacaagaaauauacgcgaacgcggcacaugaacuaauugacacagcuguucggggagaacuagaggauaaaauuuccgauaaagcugauuuuaaugacagguugguacuauauuucaugcaaggggguagagauauauacacaggagcaccacuaaauauagaccaauugagcucuuaugacauugaucacauacugccucagaguuuaauaaaagauaauucacuagauaaccgaguauuaguacacgcuauaauaaaucgagagaaaaacgcaacauuugcaucaacaauuuaugcacagaaaaugaaugcuacuuggagacaauggcacgaagcuggauugaucagcgggcgaaaguuaagaaauuuacaaaugcgaccagaucaaauugacaaauaugcaagcggauuuguagccagacaacugguagaaaccagacaaauaaucaaacugaccgaacaaaucguagcagcucaauaucccgacacuaaaaucauugcaguuaaagccgguuuaucacaccaacuaagagaagaacuagaauuuccuaagaauagagauguuaaucacuaucaucacgcuuucgaugcauuccuugccgcacguauuggaacuuaccuauuaaagagauucccaaaccuacaagccuucuuuacuuauggcaaauuuaccaaggcugauguaaagaaacuaagaggauucaacuuuauaagggacauaacacaugcagaagacaaaauaguagcaaaagauacuggugaagugguaugggacaaacaaagagacguagacgaauuagaccgcauauauaauuucaaacgaauguuaaucacacacgaaguacgauuugaaacggcagaucuauuuaaacagaccgucuacggcgcaagagauagcaaggaagcuggggguaguaagcagcucauuccuaaaaagaaaggauacccuguagacauuuacggaggauauuucagagaaaauacagccuaccuggccguagugaaagucacaaagaaaaccgaaaccauauuuaaaguaguaaaaauugcuacaagucaagucgcagcauugaauaaagcacgcagccguucgacugcugaagaacuaucaguauuaacugagcucuuaaaaccaaaauuuaguaaaguaggcaaaaauggaaaaauuaccgacacuccuuucgaaguaguauugcccagaguaccaagggaacaacuauuuuauaacgcaaaauacgguuucuucaugguuaauucagauacaauguuccacaauuuccaagaaauauggguaucacguucagaccagaaaauccuacaacaaauacgaaaagcaaaaauagacuacccuaauguagaucaggacuuagacaaucuauuccacaaucuugcagaucagauaguaaaauacuucgaccuauacagcauugcgggguuuaaagagaaaauuucacaaucucagaacacauuuaaugaucuggcaguagacgauacagaccaaaguguaggaaaaauaacagucauaaacgaauuacuaaaaggagcucaggcaaauggaaugaccggaucucuaaaaguucucaaaauaagcacaccauucggcuuuacacaagacaaguccggcguauuaacaaaagauuccuccauaaucuaccaaucgccaacaggucuauuugaaagaucaguuagacucacggaucuuuga

SEQ ID NO: 5392 - RNA, 4089 nt, Artificial Sequence
  Cas9 variant
augacaaaauuaggaaaacccuacgggauaggagucgauauaggaucuaauucuaucggauucgcagcuguagaugaaaacucacacuuaauaagacuuaaaggaaaaaccguaauaggcgcaagacuauucgaagaagguaaagcggcagcugacagacgagcaucuagaaccacgagaagaagacugucaagaaaucguuggcgacuuagcuuccuaagagacuucuuugaaucgcacauuacgccaacagauccaaacuuuuucaugagacaaaaauauagugaaauuuccccaaaagauaaaucaagauacaaauacgaaaaacgucuauucaaugacaggacagaugcugaguucuacaaauacgaaaacugcccaacaauguaucacuuaagaaacagauuaaugacggauccuucaaaagccgauguaagagaaauauacuucgcuauacaucacaucuugaaaagucgagggcauuuucuaaccccaggagacgccaaagauuucaacacaaauaaaguagcggucaacaaaauauucccagcauuacaagacgcauaugcacaaguuuaucccgauuuggauauaacauuugaugaaaacaaaguaaaugaauuuaaaacaguacuucugaacgaaaaagcuacaccuagugacacacagcgagcgcucguuaauuuacuauuagcaaaagaaggagacagagauauucucaaacaacaaaaacaagcacuaacagaauuugcaaaagcggugguaggcuugaaaacaaaauuaaacguagcccuaggaaccgaagucgacuccucagaagccacagcguggaauuuuagucuaggacaacuggacgacaaauggacgggcauugagagcgcuaugacagaugaaggaacggaaauacucgaccaaaucagagaucuuuacagagcuagacuauuaaacggaauaguaccagcagguaaaacacucagucaagcuaaaguagacgacuacgcacaacaccacgaagauuuagaauuauuuaaagauuauuuaaaacaacuagaagacgauggcacugcaaaagcuauacgacagcucuaugauagauauauagacggagaugacgcuaaaccauucgugcgugaagacuucgucaaagcauuaaccaaagaaguuacagcucauccaaaugcgaaaaguccugaauuacucgaaaggcucgcucaaccagauuuuaugcuuaaacaaagaaacaaagcaaauggcgcaauuccuguccaaaugcaacagagagaacuagaccaaauaaucaaaaaccaaucaguauacuaugauugguuggcagcaccgaauccaguagaaaaacaucgaaaaucuaugccauaccaacucgacgaacuacuaaauuuuagaauaccauacuaugucggaccccuaguaacagccaaagaacaaaaagccgcccaaggaggcguguuugcauggaugguaagaaaagacccugacgguaacauaaccccguauaacuucgaugaaaaaguagaccgagaggcaucggcaaacaccuuuauacaacgaaugaaaacaacagauacuuacuuaauaggugaagaugucuuaccuaaacaaaguuugcuguaccaguccuaugaaguacuaaacgaacuuaauaauguucgagucaacgauaauaaacuauccuucgaucaaaaacaacaaguuuuaggagaauuguuugaacgucacaauacgguaacaauaaaacaauuuguagacaauuuacucgcacacggagauuacgaucgcauaccagaaguacgaggacuggcagaugaaaaacgauuccugaguucacuauccaccuacaaucaacucaaaggcaucuugcaugaagcuauugaugauagcgauaaacaaacggacaucgaaaacauuauagccuggucuacaauauuugaagacaaagcuauuuuuaaaaccaaacuaaaugaaauaagcuggcuaaacgcaggaaugaucaacucucuugcuaacauuagauauaggggguggggacaauuuagucauaaauuauuaaacgaacuaacacuaucaacaggcagaacgguauucgaagaacucuuaaucucuucacauaacuuaaugcaaauucuaacggaugaaguacuaaaacagaaaaucgcagaguuaaacgcacaugaacucaaggcgucgggcaucuacgcggcaauugaugacgccuacacaucgccaucgaacaaaaaggcuuuaagacaaguuuuaucagucauagacgacauaacaaacgcagcaggccaagcgccaaauuggcuauauauagaaaccgcagacggugacgguguuccaggaaaacguacuaacaguaggcaaagaaaaauacaagaaauauaugcuaacgcagcccaagaacuaauaaccggaucggugagaggcgagcuagaagacaaaauagccucucgagcagauuuuacagaccgauuaguuuuauacuucaugcaaggcggaagagauauauacacaggaaaaccacuuaauauagauaacuuaucaaguuaugauauugaucauauauuaccccaaucccuaauaaaggauaacagucuagauaacagaguauuaguucacccucuagucaauagagagaaagauacgauuuucgcuucaacucgauuugccaaacaaaugaacggaauguggaggcaauggcaugcugcaggucuaauaaguuccagaaaacucagaaaccugcaaaugagaccagaugaaauagauaaauaugcaaguggauuuguagcacgacaacuugucgagaccagacaaauaaucaaacugacagaacaaaucgucgcugaucaauauccagauacaaaaaucaucgcagucaaagcaggacucaguucucaguugaggaaggaacuagacuuuccaaagaauagggaaguaaaccacuaccaccaugcauucgaugcauuccuagccgcaagaaucggaacauaccugcuuaaacgauaucccaauuuggaaccauucuuuacauaugggaaauuuaagaaaacagagguaaagaaauuaaaaucauuuaauuuuauacgagacaugacucaugccaaagauaaaauuguagcaaaagaaacuggagaaauuguaugggauaaugcaucggacauaaacgaauuagaccgaauauauaacuucaaaagaaugcuuaucacucacgaaguacgauucgaaacagcaucacuauuuaaacaaacccuauacgccgcuaaaaauaguaaaaaccgggguggcucuagacaacuaauaccaaagaagaaaggauaucuugucgauauauauggaggguauacacaagaaacagggaguuacuuaagcgugguacgauuaacuaagaaagcaauguacgcaguuguaaaaguauccacccgggacgcugcaaaauuagcaguagcaaaaucaauaucagaacaaaaagaaaaugaaacucucaagaaaaucauagacgggaaacuuucaaaaacaucuaagaaaggaaaaacgacacaucaauuauuugaaauuguccugccccguguaggccagaaaacuuuguuuaaaaacucuaaauauaaccaauuucuaguuaacagugauacauauaugcacaacuaccaagaauuauggaugccccgugaauaucaacguauguggaaagauauauuauuauccaaccauggcgacgcacaauuagaaggucaacuugaucaaauauuuaaauuuaucgucagucaaguaaauuccuacuuuaaccuauaugauauaaaucaauuccggaagaaaauagcagacgcaacagauaaauuugcaaaauuaccaacacacgauaccgacaaugccagaggcaaaaucgcuacaauaggacaauuguuaaucggucugcaagcuaaugcuaugagaucagaccuaagaaauuuagauauuaaaacaccauucggacuauuacaaauuggaacuggaauaacacuagaucuagacacaagcauaauauaccaguccccgacaggcuuauuugaaagagagguaccacuaacggaccucuga

SEQ ID NO: 5393 - RNA, 4089 nt, Artificial Sequence
  Cas9 variant
augaaucaagaaccauaugcuauaggacucgacauaggaacaucaucguuaggaugggcaaacgccgauauggacgguuacauagcacgcguaaaaggucaaacagguuuaggcguaagacucuucgaagaaggccaacccgcugcagauagacgcuccuucagaacaacaaggagaagacuaucuagacgaagauggagauuaagguuacucagggaaaucuucgaugaaccgauuucuagcauugacccaaauuucuucgcuagacaaaaggcuuccucaauaaguccuaaagacgacagauucgaaacuaccuaucagcuauucaacgauaaaacagaccaagaguucuauucaaaauacccaacgauauaccaucuaaggugggcguuaaugacugaacacagaaaauuugaucuaagggaaauuuaucuugcgguacaucacaucguaaaauauaggggaaauuuucuaagaagcggaaacccuaaaaguuuuaaaccaagcgaacuugacuuuagucaaagauuuaaagaaguuaauggacuauggcaccucaucuuugacgaagucgcaccccaacugccuacagacaacuuggaagaaauaacaaagcuaguacuagacacaacucggacccgcgcagacaggcaaagagagucaguaaaauuacugauggcugccacugacaaucacaaagacuggaaaccauauuuaacugaguucaccaaagcaauauuaggacuaaaaaccaaacuauacuugcuaacggggguagaugucgcaaaagcugaccagaaaacuuggacauucagucuagaagacauugaagaccacagagcagacuuggaaaccgccuuugaugauagaagccuagaauuaauagaaaaauuaguagaucuccaagcugccauccaauuaacugaaauuaugccuagcggacaauacuucucgcaaucaaugauauaucgcuaugaucaacauaaagagcaucuaagaugguuaaaagauuacgcagaacaacaaaccgaugcaaauaaacguaaagcgguaagacuagcauacgaccauuauauugaaggagaugccaaaggaaaaccagaaauagcugacgauuucuauaaagaacucaacagaauacuuaaaggagacacauccgaauuagcaaagaaaauaaaucacgaaauugcuuuagagcacuuuaugccaaaacaaagaacaaaagaaaacgguguuaucccauaccaaauacaucaacaagaauuagacuccauaauagauaaucaaaagaaauauuaucaauuuuuaggggaggauaauccaguagucucacaccauggaucgcaaccuuacaaaauagacgaauuaguuaguuucagaguaccuuauuauguaggaccgaugauaacagcagaucaacaaaagaaaacugcggcugggcaauuugccuggaugguacgaaaagacagcggggauauaacaccauggaauuuugaugacaaaguagaccgaacggcuucagcaacaaauuuuauacagcgcaugaaaacuacagauacguacuuaauaggagaagacguucuacccuuacaaucauuaaccuaucaaaaauucaugguauuaaaugaauuaaauaacauccgaaucaacggagaauuacuaacaagagaacagaaacaaagaacuuacaaugauguauuuaaaggacauggcacagucaauguuaaaaguuugaucaaaagccucgaaugucacucugaaguuacaggagcaaucaaaguagaaggguuagccgacccgaaaagauuuaauucagcccuuacaacauauagggauuuuaagaaaauacucccaguugcaauagaucagccacaaaggcaagcagauauagaaagaauaauaaauuggagcacuauauucgaagaugccgacaucuucaaagcuaaauuacaagaaauagauuggcugacugauacgcaacgagauagacuaucaacuaaaagauaccgaggauggggacgucuguccgcuaaacuacugcuuaacauaaaagauacccaagggcuauccaucauggaccaacuguggaacacccaacauaauuucaugcaaauaguucacgaaccagauuaugccgagaaaauugaaaagaccaaugcgaaaggcuuaaaacaacaagacauauucgaaacaauuaacgaaauguauacaaguccacagaauaagaaagcauuacgucaaauucuugcaguaguacgagacauccaaaaagcccaccauggacaagcgccuaguaggauauuuauagaggccgcgcgaggagcagagcaaaauccacaaaggacccgacaaagacaaaaacagcuagccgacuuguucgcagaucaggcaaaagaaauaguuaacgaaaccgucgcccaagaauuaaacgacgaaacagacaauaaagcaagauucacugauagauuaauguuauauuucuuacaaaauggucaagauauguauacaggugaaaaacuaaacaucgacaaacuuucaaccuaugacauagaccacauacuaccucaaucacuuguaaaagaugauagucuagacaauagaguuuuaguuucaaaaguagaaaacuuaaagaaaaacgaucauuucgcgagcgaacuauaugcacgcaaaaugcaaggcaccugggaauuauggagaucugcaggccuaauuagugcucguaaacuuaaacaccuccucaugcgcccggacgaaauaaauaaauaugcaacuggcuuuauaagaagacaauuaguagaaacaagacagguaauaaaacuuguuacagauguccuaucaaaugaauacgauagugacaaaacaaaaauaauaaguguaaaagccggccucagucaucaacugcgcauggaauuagaucucccaaaaguaagagaguuaaaugacuaucaccacgccuuugacgcguuccuagcaguaagaauuggaacauaucuuuuaaaacguuauccaaaauuggaaagguuuuucguauacggacaauaccaaguugcaccacaauuagacuuacgucgauucaauuucauacaugaucucguuagcgggaaacaagagaaaauagucgcagaagaaacgggagagauuguauggaaucgagaaaaggacguaucauacaugaaacauuuacuaucacuaaaacaccuuuuaguaacucaugaagugaaagaagaucacggagcccuguucaaccaaacaauauacaaagcgaagaaagacaauggcaauguaggagguaaaaugaaacuacuuccaacaaaaucuaaucguccaacagaaauauacgguggacauucaucccaagcgauagcauauuuggcaauaguacgaguaaauggaaaagaaccaucguauaggguuauggguguaccuauuagaauauuagaucaacuaaaacaagcuaagaaacaaggggaauaugcagaaagacuagcacugaaacaauucuuuacucccgauuuuacaaaaggaaaaggcaaaaucgucagugacuuugacguaguaauuccucauauacccuuacuacaaccuguaauagaugaaauuucugggcaaucacauagauuugccuuagggacaaauacuuacuaccgaaaccugcaacaacuaauacucacuuuagcagaucagaaaguauuaauaucuaaagaaacugguguugacgaagaaaagaaacucguagaaguauauagucauaucugccaacaaguaaugaaauuuuucccacuauacgacaggaauaaauucagagaacugcuaguugauucacgaucacacuuugaacagcuaccgauaguaaacagauacucugacgcuggaaaacuagaaauagcagguaaacgcggaauacuucaacaaaucaugguaggucuccaugcuaaugcaacaccuggagacuuaaaagaacuaggagucaaaacucccuucggaaaacuacaaguaccgggaggaauaaaacuuacugaaaaugccaaacuaaucuaugagagcccaacaggacuuuuuaaacgagaaguaaaaauaacaaccgaauga

SEQ ID NO: 5394 - RNA, 4089 nt, Artificial Sequence
  Cas9 variant
augaaaaagaaagcagaaaagauauauuuggggcucaacguaggaacaaacuccauaggauacgcgguuaccgaugaacaguacagacuguuaaaauuuaauggaaaugaugcauggggcucaauaguauuugaugcugccagcucaaaugaagaucgacgcaaucaccgauuggcgcgcagaaaucuagaccgaagacaacaacgcauaguuuggcuacaagaaaucuucgcaaaagaaauaagcaaagucgaugacagguucuuuauuagacuaucagaaaguuuuagauggagagaagauguacaagaucgcuaugucuuuuucaaugauaaagaauacacagacguucaauauaugaaagaauauccuacgauacaucaucuaauaugugaacugauggauaacaaaaccccacacgauguucggcucguauaucuugcaugugcauggcucaucacucacagaggccauuuccugaauaauuuaaaugucgaaaaacuugacgaaauaauggacuucucaaguguauaucaaaacuuuauuaacuauuuuacugaaaacggauauaaaagaccuuggggugaaauagaugugagugcacuuucagaaguacuaaaacagaaaacuggcaucaccgucaaaaacaaagaacuacaaaauauacuacuggaagggaaaaagccagaaaaaucaggaacagaagaauuuccguuuucucaagauucuaucauacgucuguuagcugggggacaaugcaaauuaaaggauguauuuugcaaagaagaauacuuagauuugggaucaguaagccuggguauggacgaagaaaaauuugacgaaauaucaggaaguauaggagaagauuacgaccuucucauugcccuaagggguuuauaugauuggucgguacuugcaaaucugcuaaacggccacucagaaacaauuagcauggcgaaaguacaaauguaugaacaacacggaaaagauuugcaaauauuaaaguacuucgugcgaaaauacguacccgacaaguauaaugaaguuuuucgaaaagcaaaagcugauaacuacguugcauacacaggacauauggauaaagacacagccagccaaauuaaaaagaaagccaaagcagaagaauuuucuaaauauguacuuaaacuuaugagccccauuaaaccggagaaaacagaccugcaaucguacgaagacaugugcgaaagguuaaaauuaaacagauuccuuccaaaacagaaaaauacagauaacagaguuauuccacaucaauuauaugaauaugaguuaauucaaauucuaaagaacgcaucuguuuauuuaccauuccucaacgauaccaauaaugguauaagugaagcggacaaaguacucucggucuuuagauacaaaauaccauacuacguaggaccauuaaacgaagaaucuuccuuugcauggaucagcagaaaacaaggaaaaauaaccccauggaauuuuaaagagaugguagaugaagaugcaagcgaaaaugcauucauaagaagaaugacaaacaaauguacuuaccucccaacggaagacguacuaccgaaagacagucuauguuaccagaaauuuaugguacucaacgaaauaaauaaccuccaaaucgacggacucaaaauuccaguaaaagcaaaacaagggauauaccacgaacuauuugagaaaaacaagaaaguaaaacguaaagauauagaagaauacuuaauuagaaacaacuacuuagacaaagauaguaccgaacuaauaucaggaauagacgaacaaauacacagcggacuauccucauacugcgcauucuuuaauuuauuaaauaagaaaauacucucagaagaugacguggaacgaauaauugaacgugccucauacgcagaagauaaaucaagaguaaucaaaugguuaagaaaagaauaccccggacuaucagaagacgauauucgcuauauugccagaaucaaaauuagagacuucggaagacuaagcaaaacuuucuuaacaggauuaaaaggaugcgauguuuccaaaggauuugauggacaagauguagaaaugauaaguauauuacaaacaaugugggaaaccaaugauaauuuaauggaaauucuuucagacaaauauacauuucuagaagccuuggaagcauucacccaagaauauuacacggguaaaaagaaaucucuaaaagaaagauuagacgaaaugagagugucaaauucaguaaggagaccaguauaucgcacauuagcuguagucaaagauauagaaaaagcguuuggcaaaccaaacaaaauauucgucgaaaugacaagagggggacaggcagaccaaaaaggcaaacguauaaaaucaagaaaacaacagauuuuagaccucuacgauaaauguaaagaugauguccaugacuuaauguggcaauuagagaguuuaggagaauaugcagacucuagacuacaaucggauaggcucuauuuauacuuuaugcaauucggaaaaugugcauauucaggagcgcauaucgguuuugaacaacuuauggccggguccguagaauacgacauagaucauauuuauccacaaagcuauguaaaagaugauucacuuaauaauaaaguucuuguauuaucagauuuaaacgggacgaaagacaauaucuaccccgugagcccagaaaucaggggaaaaaugcaaggauuauggagcugguggaaucauguaggagccauaagugaugaaaaauacaaaaggcuuauaaggucagcaccauucaccgacgaagagaaaaugggauuuaucaacagacaauuaacagaaaccucacaaucaacaaaauuuauugcagacuuauuaaaagaaagauucccagacgcagaaguaguauacguaaaagccggccuaguaagugauuucagacacgaauuugacuuaccuaaaucaagaaguuacaacgaucuccacaaugcagcagacgcauuucuaucaguuguugccggaaacguauaugauaugagauucuccaaaaagugguuucgcauagacgaaaaauauucaguaaagguaaaaacaauauuuacucaugaaguaaaauguaggggagacauuauuugggacggaaugccaauguuagaaaaaguugaagauacugcuaggaagaacacagcacauuucguaaaauaugcagccuucaagacuggcgguuuguuugaccaaaauccggucaagaaaggaacagggcugauaccacuaaaagcuggccugccuacagaaaaauaugguggcuacaauaaagcagguauaauguuucuaaucccaguaagauauaauauuggcaagaaauccgaaauacuuauucuaccgguagaauuaaugcauggaaaacacuucuuagaagacaaaguauuugccagaaacuacacauuuacacguuuagaaaacauauuaggaaagaaaguuggagaagucucguucccuauggguaugaggccauggaaaauuaauacaauguuaucauucgauggauucagaguauguuuaacaggcacaucaggcaggggaaaaugucuaguagcccaaccgguaaugcaauucagugcagacgagcauuggagauucuauguaaaacgauuagagagauucguggagaaaaucggaauaaauccagauuuacuauacgauaaagaccaugacaaagucuccaaagaugaaaacuuaaaacuauaugaacucuacguagauaaacuucaaaacacgauauauaagaaacgaguaaacagcccaguccaaacccuacucaaaggaaaagaagaauuuaagaaauuaucuauugaggaacaaugccaaguauuacuaaauauccaaaguguuuuuggucgcaugacuggaggaugcgaccugacacuaauaggaggaucugcucacuccgcagcaaccgguaguuuaucaaccacaauauccaacuggaaaaagaaauauuccacuguuagaauuaucgaccaaucccccucagggaugugggaaaaaucuagugaaaaucuauuagacuuuuuauga

SEQ ID NO: 5395 - RNA, 4092 nt, Artificial Sequence
  Cas9 variant
augaccaaauuaggaaaaccauaugguauaggagucgacauuggcucuaacucuaucggcuucgcagcaguugacgaaaacucacaccuuauucgacuaaaaggaaaaacggucauaggagccagacuuuucgaagaaggaaaagcagcugcagaccgacgcgccucacgaacaacaaggagaaggcuaagcagaaacagauggagacuaucuuuccuucgcgacuuuuucgaaagccauauuacacccacagaucccaacuuuuucaugagacaaaaauauucagaaauaucaccuaaagauaaggcacgauacaaauacgagaaaagguuauuuaaugaccgaacagacgcggaguucuaccaacaauacccaacaauguaccaucucaggaaucgucuacucacagauccaaguaaagccgauguacgagaaauauauuucgcuauucaucauauacuaaagucucgcggacauuucuuaacaucagguuacgcaaaagauuucaauacaaauaagguugcacuaaaugaaaucuuuccggcauuacaagacgcuuacgcacaaguauacccagacuuagauaucacauucgaugaaaacaaaguuaaugaauuuaaaaccguacuacuagacgaaaaggcuacaccgagcgauacacaacgcgcgcuaguaaauuugcuacuugcagaagacggugauaaagauauacucaaacaacaaaaacaaguacugacagaauuugcuaaagccguuguaggccugaaaaugaaacuaaacguagcuuuagguacugaagucgacucuucugaagcaaccgcuuggaacuucuccuuaggucagcucgacgacaagugggcaggaauagaaucagcaaugacagacgaagggaccgaaauucucgaccaaauaagggacuuauacagagcacgacuguuaaacgggauaguuccagcaggcaaaacauuaagccaagccaaaguagacgacuaugaacaacaccaugaagaucuugaacuuuuuaaagacuacuuaaagcaacuagaggaugauggaauggcaaaaguaauaaggcaacucuacgaucguuauauagauggagacgacgcaaaaccauucguucgcgaagacuuuguaaaagcacuuacuaaagaagucacugcacauccgaaugccaaaaguccggaacuacuugaacgauuaguucaaccagauuucaugcuuaaacaaagaaauaaggcgaauggcgccauaccgguacaaaugcaacagagagaacuugaucagauaaucaaaaaucaauccguguauuacgacuggcucgcagcacccaauccaguagaaaaacacagacaaagcaugccauaccaauuagacgaacuucuaaauuucaggauaccuuacuauguagguccauuaguaaccgcaaaagaacaaaaagcagcucaagguggagucuuugcuuggaugguaagaaaagacccagacggaaauauaacaccauacaacuucgaugaaaaaguagauagagaggcuucagcuaacacuuuuauucaaagaaugaaaacaacagauacauaccucauaggagaagacguccuaccaaaacagagucuccuuuaucaaucauaugaaguauuaaaugaacuaaacaauguccguguuaacgauaacaaacuaucauucgaucaaaaacaacaaguucucggugaacuauuugaaagacacaauacaguuacuauaaagcaauucgucgacaacuuauuagcacacggugacuaugauagaaucccagaaguccgagguuuagccgaugaaaaacgauuccuaucaagccuaucuaccuauaaccaacuaaaaggaauacuccaugaagcaauagacgacagcgacaaacaaacggacauagagaaaauaaucgcauggucaacaauauuugaagauaaagcgauauucaaaacuaaacuaaaugaaauuucauggcucacagccgggaugauaaacuccuuagcaaacauuagauauagagguuggggucaauuuucucauaaacuucugaacgaauuaacacuuuccacaggaagaacuguauucgaagaacuucucauaucuucucacaacuuaaugcaaaucuuaacagacgaaguacugaaacagaaaauagcagaacucaacgcccacgaacucaaagcaucgggcauauaugcagcaauagaugacgcauauacgucuccuuccaauaagaaagcauugcgacaaguacucucaguaauagacgauauaaccaaugcagccggacaagcuccaaacuggcucuauauugaaacagccgauggagauggaguuccaggaaaaagaacaaacucaaggcaaagaaaaauacaagagaucuacgccaaugccgcccaagaguuaauaacagggaguguucguggcgagcucgaagacaaaauagccaguagagcagauuucacagauagauuagugcuauacuuuaugcaagguggaagagacauauauacaggugaaccacuaaacauagauaacuuaagcucauaugacauagaucacauacuaccgcaaucucuaauaaaagauaauagccuggacaaccgaguccuagugcauccccuagucaaccgcgaaaaagacacuauauuugcuucaacaagauucgcaaaacaaaugaacggaauguggcgacaguggcaugcggcaggauuaaucucaucccgaaaauuacgaaaucuucaaaugagaccagaugaaaucgacaaauacgcaucgggauucguugcacgacagcuagucgaaaccagacaaauaauaaaguuaacagaacaaauagucgccgaccaauacccagacgcuaaaaucauugcaguuaaagcaggauuaucaucacaauuacgaaaagaacuagauuuucccaaaaaucgagaagucaaccacuaucaccacgccuucgaugcauuccuagcagcaagaauaggcacauaucuccuaaaacgauacccaaaccucgaaccauucuucacuuauggaaaauuuaagaaaaccgaaguaaagaaauuaaaaucauuaaaaucauucaauuuuauccgcgacaugacucacgcaaaagacaaaauaguagcaaaagagacuggagaaauaguaugggacaacgcuucagauauuaaugaacuagaucggaucuacaacuucaaaaggaugcuaauaacccaugaggucagauucgaaaccgcuagccuuuucaaacaaacauuauacgccgcuaaaaauuccaaaaacagagguggcagcagacaacugauaccgaaaaagaaaggauaucuaguggacaucuauggaggauauacucaagaaacagggucauaccuaucagucguacgguugaccaagaaagcaauguaugcagucguuaaaguaucuacaagagaugcugcaaaacuagccguagcaaaaaguaucuccgaacaaaaagagaacgaaacauuaaagaaaauaauugauggaaaacuaucuaaaacuuccaagaaaggaaaaacaacacaucaauuauucgaaauaguucuuccacgaguaggucagaaaacacuauuuaaaaauucuaaauacaaccaauuucuaguaaacagugauacauauaugcauaacuaccaagaauuauggaugccucgagaguaccaaagaauguggaaagauauacuacuaucaaaccauggggaugcacaacuagaaggacaacuagaucaaauauucaaauucauaguuucacaagucaauucauacuuuaaccuauacgacaucaaccaauuccgaaagaaaauagccgaugccacugauaaauuugcuaaacuacccacccaugacacagauaacgcaagaggaaagaucgcaacaaucggacaauuacucauaggauuacaagcgaaugcaaugcguucagaucucagaaacuuagacauaaaaacaccauucggucuauuacaaauagggacaggcauaacauuagaucuagauacaaguauuaucuaucaaucaccuacuggcuuauucgaaagggaaguaccuuuaacugaucuauga

SEQ ID NO: 5396 - RNA, 4092 nt, Artificial Sequence
  Cas9 variant
augagggggaacuaccauauaggucuagacauagguacaaguucaauuggaugggcaguuauugacgacaaugcaaaagugaugcgagcaaaaggaaaaacagcaauaggcgcuagacuauacaacgaaggacaaacagcagcagauaggaggcucuuuagaacaaccagaaggcgacuuaacagacgaaaauggcgauuaaaacuacuggacgaaaucuuugacccuuauauaaccccugucgaugccgcauuuuucgcacgucuuaaacaaucuaauuuaagcccuaaagaccaaaauagagauuggacagguucaauguuauuuccagaccguacugauagaaaauuucacaaagauuacccaacuauuuaccacuuaagacauaagcuaaugaccgaagaucaccaguuugacauacgagaaauauaucuagcaauucaucauauaguaaaauacagaggcaacuuccuaaacaccacaccgguuucaucauucagcguuagugauguaaaguuugaugaacaauucgacagacuaaacgaauuauaugcagcuguaucuccugacgaacccuucgcaaucaauggcgauaacucuaaagcgauagaaacacuacuauuauccgacgaaacuaaaaaauuugauaaacaaaaacaaucugcaaaacuuauccuaucagaaacaggggacaaagcuuuagauaaagagaauaccaaaguggcgacucagaucucuaaagcaaucuuaggauacaaaacacaacuugacguuuuacuuaaauacgacgcaauuaacaguucagcauggaagaucgaauuagacgacgaaaacauagaugauacccuaccaggacuacugucccaacuggaugaaaaucgacaagaaaugguaagcauaauccaaaacuuauaugcccagguaacgcuuaaccaaauagucccaaacggcaugucauuaagugagaguaugauagagaaauauaaugcacacagagaccaucuaaaacucuuaaagcaacuagaagauaaaauagacgauccaaagaaaaaaaaagguuuagaagcagcauaugacgcauacguugguaagaacaugaaaguagccaaucaagauguauuuuacgcaucaguuaagaaaaaucucgacgacagugaccuagcaaaacaaauagcagaccuaauagaggcacaaaaauucaugccaaaacaacgcacaagccaaaauggaguuauaccacaccaacuucaccaauuagaauuagaucaaauuaucgaaaaccaaucaaaauacuauccauggcuaacagcagcaaauccgaacccgaaacgaauacaucaagcuaaauacaaacuagaugaacuaguagcauuuagaauacccuacuacguaggaccacuaguaacgccugaagaacaagaaaaaucugcaaaccaaguguucgcauggaugaaaagaaaacaaccaggaaccaucacaccuuggaacuuugaucaaaaaguugaccgaauggcuucagcaaaucgcuucauaagacgaaugacuacaaaagauacguaucuuauuggcgaagacguauuaccagacgcuucacuaauuuaugaacgguucaagguacuaaacgaauuaaaccuagugaaagcaaacuaucaccguuuagcaccagcgcaaaagcaggcagcauaucgagaucuauuugaaaaccaaaaaagcauuucaacaaagaaauuacaaaacuaucuaguagaccaaggauauuucacagcaaaacccaagauaacaggguuaagugacccagaacgcuuuaauagcucauuagggacauauauugacuucaaagaaauuuuuggugaucaagucgauaacccugaccgacaggaugauuaugaaaaaauaauagaauggaguacagucuuugaagauagacaaauuuaugaagccaaacuacguacccuagauuggcucacugaagaccaaauacaagcccuaaagacaaaaagauauaacggauggggacgcuuaucuaaaaaacuacuaacaggaaucguagaugaaaauggagaacgcaucaucgaugucuuguggaacacuaaccaaaacuuuaugcaaguacagucacaagaaucauucgccaaaagaauacaugaagccaacgcuaaacaaaugaagguaacgggaguagaagacauacuagcugacgcauacacaucuccacaaaacaagaaagcaauucgucaaguaauacggguuguagaugauauacaaaaagcaaugggcggaguggcuccaacaucaguaagcauugaguuuacacgcagcgaagaccaaaaucccaggcgaacacaaucaagagaaucucaacuacagaauacuuucaaaguagacgccaaagaaaucguagacucagaccucgugacugaacuagaaaccguuucaaaaucaaaaaaaggucuaacagaucgauuauaucuauauuucacacaguuaggaaaagauauguauacuggcgacccauuaaacaucgaugagcuaagcacauaugauauugaucauauccuaccacaagcguuuaucaaagacgacagucuagauaacagagucuuaguuagcaaggccguaaauaacggaaaaagcaauaauguaccaguuaaacuguuuggaggaaaaauggggggauuuuggaaagaacuagcagaucauagauuaauaaguaagagaaaauuaaaacaccucuuaacagauccagauaccauagauaaauacacaaugagaggauuuaucagacgccaacuaguagaaaccagccaaguaauuaaauuaguggcucagauauuaggggacaaauaccaaaacgaugauacaaagauuauagaggugacagccaagaugaaucaccaaaugagagaaaauuucaagcucaucaaaaaucgggaaguaaaugacuaucaccacgcaguagacgcguaccuaacagcguucguaggacaauauuuauauaaaagauauccuaagcucagaccauacuucgucuauggcaacuucaaaaaauucaacgaggaccaugucagcuuucgcuauuucaauuuccuacacgaauuaauggacgagaacaauaaaagaauuguggaaccugaaaccggagaagugguucucgaacgagaaccugcgauagcauauaugaaacgaguauaucacuucaaguucaugcuaaucucacaagagguauacaccagacgcgaugcaauguucaaccagacaaucuacccagccaaagaagcaaauagaagaaaauuaauagcaaucaagcauggaaaaccaguagauguauacgguggauacaguggcucgguagaugcauauauggccaucguacguauacacgauaaaaaaggagacaaauacaaaguugucggaguuccuaugagagcauuagaaauacuuaacgcaacacacgauaaaaaagauuaugaugcaaaacuaaaacagauacuaguaccaaaauucaccaaaguaaaaaaaucaagaaaaacuggugagauaaccaaaaagguggaagacuuugaaauaguacucgggaaaguaauguaucgacagcuagucauagacggagauaaaaaauucaugguuggaucuuccacuuaccuauauaacgccagacaacucgugcuaagcgauucaucccuagacacauuggcauccaagggaacguuagauagugacgccgacuccaaaagauuagucgcgguauacgaugaaaucguagaaaagguagauaaauauuucccauuauacgauaaaaaugcuuuucguaguggauuacacaaaggccgagauaaguacuuguuauuaccaaaccgauccaccuuuaauggagcaaaaaaaguacauucuggcaaacgcgaaauccugaaugagauacuaaacgguuuacaugcaaacgcaacacuuggaggauuaaaagaucuuaaaauaucuacaccauucgguaaaaugcaagggcaaucaggcauuccauuaucuaguaacacaauaauauguuaccaaucaccaacaggccuauucgaacaucgaguaaguuuaaaagaucuauga

SEQ ID NO: 5397 - RNA, 4092 nt, Artificial Sequence
  Cas9 variant
auggaaaacaaccgauauaacguaggauuagauauuggaacgucauccaucgguuuugcaguaacagaugaacaagacgaacugguucaaguaaaaggcaaaaauuacauugguguaagacuauucaaagaaggucaaaccgcgucugaaagaagaucauuuagaacaaccagaagacggcuaaaaagaagaaaauggagauuaggucuacuugaagaaauauuugccccauaccuagcacaaggggauccauauuuccuugcaaggaugaaagagucaaacaucaguccacgugaugaacgcaagaaauacuacggauccuuauuauucagcgaugacaccguauuuuaugacaaauacccaacaguauaucaccuaagacaugcacuaaugacugaagacagaaaauuugacauuagagaaauauaucuagcgguacaucacauaauuaaauaccgaggaaacuuucuaauaaacacccuaauuaacgaguucucaucaaaagcaguagauuucaagaaagaugcagacauacuaaaugaccucuuugaacaauucuacauuagugauauuaaugauucguuucagcucaacacggcagauaugaacgaaauauccgaacuacuccucgacaacagcaaaacacgacuagacagacaacgagaaagccucaagaaacuagccaagaaaguagacgacauuaguguagcgaagaaacaucagaaaauugcaacagaauuuaguaaagccauauuaggaaacaaagccaaauucgacguaauucugaauguaacgacagacucaucaaaugauuggucguuuaaacuagaagaugaagacgcugaugagaaaauuguagucuuauuagaagaacuaaauacuccgcaacaagaagcucuaaacauaauacaucaaugguacucacaaaucucacuaaacggaauaguaccagacggcaaaaguauuucagaagcaaugauuagcuccuacgaacuacauaaagaacaccuagcucuauuaaaacaacaaauaaacaacaccaaagacaaaaagaaagcccacggacuacaugaagccuauaacgaauauguacacggcaacaacaauaagaaacuaaaccaagcagauuucuacuccaaaguaaaacaaaauuuggaaucuucacuuauaacggacgaaauacucgaacuaauuaaugcggaaaacuucaugccaaaacaacgcacaucugcuaauggagucauaccacaccaacuccaccaacaagaauuagacagaauaauacaaaaucaagcuaaauacuauccauuccucgccgaaacaaauccaaacgagaaaagaagcaaaguugcaaaauacaaacucgacgaauugguagcauucagaguaccauacuacgucggaccccuaauaacggcaacugaccaaaagaaaacaucuggaaaagaauuugccuggaugguucgaaaacaaccaggacgcaucacaccauggaauuuugacgaaaaaguaaauaaaauggaaagcgccaacacuuucauaaggaggaugacaacaaaagacucuuaccuaauagccgaagauguacucccagaugaaucccucuuauaucaaaaauuuaaaguccucaacgaacuaaauaauuuacgagcagacggacguaaauuaaaagucaguguuaaacaaaaaguuuuuaaagaauuauuucagcaacagaaaaccauuacuauagucaaacuccaaaauuauuuaaaagcagaauguucuuuccuaacgacaccagaaaucuccggucuuaguaaaccugaacacuucguuaguucacucgcaacauacauagacuuaaagaaaauauuuggagaggacaucgauaacccugcuaggcaaaacgauuuugaacgcaugauagaaugggcaacaauauucgaagacaaaaauauauacucagaaaaacucaacgagauaaaaugguuaaacgaccgacagaagaaagaacugaaaaauaaaaacuaucacggguggggaaaauuaagcgcuaaauuacugaaaggacuaagagacucagaugaauguucgauaauagaacauauguggaauacgcaacaaaauuucaugcaaguacaagcagaagaagauuucgcccaaagaauacaagaagaaaauaaccaacaccuaaaaggaaacacacucgaagaaguuuuagcagaugcuuauacaucaccucaaaauaagaaagcaaucaggcaaguugugaaaguaaucgaagacauacaaaaagccaugggcggaauagcaccccagaaaauaucgaucgaguucacacgagcaccagaagagaaacccagaagaaguguugagcgacaacaacaaauagagaaaauauauaaaaguguagcuaaugaagucgaaaaugcaggcguuaaagaugaauuacaacgcuuuucggacagaaaacaaacgcuaacagacaaauacuucuuguacuucacccaacuaggaaaagauauguacacgggaaaaagcauaaauauagaucaaauuggaaauuaccaaauugaccacauucugccacaagcauucauaaaagaugacucacuugacaauagaguccuaguaucugccgcaguaaacaacgguaaaucagauaacgucccuaccaaaaacgaccgauauaaaguaagagaacacggacaaagauuauaugaccaaggccuuauaagcaaacguaaauucaacaauuuaauuacagacccagacucaauaaauaaauucacagcuagaggauucgucaaacgacaacugguagaaacaucacaaguaauuagacucguagcagaguuccuuuauaauaaauaucagaguaaauccgaaauaauugaaguaagagccaaaaugaacucacagcuacggaaagauuucggacucaucaaaaauagaaauguaaaugacuaccaucacgcacuagacgcauacuuaacuacauuuauaggcaacuaucuauacagaagauacccaaaacuacgagcauauuucaccuacgguugcuucaagaaaguagacgauagucaacuaaaauacuucaacuuccuacacgacaucgaagacgacaaaaagaaaauuauaaaagauaaugacacaggcgaaauacuauggcauagagacgaaggcauugcaagauuuaaacgaauuuacaauuucaaauacaugcucguaacacacgaaguacucacccgacagggagcaauguucaaacaaacuguauacuccgcagccguugcgggaucuaagaaacuaauaccuguaaaagaagaucgcccaauagacauauacggaggauacacaaauaauaacgaugcuuuucuagcuaucgucaaaguaaccaaaaagaaacaauacaugguaguaggcauuccucaaagagcaguaguaaaacucaacgacgccgccaaacaagguagcaaggcuuaccaaaaaguucucuacaauguaaucaaaccacaauucaucaaaaagaagaaagauagaaaaacagguaaaauaacacaaaaacucgaaaauuuugagauaguaguaaguaaaacccuuuaucgacaauuaauuauugacggugaucaaaaauacauguuaggaucaucugccuacaaauauaaugcgaaacagcuaguacuuucugaauacgcucuggaaguguuagacagaucaauauucgagaagaaagaauacacuacaguagacuuagacaauguauaugacgaaauccuggcacaagucgacaaauacuuuaguuuauaugauaaaaacaaauucagacaaaaacuacaugaaagccgcaaaauuuucacagaacugcccauaaauaaucucuucucuggaacaaaacuccuuaaaucaggcaaaagggaaacuuuaaaugagauuuuggaaggacuucacgccaaugccacuaagaaagaccuaaaaucccuaaaguucuccacaccacuaggaaugauucaauacccaucggggauaauccucagugaaaacgcaauacucuguuaucaaucaccaacagggauuuucgaaaggagaguaacacuaaaagauuuauga

SEQ ID NO: 5398 - RNA, 4092 nt, Artificial Sequence
  Cas9 variant
augacaaaacuuggaaaaccauaugguaucggaguugacauaggaagcaacagcauuggauuugcggcaguagaugaaaacagccaucuaauuaggcuuaaaggaaaaacagugaucggcgcuagacuauucgaagaggggaaagcagcugcggaccgacgcgcuagucgcacaacccgaagaagacucucaagaaacagauggagauuaaguuuucuacgagacuucuucgaaagccacauaacccccacagacccuaauuucuuuaugcgccaaaaauacagcgagauuaguccaaaagacaaaagccgguauaaauaugagaaaagguuauuuaaugaucgaacagaugcggaauuuuacaaauaugaaaacuguccaacaauguaucaccuucgaaaccgacuaaugacagauccaaguaaagccgauguacgugaaaucuacuucgccauccaucacauacuaaaaucaagagggcacuuuuuaacacccggcgaugccaaagacuucaacacaaauaaaguagccguuaauaaaauauuccccgcauugcaagaugcauaugcacaaguauauccagaccuagauauaacauucgacgaaaauaaaguuaacgaauuuaaaaccguacuucucaacgaaaaagccacgcccucugauacacaaagagcuuuagugaaccuuuuauuagcuaaagaaggagaucgagacauucuaaaacaacaaaaacaagcacucacggaguucgcaaaagcaguuguaggauuaaaaacaaaacucaacguugcacuaggaacagaagucgauuccagcgaagcaacugcauggaauuucucccuaggacaacuagaugauaaauggaccggaauugaaucugcaaugacagaugaaggaacagaaauucuugaucaaauacgcgaucucuaucgagcucgacuacuaaauggaauagugccagcugguaaaacguuaucacaagcaaaagucgaugacuacgcgcaacaucacgaagaccucgagcuauuuaaagauuaccuuaaacaguuagaggaugauggaaccgcuaaagcuauccggcaguuauaugacagauacaucgacggcgaugacgcaaaacccuucguuagagaagacuuugucaaagcauuaaccaaagaaguaacugcgcacccaaacgcaaaaaguccagaacuauuggaaagacucgcacaaccagauuuuaugcuaaaacaaagaaauaaggcaaacggugcaauaccaguacaaaugcaacaaagagaauuagaccaaauaaucaaaaaccaaagcguuuauuacgacugguuagccgcgccaaauccaguagaaaaacaucgaaaaaguaugccguaccaacuugaugaauuacugaauuuccgaauaccauacuauguuggaccucuaguaacagccaaagaacagaaagcugcccaaggagggguauuugcuuggauggucagaaaagauccagacgguaacauaacacccuacaauuucgacgagaaaguggacagagaagccagcgccaauacauuuauacagagaaugaaaacuacagacacuuaccuaauuggcgaagaugugcuaccaaaacaaucccuccuauaucaacgauaugaaguccuaaaugaacucaauaacguaagagucaauaacgaaaaacuuagcauagaacaaaaacaacaaguaauaagagaacucuucgaaagacacaacagcguaacgauaaaacaauuugcugaaaaucuccgagcucauggugacuacgcacacaugcccgaaauacgaggccucgcagacgagaaaagauuuuuaagcucacuaucgacauaccgacaauuaaaaaguuuacuaccagaagcaauagacgauccagcaaagcaagcagacauagaaaauauaauagcauggucaaccgucuuugaagaugcggcuauuuucaaaacaaaacugaaagaaaucaacugguuagacucccaaacaaucacaaaacucucuaacaucagauacagaggauggggucaauuuucacacaaauuucuuaauggacugacacucggaaacggacacacgauaauacaagaacuauucuuaagcaauaacaaccuaaugcaaauacuuacagacgaaacacuacaaaagaaaaugacagaacuaaaugcagauaaacuaaaagccgcaaauauaaaugacgcuaucgaugauguuuauacaucaccuagcaauaaaaaggcacuucgccaaguuuuaagaguaauugaggacauuaaaagggcagcugacggacaagaucccucauggcuauauguagaaacugcagacggcggaggaacacccggaaaaagaacaagagcaagacagcaccaacuccaagagauauaugcaaaugcagcccacgaauuaaucgauagugccguucgaggugaauuagaagauaaaauagcagauaaagcagauuucaacgaccggcucguauuauauuucaugcaagggggccgcgacauauacacagguacgcccuuaaacauagaucaacuaucaaguuaugauauagaucauauucuuccucaaucacucauaaaagacaauucccuagauaaccgaguguuaguacacgcgauaauaaaccgugagaaaaaugcaacauucgccucaaccauauaugcccagaaaaugaaugccacuuggcgccaauggcacgaagcugguuuaauaagcggcagaaaacugagaaaccuacaaaugcgaccugaccagauugacaaauaugcaaguggcuucguagcacgccaguuaguagaaacaagacaaaucauuaaacuaacugaacaaauaguagccgcucaauacccugaaacaaaaauaaucgcagucaaagccgggcuaagccaucaguuacgagaagaacuagaguuccccaaaaacagagacguuaaucacuaucaucacgccuuugaugcauuucuugcagccagaauaggaacuuaucuauuaaaacgcuucccaaacuuacaagcauucuucacauauggcaaauuuaagaaagccgacguuaagaaacuaagaggauuuaacuucauccgugacaucacucacgcugaagauaaaauaguaguaaaagacaccggugaaguuauaugggacaagaaaagagauguggaugaauuagacagaauauauaauuucaaacgaauguugauaacucacgaagugcacuuugaaaaagcagaccuauuuaaacaaacggucuauggcgcuaaagauuccaaagaagcugggggaaagaaacagcucauuucaaagaagaaagguuacccaguagauaucuacggggguuauacacaagaaacaggaagcuaucuaagugucguuagacucacuaagaaagccauguaugcaguuguaaaagugucaaccagagaugcugcaaaacuagcaguggcgaaaucuauaagcgaacaaaaagaaaacgaaacucuaaacgacaucauagacgaaaaauuauccaaaauaaguaaaaaugggaaaauuacacacgaauuauuugaaguaguuuuaccacgaguaggacagaaaacacuauuuaaaaacucuaaauacaaucuuuuucuagucaacucggacacauacaugcauaauuaucaagaacuauggaugccaagagaauaucagaaaauguggaaagauaucagccuaaguaaauacggugacgcgcaaacugaagaccaauuagaucaaauuuucggcuucaucguuagccaagucaacuccuauuucaaucuguacgauaucaaucaauuccggaagaaauuaaaugaugccgcagacaaauuugcaacauuaccuaugcgagacacagacgacaugcaaggaaaaauugcuacuaucggccaacuacuuauaggucuccaagcuaaugcagcacgcuccgaucugaggaacuuagacauaaaaacaccacugggccuccuccaaauccccaauggcauaucuuuagacucagacacaaguguaguuuaccaaagcccaacuggacuuuuggaaagagaaguacaucuguccgaucuuuga

SEQ ID NO: 5399 - RNA, 4092 nt, Artificial Sequence
  Cas9 variant
augaccaaacuaaaccaacccuaugguauaggccuagacauaggauccaauucuauaggguucgcuguaguggacgcgaacagccaccuacuaaggcuaaaaggagaaacggcuauuggagccagauuauuuagggaagggcaauccgcagcagaucgacgugaaucaagaaccacaagacgaagauuaucaagaacaagauggagauuaaguuuccucagagauuucuuugccccucacaucacgaaaauugacccagacuucuuucuccgacaaaaauauucagaaauuuccccgaaagacaaagauagguuuaaauacgagaaaagguuauucaaugauagaacagaugcagaguucuacgaagccuacccaucaauguaccaccuaagacuccgacuaaugacagacgcaucucaagcagauccccgggaaaucuucuuagcaauacaccacauacuaaaaaguagagggcacuuucuuacuccuggugcagcaaaagauuucaacaccgaugaaguggauuuaaaacauaucuuuccugcacuagcagaagccuaugcgcaaguuuauccagauuuagaauugaacuuugauucagcgcuagcagaugauuuuaaagcaaaacuauuagaugaagaugcaaaaccuucugacauacaaaaagcccuaguuaacuuacuacuaucuucggacggcgaaaaagaaauaguaaagaaaagaaagcagguauuaacagaauuugcaaaagcaaucacuggcuuaaaaacaaaauucaauuuagcauuggggacagaaguagacgaagcugacgccucaaauuggcaauucuccaugggccaauuggaugacaaauggaguaauauagaaacgucuaugacagaccaagggacggaaaucuuugaacaaauacaagaacuauauagagcuagacuguuaaaugggauaguacccgcaggaaugucacuuucgcaagcuaaaguagccgauuacggucaacacaaagaagaccuagaacuauucaaaacauauauaaagaaacucaacgaccacgaacuagccaaaacaauaagagggcuguaugauagguauauuaauggcgaugaugcgaaaccauucuuacgagaagacuucguaaaagcucuaaccaaagaagugacggcgcaucccaaugaaguaucugaacaguuacuaaauagaaugggacaggcaaauuucauguuaaaacaaaggaccaaagcaaacggggcuauaccgguacaacuacaacaaagagaacuagaucaaauaauagcuaaucaaucgaaauacuaugacuggcuugcuaaaccaaauccgguggagaaacacagagcaagcaaaccauaccaauuagacgaacuuuugacauuucguauccccuacuaugucggcccacucauaacgccuaaacaacaggcagaaucaggagagaacguauucgcauggaugguucggaaaaacccaucaggcaauauaacgcccuauaacuuugacgagaaaguagacagagaagcaucagcaaauacuuuuauucaaagaaugaaaacaacagauacuuaccuaauagaugaagauguacuaccaaaacaaucucuacuuuaucaaaaauacgaaguauuaaaugaacucaacaauguacguauaaauaaugaagcccuaagcacugaucaaaaacaaagacuaauaagagaaguauucgagcggcauagcaguguuacuauaaagcaaguagcagauaauuuaguagcacacggagauuucgcacaaaggccugaaauuagaggauuagcugacgagaaaagauuuuuguccucacuauccacauaucaucaauuaaaagaaauuuuacauggcgcaaucgacgaccccacaaaauuacacgauauagaaaacauaauuaccuggucaaccguauuugaagaugcugcgaucuuuaaaacaaaacuagcagaaauagauuggcuagacccagcuacgaucaagaaguuaucaaauauuagguacagagguuggggacaguuuucccgaaaauuacuagauggucuaaaacuagggaauggacauacagugauacaagaacuuaugcuaagcaaccauaacuuaaugcaaauacuugcggaugaaacauuaaaagaaacaaugacugaauuaaaccaggauaaacuaaaaacagacgacaucgaggauguaauaaacgacgcuuauaccuccccaucaaacaagaaagcacuccgacaaguacuucguguaguagaagauaucaaacacgccgcgaauggacaagauccuaguuggcuguauaucgaaacagccgacggaccuggaacagccggcaaaagaacgcaaucaagacaaaaacaaauacagacagucuacgcuaacgcugcacaagaauuaauagauucagcagucaggggcgaacuugaagauaaaauugcugauaaagcaucauucacggaccgauuaguucuauauuucaugcaaggugguagagauauuuauacuggggcaccuuuaaauauagaccaacucucgcacuaugauaucgaucauauacuaccacaaaguuuaauuaaagacgauucacuagauaauagaguccuuguaaaugcgacaauaaauagagagaaaaauaacguuuucgcuucgaccuuauuugccggaaaaaugaaagccaccuggagaaaauggcacgaagcaggccuaauuuccggaagaaagcuacgaaacuuaauguugcgcccugaugaaaucgacaaauuugcaaaagguuucguugcaaggcagcuaguugaaacgcgacaaauaauaaaacugacagaacaaauagcugccgcccaauacccaaacacaaaaauaaucgcaguuaaagcaggccuaucucaccaacuaagagaagaacucgacuuuccuaaaaauagagacgugaaccacuaucaccacgcauucgaugcuuucuuggcggccagaauuggaacuuaccuauuaaaacgauacccaaaauugacaccuuucuuuacauauggugaauuugcgaaaguagacguaaagaaauuuagagaguuuaauuucauaggugcccucacacacgcaaagaaaaauauaaucgcaaaagauaccggugaaauaguaugggacaaagaacgagauauacaagaacuugauagaauauacaacuucaaacgcauguuaauaacccaugaaguucauuucgacauggcugauuuauucgaucaaacaauuuacgcagcaaaagacucaaaagaacgcgggggaaguaaaaaucuuauacaaaagaaacaaggcuacuugacaggaauauacgggggauauuccacagaacgaggaucguacgugagcauuauuagaacauuuaagaaaggagcuccaauauacaauaucguaaacauuaguaccgcugacgucuccuuacuuucagauaaacagcgaguuagcgaagcaucagcagacguccuucuaaaagaacuuauaaagaagaaacucgcaaaacguaaaagcggcgaaaauacaaaaucaggggcuuucgaaauaguauuacccagaguuggcaaaaacacuuuauucaaaaauaagaaauauggacuauuucuagucgaaucuacaacugaauuucauaacuaccaagaauuaugguugcccagaaaugaucaaauguuaauaaaaucaauacaaucacauaaaauagaagaaucuaaagcagauuaugaacuaacacgaauguaucgcaacauagcuucacaaguugaccauuacuuuggacuuuauacaauucguaaauucucugaaaaauugacagcaucaauuaaugauuauggcgcuuuaccgguauauaaaucagaaaccacggaugguaaauacgaaguacuaucuaacuuauucgagggacuaggaaguggaacaucaacaggaaaccuuacagcaguuaaacugcaaccuaauuuuggcaggguguauuuaacaaguggcauuguccuagaagacgauacaucgauaauauaccaaaguccaaccggucuauucgaaagaaguguuaaauuagcagauuuauga

SEQ ID NO: 5400 - RNA, 4092 nt, Artificial Sequence
  Cas9 variant
augacaaaacuuaaucaaccguacgguauaggcuuggauauuggaagcaauucaaucggauuugcaguuguagaugccaacucacaucuacuucgacuaaaaggugagacugccauaggagcaagacuauuccgcgaaggucaaucagccgccgaucgacgaggaucaagaaccaccagacgaagauugucacggacaagauggagacucagcuuucuacgagacuucuuugccccacacauaacaaaaauugaucccgacuuuuuccuaaggcaaaaauauagcgaaauaucccccaaagauaaagaucgcuucaaauaugaaaagagacuauucaaugaccgaacagaugcagaguucuacgaagacuaucccucaauguaucaucuuagacuacaccucaugacccacacacauaaagcagauccuagagaaauauuuuuagcuauacaccacauuuuaaaaaguagaggccauuuucuaacgccaggagcggcaaaagacuuuaacacagacaaaguggauuuagaagauauuuuuccagcauuaacugaagcauaugcacaaguuuauccagaccuggaacuuacauuugaucuagcuaaagcagacgauuuuaaagcaaaauuauuagaugaacaagcaaccccaucugauacacaaaaagcucuaguuaaccuacuacuuucauccgacggcgaaaaagaaauaguuaagaaacguaaacaaguucuaacagaguucgcaaaggcaauuaccggcuugaaaacaaaauuuaaucuagcauuaggaacagaaguagacgaagcugaugcaucaaauuggcaauuuaguaugggacaacuggaugacaagugguccaacauagaaacaaguaugaccgaucaaggcacagaaauauucgaacaaauacaggaacuauacagagcucgccuacuaaaugguaucguuccggccggcaugucacuuagccaagcuaaaguagccgauuaugggcaacacaaagaagaccuagaauuauuuaaaacuuacuuaaagaaacucaacgaccaugaacuagcaaaaacaauaagggggcuauacgauagguauauaaacggggaugacgcaaagccauuucuccgagaagauuuuguaaaggccuuaacuaaagaagucacagcucacccaaacgaaguauccgaacaauuacuuaauaggaugggccaagcaaacuucaugcucaagcaacgcacgaaagcaaacggagccauacccauacaauuacagcaaagagaguuagaucaaauaauagcuaaucaaucaaaauauuacgauuggcucgcggccccuaaucccguugaagcacaucgauggaagaugccauaccaauuagaugaguuauugaacuuccauauacccuacuacgugggaccacuaauuacaccaaaacaacaagccgaaagcggugaaaauguuuuugcauggaugguucguaaagacccauccgguaacauaaccccauauaauuucgacgaaaaaguagacagagaagcaucagccaacacauucauucaaagaaugaaaaccacagacaccuacuuaauuggugaggauguacuuccuaaacaaucauuacuauaucaaaaauaugaagugcucaacgaacucaacaauguuaggauaaacaaugaaugucuagggacagaccaaaaacaacgccuaauacgugaaguuuuugaaagacacaguucaguaaccauaaagcaaguagcagacaacuuaguagcacacggcgauuuugcacgcagaccagaaauacguggauuagcugaugaaaaacguuucuuaaguucacucaguacuuaccaccaacuuaaagagauacuucacgaagcgauagaugauccuacaaaauuacucgacauagaaaauauaaucacauggaguaccguuuuugaagaucauacaauauuugaaacaaaauuggcagaaauugaaugguuagaccccaagaaaauuaacgagcugucuggcauacguuauagggguuggggacaauucaguagaaaacuguuagauggcuuaaaauuaggaaauggacacaccguuauacaagaauuaaugcuaagcaaccacaacuuaaugcaaauccuugcugaugaaacgcuaaaagaaacaaugacagaauugaaccaagacaagcuaaagaccgacgacaucgaagacgugauaaaugaugcauauacaagccccucuaauaagaaagcucuaaggcaaguacuuagaguaguagaagauauuaaacacgcugcaaacggccaagauccaucuuggcuauucaucgaaacugccgauggaacaggaaccgccgguaaacguacccaauccagacaaaaacaaauucaaacaguguacgccaaugcagcgcaagaacuaaucgauagcgcaguccguggagaguuagaagacaaaauagcagauaaagccaguuucacagauagauuaguccuauacuuuaugcaaggaggaagagauaucuauacaggagcaccccuuaacauagaccaacuaucccauuacgauaucgaccacauauuaccacaaucauuaauaaaagaugacucgcuagacaaucgaguccucguaaaugcaacaauaaacagagagaaaaacaacguauuugcgucaacuuuauuugcagggaaaaugaaggccacuuggaggaaauggcacgaagcgggccuaauuucagggaggaaauuacguaacuuaaugcuacgaccggacgaaauugacaaguuugcaaaagguuuuguagcaagacagcuaguagaaacaagacaaaucauuaaacucacagaacaaauagccgcagcacaauauccaaacacaaagauuauagccguuaaagcaggucuaucacaccaacuaagagaggaacuagacuuucccaagaacagagacguaaaucacuaucaccaugcauucgaugcauuuuuagcagcacgaauaggaacauaucuucuaaaacgauauccaaaauuagcaccguucuuuacauauggugaauuugcaaagguagauguaaagaaauucagagaauuuaacuucaucggagcacuaacacaugcgaagaaaaacauaauagccaaagacacaggagaaauagucugggauaaagaacgagauauaagagagcucgaccgcauauauaauuucaaaagaaugcuuauuacacacgaagucuauuuugaaaccgcagacuuauucaaacaaacuauauacgccgcuaaagauaguaaagaaagaggaggauccaaacaauuaauuccaaagaaacaaggauacccaacacaaguguauggcggauauacccaagaaagugggaguuacaaugcucuaguaagaguagcagaagcagacacaacugcauaccaaguaaucaaaauuuccgcucaaaaugcauccaaaaucgcuucagcaaaucuuaaaucucgugaaaaagggaaacaacuauuaaaugaaauuguaguaaaacagcucgccaaaaggaggaaaaacuggaaacccagcgccaacaguuuuaaaauagucauaccacgauucggaaugggaacgcuuuuucaaaaugcaaaauauggcuuauucaugguaaauagcgauacuuacuaccgaaauuaccaagaauuaugguuaucaagggaaaaucaaaaacuccuuaagaagcuauuuucaauaaaauacgagaaaacccaaaugaaccacgacgcauuacaaguuuauaaagcuauaauagaccaaguagaaaaauuuuucaaacuauaugacauaaaccaauuuagagcuaaacucucugacgcaauagaacgauuugagaaacuacccauaaauacugacggaaauaaaauuggaaagaccgaaacauuacgacaaauuuuaauaggauuacaagccaacgguacuagaaguaacguaaagaaucuagguauaaaaacagaccuuggauuauuacaaguaggcucaggcauaaaauuggauaaggacacacaaaucguuuaucaaagcccaucagggcuguucaaaagaagaauaccucuggcagaccuauga

SEQ ID NO: 5401 - RNA, 4095 nt, Artificial Sequence
  Cas9 variant
augggugaccgaaaauacaaccuaggccuggauaucgggacaucgucgauaggauuugcagcgguugacgagaauaaucaaccgauuagaguaaaaggcaaaacagccauaggaguucgucuguucgaagaaggcaaaacugcagccgauagaagaggguucagaacaacaaggagaagacuuucacgccgucgcuggcgaaucaacuuauuaaaugaaauauucgacgcacacuuagcagaaguagauccaacauucuuagcaagacuaaaagagaguaaucgaaguaaccuagauccaaagaaaucauuccaaggaucacuucuauuuccugaacgaaaagauuaucaauuuuacgaagaauacccaacuauuuaucaccuaagaaaagcucuaauggaaaaagaccguaaauuugacuucagagagauauacuuagcaguccaucauauaauaaaauacagagguaacuucuuaaacggaacaccaaugcgaucauuuaaaguagaaaauauagaauuagacacccucuuugaccaacuaaaucagcuauacgcagaaauuguucccgauaacgaacucgcauucgaucuggcucaaguagcagacguaaaagacguuuugucaucuacaacgauuuauaaaauggacaaaaagaaacaacugguaaaaaugaugcuccuuccagcaucgaacaaagccuuacaaagcgaaaacaagaaaaucguaacacaauuugucaaugcaauacugaauuauaaauuuaaauuagaugucuuauuacaaguagaaacagaugccgacuggagucuuaaacuuaacgacgaaggagccgacgauaaacuugaagaguucacgggagaccuugacgaaaauagacuugaaauuauagacuuacuccaaagacuccauaauugguucucacucaacgaaauaacgaaagauggaaauagcuuauccgcugcaaugguugaaaaauacgagaaucaccaucaccaccucggacucuuaaagaaagucauagagaaucacccagacgccaagaaagcaaaagcacuaaaagaaacauacacagcauaugugggaaaaaccgacgacaaaacccaaaaccaagaugauuuuuacaaagcaguugaaaagaacuuagacgacucaccugacgcaaaagaaauuaaacgcuuaauacaauuagaccaauuuaugcccaaacaacguacgggccaaaauggagccaucccacaucaacuacaccagcaagaauuagaucaaauuauagaaaaacagucuaaauacuauccauucuuagcggaacccaauccaaauguaaaaagaagaaaagacgcaccuuauaaacuagaugaauugauugcuuucaaaauacccuauuacguugguccgcuagugacgccagaagaacaagcacagaacggagaaaacgucuuugccuggaugaagagaaaagcggcuggaccaaucacuccauggaauuuugacgaaaaagucgacagaauggaaucugcaaaucgauucauacguagaaugacaacaaaagacacuuaccuauucggagaagauguacucccagcagaaagcaugauauaccaaaaauucguaguauuaaaugaacucaauaaccugaaaauuaaugggcgccaucugucacuaaaagacaaacaagaugucuacaacgaccuauucaaacaacaaaagacaguaucaauaaaagcauuacaaaacuacuacguaaccaaaaagaaggccgcaacagccccaacaguaggcgguuuggcagacccaaagaaauuccuaucaagccuaaguacauauauagauuuuaaaaacauguucggugaaagaguaaaugauccucaguuccaagaagacuuagaacaaaucgucgaaugguccacaaucuuugaagaucguggcauauuuaaagcaaaacuacaagcacuaggauggcuaucggaaaaacaaauccaacaauuaguggcuaaaagauauaaagguuggggacgguuaucaaagaaauuacuuacaggacucaaaaacgcagaaggauacucaauuuuagacgaaauguggcgaucaacuggaaauuuuaugcaaauccaaucgcguccagaguucgcagcacuaauacaacaagcgaaugagaaacaauucgaagggaaugaccccgacaacgucugggagaauauugaaaauauacuaggagaugcauauacaaguccacaaaauaagaaagcgauaaggcaaguagucaaaguuguacaagacauagaaaaagcgguagguaauccacccgaaaagaucgcgauagaauuuaccagagaagcagcagcuaacccccaaagaacgcaaucaaggcuaagaaccuuagaaaaauuauacgaaucagccgaagaagugguagaugcaggguuaacagcagaacucgcggaguucaaagaaaauaaacacguacuuuccgacaaauacuacuuauauuuuacucaauuaggcagagauguauacacaggagacacaaucagucuugacaaauuaaacgacuaugauguagaucauauacuaccacaaucuuuuauaaaagaugauucacucgauaacagaguauugacgaucagagcugucaacaacggcaaaagcgauaacguuccagcaaaaauguuuggcaagaaaaugggcagcuucuggagauaucucuuagauaacggaaugauaucaaaaagaaaauauaauaaucugauaaccgaccccgacaacauuuccaaauacgcacaaaaaggauucauaaaccgccaguuagucgaaaccucacaaguaauaaaacuaacagcaaacauacuuaauggaauauaugauaaagacacagaaauaauugaaguuccagcaaaaaugaacucucaaaugagaaaaauguucgaccuaguuaaaguaagagaagucaaugauuaucaucaugcuuucgaugcuuauuugacaauuuucauuggaaauuaucuauacaaaugcuauccaaaacuucagccuuauuucgucuacgacaauuuuaagaaauucggaaacaaagaagauauuggccauaaaagauuuaauuucuuaggaaaaauugaaagagaaaagaaaguaguagccccagaaacaggcgaaaucuuguggucaaacguagcaccaaacgaaacaauaaaacaaaucaagaaaguguaugacuacaaauucaugauagucucgagagagauaacaacaagacgagcggaacuauucaaccaaacaguuuaccccaaaaauuaucauggcaaacuuauaccaauaaaagaggaucgaccuacugauuuauauggaggcuauucaggaaacacugaugcauaucuggcuauuguagcuuuagaagauaaaaagaaaggaaaauacuucaaagucguagguauaccgacucgaguagccgccaaacuagaaaaauugaaacagcaagacucccaacaauaccuacaagcacuucauaaagugauugcuccacaauucacaaaaucaacaaagaaaggaauaaagaaaacagaguuugaaauaguacucgauaaaguacacuacagacaauuggugcaagacgguccaguuaaaaugaugcuaggcaguucuacauauaaauacaaugcaaaacaacucguuuuauccgaaaaagcacuccaaguuauagcugacgaucgaaaauuugacgaaacacagaaagacgacaaucucauagcaguuuacgacgagauacucaguaucguaaaccaaucauucgaucuauaugacauaaacggauuuagaaagaaauuaaacgacaaucgugaccaauuuauagaucuuccggcagaaacuaaauacgaagggagaaaaguuguagcacacggaaaaagagaaaugauacuagaaauucuaaaaggacuacacgcuaaugcagcauucgguaauuuaaaaccaauaggauucaguaccgccuuuggacaacuacaagucccaaaugguauaaucuuaucgaaaaacgccauauuaauacaccaaucuccaaguggacuauucgagagaaaaaucaaacuuucugauuuauga

SEQ ID NO: 5402 - RNA, 4095 nt, Artificial Sequence
  Cas9 variant
auggaaaaacaggaguauuaccuaggacuagacaugggaauaagcagcguaggaugggcggucacaaaugacaaauaugaacuacuacguaagaaaggaaaagacaugugggguauaagagaguucgaagaagcggacucaagcgcagaaagacgaacacacagaguaaacagaagacgaagacaaagacaagucgcaagaaugggguuacuaaaagaauacuucucagaugcaauagaaaaaguagauaguaauuucuuuauacgaauagaaaacuccaaauauuucuuugaagacaaagauggcagacuaucaucaaagaaugguaucuuugaugaugcagacuauaaagacguagauuauuauacagaauaucccacgauuuuucaucuuagaaaagcacuuuuagacaucgaggacaccggaaaagaauaugacguucgacugguauaccuagcgcuaguaaacauguucaaacauagaggucauuuccuauuaaacacagaaggcgacgcacuaaguagcgagcaaguaaauacaaccuaccaagaauuacuagaaauauuagaaaacaacuaugauauauccuuagaaucucgagacauaaaggacguaauagauauuauuucaagcucagauaacggaagaaagaagaaacaugaacaaauacuagaauuauuuggagugaagaaaucagacaaaagggcaaaugaauuacuaaaaugucuaugugggcuuagcguaaaugcaaaauuaauauucgacgaaaauuaugaagaaaaaguagauuuguguuuccacgacuuuagcuauacagacaaaauuccagacuugauggagaaauuaagcgaggaagaauauuacgucguugaacaacuuaaaagcauauaugauuauucaauauuagcagguacacuaaaagguuacgauuacuuaucaugcgcacgagucgaacucuaugaaaaacacagagaagacuuaaaacuacucaaagcacuuuacaggagauacaaaacgaaugaggaguauaacgacauguuuaaaagcgacaaagaaggaacauacagugcauacguaaacucauuuaauaguucagacucuagugugaaaaucaaaaaguaccgauggaauaugaaaggaagaacaauagauaacuuauacgguacgauaaagaaggcauuuaaagauaauacagaugacaaggauguacaaucaaugauggaguccauugacaaagaacaauuuuuaccaaagcaacuaacaggagcaaauggggucauucccaaccaaguacacaaaaaggaaauggaaagaauacuuaagaaagcgcaaaacuaucuaccauucuuaaaagaaaaagacgaaagugaauugaccguaagcgaaagaauauugagacuuuuuacuuuucagauaccauauuauguaggaccauuaggcgaaaauucaaaaacaggauggguuguacgacgggaaggcgguaggguacuacccuggaacauagaugagaaaauagauaugagcgcaacgagugaagcauuuauagggaaccugaucagaaaauguaccuaccuaucugaugaaaaaguaaugccaaaagccucacuaaguuaugaacguuauuguguuuuaaaugaaaucaauaauauaugcauagauggagaacgccuagauacggaacuaaaacagaaaauauauacagaauguuucaugaaaggcaaaagaguuacaagaaaacaaauaugcaacuaucuuguagcacaaggauguauaaagagugaugaacaaguuacaggaaucgauaucaacgugaacucuucucugagcucauacggcaaaauguucgcaaucuuuggagaacacuuaaaagaagacgcaauacggaaggucgccgaagaaauaauauauugggguacaauauuuagugacucuaagaaaauguuuaggaaacacuuaacaaaauaugucgaacaggguauuuugggagaaucacagguaaaacggauucuagguuacaaauucaaggauuggggaagauucucaaaagcauuacuuacuuuacaaggaauagauaaauccacgggggaacuauuaucacuugaaaacgcgaugugggaauauaguuugaacuucauggaauuaauuaauucugaugauuucacauucaaagacgagcuugcuaacagaagaacaucugcaauuaagucauuauccgaauuuacauacgaagaccuugaggauacauauuuuucaguacccguuaagcgaaugauauggcaaacuaucuuaguaguaagagaaauagaacaaauaaugggguacgcgccaaagaaaguauuuguagaaauggcgaggucagaagaagaaaaaggugacaaaggcagaaaagacagccguggaacucaauuacuagaacuauacaagaacaucaaaaauaccgaaaaccaugauuggaagaaagagauaagcgaggcaaacgaaucuggaaaacuaagaucuaagaaacuauaucuauacuauacucagaugggcagagauauguauacaggggaagaaauaaacauagacauguuauacgaugacaguauguacgacauagaccacaucuauccacgacauuauguaaaagacgauagcaucgucaacaauuugguauuaguuaauaggagagccaaucaagacauaaagaaagacuuauauccgauaccagauaaaaucauuagcaacccuaaaguacaagaguuauggaaaaugcuacauaaacaaaaccucauuacagacgagaaauauaaaagacuaaugaguagaucuccauuuaccgaaaaacaacuaggagacuucauugcacgucagcucguagaaacuagacagggaacaaaagggauugcagaacuucuuggucaauuguucaaggacacagagauaguauaugcaaaagcgaccaauguaucagacuucaggagagauaacgguuuuguaaaaagcagauuaguaaaugauuuccaucacgcucaagaugcguaccuaaauaucguaguuggaaacguauacuauaccaaauucaccaaaaauccauggaacuuuauaaagaaagauuuugacaaagaccguaacaaaaacggguauaaccucgcaaaaauguucgauagagauguaguaagaggagacgacacggccuggaucgcaucuaagaaagacacccaaggaacuaucgaaacgguaagaaaaaugaugcguaaaaauaccccauuaaugacaagaaugucuuuugagcaacauggaggaauugcuaacgcuacacuguacucagcaaagaaagcgaaaguagaaaauuacauacccuuaaaaagcuccgauauaagacuaucagacguaaagaaauaugguggauuuacuuccgcaacaguagcguacuacuuuauaguccaccauaaagaaggaaagaaagaaaauacaacaauagaagcauuaccauuauauuguaaacgaaaaguagaaaacgaagaaaauggacuacuaaaauacugugaagaaguguuaggauacggagacgucaaaauauuguucaacaaacuuaaaauccaaucacuacuagauaucaacgguuaccaagcucauuuaucaggaaaaacuggcaaccaacuaacccuaaggaaugccaugaaccucugcguaccagaaaaauggacggcauauauaaagaaauuagaaaaauuagucgugggacacgugaaagaacaagagauaaguucagaagcaaauauagaacuauacgauuugcugaccgauaaacacuuaaauagcguguaugccaaaagaccaaaugcauacggacaaaaacucauagacaacagaucaagauucguaaauuuaaaaccggaaucucagugugaagcaauacuacaaauauuaaaacuuacaaaaauaggaaauaaugaaacaaaucugaaacuaaucggggaaucagagcacucaggaaaaauguuaauaagcaaaaauuuaaaagacacagacaaaccagcaaucauaugccaaucaguaacaggacuguaugaacgcaaaauauacauauucgaugaacaacuagacaaauga

SEQ ID NO: 5403 - RNA, 4095 nt, Artificial Sequence
  Cas9 variant
augaacaaacgcuauaauauuggucuagacaucgggacuaauagcauagguuggucaguagucaaugaucaaucacaacuuguuagaauuaaaggaaaacuaggcuauggaguacgcuuauacgacgaggggcaaacagcagaagaccgacggcucuuuagaaccacaagacgaagacugaagagaagaaaauggcgccuuggcuugcucagagaaauauucgaaccauauauuacuccucaagaugccacauuuuuccuaagacaaaaacaaucaaaucuauccccuaaagaucuacaaaaacaacaaccacaaauaggcuuauucaacgauagauuagauagcgacuuccacuaucaauacccaaccauauaucaccuaagauaugcauugaugacugaaaaacgccaauucgaucuacgugaaauauauuuagcaaugcaucacauuguuaaauacagaggacauuuccuuaaugcagcagcggcauccagcuuuaaaagcggagaaauagaucuagcuaaagauuucgcagcacuaaaccaaauauuuggcacaaucuuuagugaaguggguuuuaguuuauccgaaucgaaucuagacgaaauaaaaagcauauuauuagauaacaaccucucagcaagcgugagacaaaggaaagcccuaccauugauauaccaaacggcggcaagcaaagacucugaaaaacaauacaaagcaauagccacugaauuacuaaaagcuauauugggauuaaaagcaaaauucaaucuuauaacagguauugagguagaagacguaaaggcuuggacauuauccuucaacgcagaggauuuugaugcaaaacuaagcgaccugaauauugccgauaacgacgaugcaguacaaaucauagaaauccuccgcgcguuauacucuggaguauuauugacagguauagugccggaaggacaaaguauaucacaagcuaugauagacaaauacgaagcacauaaagcacaucuuauuauguuaagaucaauucgugaacaauuaucggauaaagaaaauaaagcacuagaaaaggcuuaugacgauuacauugaucaccccgaagauaaacaacacgggagcagagaagauuuuuaugcugcaaucacaaaaguacuaaagaaagauucagaagauacuaauaucauagaaauacuaaaauuaauagaacuggaccaguucaugccuaaacaacguacaaaagauaauggagcaaucccccaucaacuacaccaacaagaacuagaccaaauuauagaaaaccaaaaacaguacuacccauggcucgcugauauaaauccaaacgaacaacgacagaaaauggcaccauauaagcuagaugaacucguuacguucaggguuccauauuacguagguccaaugauaacagcagaagaacaauuucaaacuucaaauaagaaauucgcauggaugauacgaaaagaaccaggagcgauaacaccuuggaacuucgaccaaaaaguagauagacaagcaagcgcaaaugaauuuauuaaacgcaugacuacgacugacacuuaccuucucgcagaagaugucuuaccaaagcaaucacuuuuauaccaaagauuugaaguacuaaacgaacuaaauggaauuaaaaucgacgaccagcccauaaccguagaacaaaaacaagcuaucuuuaaugauaaauuuaugcaacaagcccauguaaccgucaaaaacauacaagcauaccuaguauccgagggccaauaugcaaguagaccuaacaucacaggacuuagcgacggagaaaaauucaauaguucgcuaucgacguaucacgacuuaaagaaaauuuucggagauaugauagaugaccccaauaaacaaacagauuuugagaaaaugauagaauggucgacuauuuuugaagacggcaaaaucuuugcggauaaacucagggaaauuaacugguuaacagaugaacaaagacaaagauuaucuaacaaaagauacagaggguggggccaacuaucaaccaaauuacucacuaaaauuguagaucaaaacggccaaagaauaauagacauccuauggaacacaaaugacaacuucaugcgcauaauacacucagacgauuuugaccaagcgguuacccaagcgaaccaaauguugcuagcugacaacgacacucaagaugucauaaaugaacuguauacaagcccaucaaacaagaaagcucugaggcaaauacucuuagugguugcagauauucaaaaagcaaugaaaggacaagccccugcaagaauacugauugaauuugcacgagaaaaacaggcaaacccuagacuaucaacucaacgaagacgacagguagaacaaguauaccaagaauuaaacaacgaucaguuaaauaaagaauuagcagacccacaauaugcuaaccuaucaaaagauagacuauuccuauauuucaugcagggaggaagagacauguauaccggcgaaagccuuaauauagaucgacucagcgaauacgacauugaccacaucuuaccacaagcguucauuaaagacaacucacucgauaaccguguacucgucuccgcuaaaaugaaccguaguaaauccgaucacguaccacuagauuucacugaggaacguuucggucagaaaaugcgaucacagugggaacaaaugcuacgugccggacuacuuacaaggcguaaauacaauaacuugaccuuaaacccugauucccuuaacaaauauacaaugucaggguucauuaauagacaauuaguggaaaccagacaaguaaucaaacuagccacaaaccucuuaguagaccaauacgccgaugaagacgugcagcuuguuacagucaaaaguggauuaacgcaccaaaugagagaagacuucgacuuuccuaaaaacagaaaccucaacaauuaccaucaugcuuucgaugcauaucucacagccuucguaggauuauauuugcuaaagaaauacccaaaauuagcccauuacuuugucuauggccaauaccaacaaggauuuaaagccaaugaucaauggagaaauuucaacuuuuuaaauggauuaagacaagaacaacaaguugacgcagagacaggagaauugaucuggcaaaaagaccacgaccucgcauauaugaacaaaaucuaugauuuuaagaaaauauugguaacacgcgaagugcauacuaaccauggcgcccucuauaaucagacacucuauaaagcaaaagacgacaaagcaucaggucaaggagggcggcaauuaauagcggccaaagaaaauagaccuaccgccauuuaugguggauauuccggaaaaacaguagcauauaugugccuaguacgaaucacagaaaagaaaggggacuucuaucgaauauguggaguacaaacagcauggguagacgaauuagaacauauagaagacgcuaccaucaaacuccaaagacuaacugcccuacuaacaccgcaauuuagcgcaacaaagaaacaaaaagacgaaguagucacaguagugaaaccauuugaaguacuucuaccuaaaauucuaaucaaucaaagauuuuacgacggaggacaagaacuuacacuagcauccgcaaccuacaaaaauaacgcccaagaauuaguacuagauaagaaagccguacaaguauugaauggucaacucccaaaagccgaacuagaagcucaagcaacaguuguauaugaucagauucucgaacgagugcaaaaauacuucccauuauacgauaugaauagcuuccgagaaaaacuuuuuguagguagagauaaauucaaugaguuaccauggcaagaccaaugggaaaaccauaaacuaauccaaguaggucagaaaacaauccuagaucgaauacuaauuggauugcacgcaaaugcugccaugggggaccuaaaagcauuaaacaugagcacacccuucggcaaacuacaaaaaucuaacggaauaucauuaucuccagaaacacaaauaauauaccaaucaccaacaggacuuuucgaaagaagaguugcucuuaaagaucuauga

SEQ ID NO: 5404 - RNA, 4095 nt, Artificial Sequence
  Cas9 variant
augaaaaaccuaaaagaauacuauauaggacuagacauaggaacagcaucagucggaugggcaguaacugacgaaucauauaacauaccaaaauuuaauggcaagaaaauguggggaguucgccuguuugacgaugcuaaaacagcagaagaacgcagaacacaaagaggaucaagacggcgauugaacagaagaaaagaaagaauaaacuuauuacaagaucuuuucgcaaccgaaauauccaaaguugauccaaacuucuuucuaagacuagacaacuccgaucuuuaucgagaagauaaagacgagaaacuuaaaaguaaauacacacuguucaacgacaaagacuucaaagaccgagacuaccacaagaaauacccuacaauccaccaucuuauaauggaucuuaucgaagacgaagggaagaaagacauaagauuacuguaucuagcaugucacuacuugcuuaaaaacagaggacacuuuauauucgaaggacaaaaauuugauaccaaaaacuccuuugauaaaucaauaaacgaucuaaaaauacaucuacgagaugaauauaacauagaccuagaauuuaauaaugaagauuuaaucgaaauaauaacagauacaacacuaaacaaaacaaacaaaaagaaagaacucaaaaacaucguuggagacaccaaauuccuaaaagcaauaagcgcgauuaugauagguucaagucaaaaacuggucgaucuauuugaagacggcgaauuugaagaaacaacggucaaaagcguggacuucucaacuacagcauucgaugacaaauacagcgaauacgaagaagcacuuggugacacgauaucauugcuaaauaucuuaaaaaguauuuacgacagcucaauuuuagaaaaucuauuaaaagaugcagauaaaucaaaggacggaaacaaauacauaucuaaagcauuuguaaagaaauucaacaaacauggcaaagaccucaaaacccugaaacgaaucauaaagaaauaucuaccgagcgaauacgcgaacauauuucgaaacaaaagcauuaacgacaauuauguugcauacacaaaaaguaauauaacaucaaacaaaagaacaaaagcgucaaaauuuacuaaacaagaagacuucuacaaauuuaucaagaaacaucucgauacaauuaaagaaaccaaacuuaacagcagcgaaaacgaagaccugaaauuaaucgacgaaaugcucacagauauagaguucaaaacauucauuccgaaacucaaaagcuccgauaauggcguaauacccuaccagcugaaacucauggaacucaagaaaauucuugacaaucaaucuaaauauuacgacuuccuaaacgaaagugaugaauaugguacagugaaagauaaaguagaaaguauuauggaguuccguauaccguauuacgucgguccauuaaacccagacagcaaauaugcauggauaaaaagagaaaacacaaaaauuaccccuuggaauuucaaagauaucguagacuuagacucaagucgagaagaauuuauagacagguuaaucggaagauguacauauuuaaaagaagagaaaguucuaccaaaagcaucacuaauauacaacgaguucauggugcucaaugaacuaaauaaucuuaaacucaaugaguuccuaauaacugaagaaaugaagaaagcaauuuuugaagaauuauucaaaaccaaaaagaaaguaacauuaaaagcaguaucaaauuuacuuaagaaagaguucaauuuaacaggggacauacuacuaucaggcaccgacggagacuuuaaacaagggcuaaauuccuacauagauuucaaaaacaucauaggggauaaaguagacagggaugacuaccgcauaaaaauagaggagaucauaaaacuaauagucuuauacgaagacgauaaaacauaucuuaaaaagaaaaucaaaucagcuuacaaaaacgauuucacugaugaugaaaucaagaaaauagcagcacuaaauuacaaagacuggggacgucucucuaaacgauuucugacagguaucgaaggcgucgacaaaacaaccggagaaaaaggcuccaucaucuacuucaugcgcgaauauaauuuaaacuuaauggaauuaaugucgggucacuacacauuuaccgaagaaguagaaaaacucaacccaguagagaauagagagcuaugcuacgaaaugguugaugaacuuuaccuaucaccauccguaaaacggauguuauggcagucccuaagagugguugaugagauuaaaaggauaauagguaaagauccgaagaaaauauucauagaaauggcaagagcaaaagaagccaaaaauucucgcaaagaaucacguaaaaacaaauuacuugaguucuauaaauucgguaagaaagcauucauaaaugaaauaggagaagaacgauacaacuaccuacucaacgaaauaaacagcgaagaagagucgaaauucagaugggacaaccuuuacuuauacuacacacaacuuggccguugcauguauagcuuagaaccaaucgaucuagcugauuugaaaaguaacaacauauaugaccaagaccauauauacccaaaaaguaaaauauacgaugacucauuagaaaacagaguccuuguaaagaaaaauuuaaaucaugagaaagggaaccaauaccccaucccagaaaaaguacuaaacaaaaaugcauauggauuuuggaaaauccuauucgacaaaggacuuauuggccagaagaaauauacucgacuaacccgaagaacaccauuugaggaaagagaguuagccgaguucauugaaagacagauaguagaaacccggcaagcaacaaaagaaacagcaaaccuacucaaaaauauaugccaagauucugagauagucuauagcaaagccgaaaacgcguccagauucagacaagaguucgacauuauaaaauguagaacaguaaaugacuuacaccacaugcaugacgcauaucuaaacauagucguugggaacguauauaauacgaaguucaccaaaaacccguuaaauuucauuaaagauaaagacaacguacgcucguacaaucuagaaaauauguuuaaauacgacguaguaagaggguccuacacagcauggaucgcggacgauagcgaaggcaauguuaaagcagcaaccaucaagaaagucaaaagagaauuagaaggcaaaaauuauagauuuacaagaaugucauauaucggcacaggaggucuauaugaccaaaauuuaaugagaaaaggcaaaggacaaaucccucagaaagaaaacacaaacaagucaaacauagaaaaauauggagguuacaauaaagcauccucagccuacuucgcauuaauugaaagcgauggaaaagcugguagagaaagaacacucgaaacaauaccaauuaugguuuacaaccaagaaaaauacggaaauacugaagcggucgacaaauaucucaaggacaaccuggaacuacaagaucccaagauacuaaaagacaaaauuaaaauaaauucauuaauaaaacuggacgguuucuuauauaacauaaaaggaaaaacaggcgauagccuuuccauagccgguucaguacaacuaaucguaaauaaagaagaacaaaaacuuaucaagaaaauggauaaauuccuuguuaaaaagaaagacaauaaagauauaaaaguaacauccuuugacaacauuaaagaagaagaacugauaaaacuauacaaaacacuuagugauaaauuaaauaaugggauuuacucaaacaaaagaaacaaccaagccaaaaauauuucugaagcauuagacaaauucaaagaaauaagcauagaagagaaaauagacguacucaaucaaaucauacuacuuuuccaaaguuauaacaauggcuguaauuuaaaaagcauaggacucucagcaaaaaccggaguaguauuuauacccaagaaauuaaauuacaaagaauguaaacuaauuaaccaauccaucacuggauuauuugaaaacgaaguagaccuacuuaacuuauga

SEQ ID NO: 5405 - RNA, 4098 nt, Artificial Sequence
  Cas9 variant
auguacaagaaagauuauaccguaggacuugauauaggcagcacaagcguuggauucgcugcaauagacgacgacuaccaaccuaucagauuaaaagguaaacgcguuaucggggucagacuauuugaagaaggaaaaacggcagcagaaagacgaaauuuccgcacaacgcgucgaagauuaaaucgaagaaaauggcgacuuaguuuacuugaagaaauuuucgacccauauauggcuaaaguugauccuacuuucuucgcucgauuaaaacaauccaaucucuuccccaaagacaaaaacaagaaauucaccggaucacuucuauucccaaaaacaacugacagcaaauuuuaugaugaauauccaacuauuuaucaucuccgauaucaucuaaugaacgauagucguaaauuugaucuaagagaaauauucuuagcaauucaucacauaguaaaauacagaggaaauuuccucaauuccgcccccaucgcuuccuucucaacagauaaaauuaaucucguagacgacuucgaaaccgucaacgccgcauaccuccaaauaaacagcuccaauccuguacaguuagauacugaccaagcggaucaaguaagcagaauccugcucgauaauaaacuaagcaaccuugacaaacaaaaacaagcagcuaaagcacuagcacagaaaaguggggacaagaaacaagacaaaauaaauaacacaacaauaaaacaaauauguaaagccuuauuagguuacaaauuugaccuagcuguaguacuaaauauagacagugacgaccacaacaaauggaaacugcaacucagugaugaaaauaucgacucgagacucgccgaacucacuggagaacucaacgaagcccaauuggacauauuaaauguccugagccgauuauauagccagauuacacuaaaugauaucguacccagugggaugacacuauccgaagcuaugaucgaaaaauauaaagcccauaagaaacauuuaaaaaugcuaaaagauuuugccagaucacuuaguaagaaagacuauggucaaguaauggaggcuuaugccgaauacauaggaaauauacccgaaucagccuccucuaaagcucaaaagaaaaucagccaagacgacuucuacaagaaaauaaaaagauaucuagacgauuccaaacugggacagaaaauugcagaauuaaucgccaaaaaugaauuuaugccaaaacaacgaacuaaucaaaacggcguaauaccuuaccaacuacacuuaaaagaacucaaucaaauaauagaaaaccaaucaaaauacuauccguggcuagcagaauuaaaucccaacgagaaaaggagaggaaaagcaaaauauaaacuuuccgaacuuguagcauuuagaaucccuuauuauguaggaccacuaauuacacaagaagaacaacaaaagaccaguaacgcaaacuuugcauggaugauacgaaaaagcgaagguaggaucacaccauggaacuucgaugaaaaagucgaucggauagcgacugccaaucguuucauaaaaagaaugacuacaaaggauacauaccuaauuggugaagauguccuaccagcacacucauuacuuuaugaacgauuuaaaguacuaaacgaauuaaacaugauuagaguuaauaaccaccgauuaucagucggacaaaaacaagauguauucgaaaaacucuuccaaaaacacaaaaccguaaagacucgagaacucauaaaacaacuaauggcuucaggcuuaccaacgcaaccaagaauaacaggauuaucagaccccgcaaaauuuaacacaagccuaggaacauauaauaacuucgccaaaauacucggagacgaaauaaaccaaccagaccgucaagaagacuuugagaaaauaaucgaauggauaacaauauucgaugauaaagauauuuuaaaaacuaaacucuccgaauuaucauggcuggacgaaaaacaaauuaaugccuuaauuaacaaaaacuauucaggauggggacgguuaucacgaaaacuacuaacagaauuaaccaacaagaaaggacaaucgauaauagaccgcauguggaacacacagaaaaguuuuauugaaaucaucaaugaacccgucuuugcagaacaaauuaaagacgccaaccaagaccaacuugaugaagacgacuacgaaaccguucuacacgaugccuauacgucaccacaaaacaagaaagccauaagacaaguuauuaaaguagucgaugacauagucagagccgccggcagagcaccaaaauucauuucacuagaauuugcacgcgaagaccaggaaucgagaagaacccaaucuagacuaucucggauaaagaaaauuuacgaaacaaccaccaaagagcuaguagccaacgaucagauaagagaagaacuuggaaacgucaaagaucuaaacgaucgauuguucuuauauuuuacccaacucggaagagacgcuuauacuggagaaaggauaaacaucgaugauauauccacaaaauacgauauagaccacauauucccccgcgcauuuaucaaagacgacucccucgauaauaaagugcuaguaaaaagagcuguuaacaauggaaaaaguaauaauguaccacucaaacucuucggagccaaaaugaaaccaauauggaaaauguggaaagaccaucaacuaauuucuaaacgaaaauaugaacaccuaaugacuaaccccgacgcaaucgauaaauacaaagccaauggauucauaaauagacaacuaauugaaacacgucaaauaauaaaacuagccgcaaauauacucgcaaacagauauucgacagaagacacgaaaaucauagaagucaaagcaaaucucaaucaccaacuucgacaaucuuuacaccuuuacaaaaaccgccaaguaaaugacuaucaucacgcugucgauggcuacuuaucagcauuugucggccaauaccuauaccaccgauacccgagucuacaaagcuacuucguauacggucaauaccagcgauucuucgauaaacaaguucaagaaaacaugaaauuuaacagauucaacuuucuauaugaccucacagacagagauaacgaucaaauaguugucaaaaguacaggcgaaaucguaggagaaaaauccaaacucauagaacaaauuaaauggguauaucgcuacaaauucaugcuaguaagccaagagguauucaccaaaacuggaccuuuguucgaucaaacaauauacccugcagggaguaauaaaucacgauuaauaccaaucaagaaagacagacccacagacauauacgggggauauagcucgucuacagacgccuacaugagccucaucagggucccagauaagaaagaagacaaauacaaaguagucggaguaccuucccgaagucuugcaucucuaaaucgagcagaaaaacgcgggcaugaugcauacuuagaucaauugagacaaguaaucgccaaaucacaaaagaaagaguuccaaauaauaauacccaaacucagauacagacaacuuauaaucgacggaggauugaaauauaccuuaggcucauccgccuaucaauacaacgcacgucagcucguccuaucagaaaaaucuauggaaguccuaguaacagacuuuucaaaaguaacaaccgauuuagacaaacaaaaccaaaaacucaucgcuguauacgacgacauacuagacaaaguaaaucgauguuuaccucuauacgacaaaaaucaauucagaaaagcccucaauggugcccgugacaaauuuguacaguugccuauacuaccaaaauucaacggaaacaagaaagaagaagcagguaaaguugaaauacuaaacgaaauuuuauuaggacuccacgaugaugcuagcacaggaaaucucaaaccucuaggaauaaaaacgcccuuuggaaugcuccaaacacaaagcgguauaacgaugucaucuaaugcuguaauuguuaaccaauccccaacaggacucuuugagcaccguauauaucucaaagcgcuacuaaacaaauuaaacaaauga

SEQ ID NO: 5406 - RNA, 4098 nt, Artificial Sequence
  Cas9 variant
augaccaaacuuaaucaaccuuauggcauuggacuugauauaggcucaaauucaauaggauucgcuguuguagacgccaauagccauuuauugagauuaaaaggagaaacagcaaucggagcuagauuauuuagagaaggacaaagcgcagcugacagacggggaucaagaacuaccaggcgacgauuauccagaacaagauggcgccuuagcuuccuuagagauuucuuugcgccccauauaaccaaaauagacccagacuucuuucuaagacaaaaauacucugaaaucucaccuaaagacaaagaccgauuuaaauacgagaaaagacuauuuaacgauagaacagacgcugaauuuuaugaagacuauccaucuauguaccaucuacgacuacaccuuaugacacauacccauaaagccgacccaagagaaauauuucuugcaauucaccauauucugaaaucuagaggucauuucuugacaccaggcgcugcaaaagauuuuaauaccgacaaaguagauuuagaagacauauuuccagcuuuaacagaggcuuacgcacaaguauauccagaucuagaauuaacauucgauuuagcaaaagccgacgauuuuaaagccaaacuuuuagacgaacaggccacgcccagcgauacacaaaaagcccuugucaagcuauuacuauccucggacggagaaaaagaaaucguuaagaaaagaaaacaaguccuuacagaauuugcaaaagcaauaacuggacuaaaaacaaaauuuaauuuagccuuagggacagaagucgacgaggcagacgcaucuaacuggcaauucucuaugggccaacuugaugacaaauggucaaacauugaaacaucaaugacagaccaagguacagaaauauuugagcaaauacaagaguuguacagagcaagacuuuuaaacgguaucguuccggcaggaaugucacuuucccaagcuaagguugcagauuauggccaacauaaggaagaucuggaacuuuuuaaaacauaucuuaagaaauuaaacgaucaugagcuagccaaaacuauuagaggcuuauacgaccgauacauuaauggagaugacgccaaacccuuucuucgugaagauuucguaaaagcacuaacaaaagaagucacugcacacccaaaugaaguaucggaacaauuacuaaacagaaugggacaagcaaauuuuauguuaaaacagagaacgaaggcaaacggagcaauuccgguacaacuucagcagcgagagcucgaccaaaucauagcuaaucaaucaaaauacuacgauugguuagcaaaaccaaaucccgucgaaaaacacagagcaaguaaaccauaucaacuagacgaauuacucacauucagaauaccauacuauguuggacccuuaauaacgccaaaacaacaagccgaaucaggagaaaacguguucgcauggaugguuagaaagaaucccuccggaaauauaacgcccuacaacuuugaugagaaaguagaccgagaagccagcgcuaacaccuuuauucaacgcaugaaaacaacugacacguacuuaauagacgaagacguacuacccaaacaaucucuacucuaucaaaaauacgaaguuuuaaacgaacuuaauaauguucgcaucaacaacgaagcccuaagcacugaccaaaaacaacgacuaauacaugaaguuuuugaaagacauucaucagucacuauuaaacaaguaguagauaaccuaguagcacacggugauuuugcacaacgucccgaaauaagaggacuugcugacgagaaaagguuccucucuagucuaucuacguaccaucaacugaaagaaauauuacacggagcuauagaugauuccacaaaauugcacgauaucgaaaauaucauuacauggucaacagucuucgaagacgcugcuauauucaaaaccaaacuagcugaaaucgauuggcuagacccagcuaccauaaagaaacucaguaacauucgcuauagaggauggggacaauuuaguagaaaauugcucgauggccuaaaacuugggaauggucauacaguaauacaagaguuaauguuaagcaaucauaauuuaaugcaaauauuagccgacgaaacccuaaaagaaacuaugaccgaguuaaaccaagacaaauuaaaaacugaugauauagaagacguaauaaaugaugcauacaccagcccuagcaauaagaaagcacuucgucagguccuuagaguaguagaagacauaaaacaugccgcgaacggacaagacccaagcugguuauacaucgaaacggcugaugguacaggcacagcagguaaaaggacucaaaguagacaaaaacaaauccaaacuguuuaugcaaacgcagcacaagaacuaauagacagugcuguuagaggagaauuagaagauaaaaucgcagacaaagcaucauucacagacagauuaguuuuauacuuuaugcaaggcggccgagacauauauacuggagcuccucuaaauauagaccaauugucucacuaugacaucgaccauauacuaccccaaaguuuaauaaaagaugacucacucgauaauagaguucuaguaaaugccacgauuaauagggagaaaaauaacguauucgcgagcacucuauuugcuaguaaaauggcagcaacauggcguaaauggcacgaagcaggauugauaucaggacgaaaacuaagaaaucuaauguuaaggccagacgaaacagacaaauucgcucacggauucgucgcucgccagcuaguagaaacuagacaaauuaucaaauuaacagaacaaauugcagcggcacaauaccccaacacuaaaauaauugcagucaaagcaggcuuaucacaccaauuaagagaagaacucgauuuuccuaaaaaucgugacguaaaucauuaucaucaugccuucgaugcguuuuuagcggcaagaauagguacauauuuacuaaaacgcuaccccaaacuagcaccuuucuuuacguacggcgaauuugcaaaaguagauguuaagaaauuuagagaguuuaauuuuaucggagcccuaacccacgcgaagaaaaauaucauugcuaaagauacaggugaaauuguaugggauaaagaacgcgacauacaagaauuagaccgaaucuacaacuucaaaagaaugcuaauuacacaugaaguacacuuugaaaccgcagaccuauucgaccaaaccauuuaugcagcaaaagauucaaaagaacgagguggacgaaugucucuaauaccgaagaaacuaggcuacuuaaccgguaucuauggaggauaccaaaccgaaagaggaucauauguaaguauaauuagaacuuuuaagaaaggcgaaaccauuuauaaagucguuaacauacuuacagcggacguuucccuccuaucugaaaaagaaaaaguaucgaaaacccuggcagauauuuaccugaaagaauuaaucgcuaagaaauuaucgaaaggaaaaucggggaaaaacauagccucggaaccauuugaaauuguacuaccuagaguaggaaaagacuccuuauucaaaaacaagaaauacggauuauuccuuauagaaucugcgacggaacuucacaauuaucaggaauuaugguuaccaagaaaugaccaacuauuaauaaaaaggauacaagcgcgacaaauugaagaaucaaaagccgauuacgagcucacacguauguaccgcaauauugcguggcaaguagaccauuacuucagauuauauaaaauucgaaaauucgcugaaaaacuacaagcgucagucgaggauuuugcaggauuaccuguauauaaaaaugaaaccucagacggaaaagucgaaguauuagcuaguguacugaaaagacuaaacggggcagcagauaaaggaagaacaaauccaaccacagucaaacuucagagcgacuucggaagaacucuauuaaccaacgguauuguucuagaagaugauaguuccauaguauaucaaucacccaccggacuuuuuaaacgaaguguaaaacucgucgaccuauga

SEQ ID NO: 5407 - RNA, 4098 nt, Artificial Sequence
  Cas9 variant
augacaaaagaauacuacuuaggacuugacguaggaacaaacucgguaggcugggcaguuacggauagucaauauaacuuauguaaauuuaaaaaaaaggauauguggggcauaaggcuuuuugaaucagcaaauaccgccaaagaccgcagauuacaaagaggaaauagacggagacuggaacgaaaaaaacagcgaaucgaccuccuucaagaaauauuuagcccugaaauaugcaaaaucgacccaacauucuucauaagacuuaacgaaucaaggcugcaccucgaggauaaaagcaaugacuucaaauacccucucuuuauagaaaaagacuauuccgauauugaauauuacaaagaauucccaaccauauuccaucugcgaaaacauuuaauagaauccgaagaaaaacaagacauucgguuaauuuacuuagcguuacacaauauaauaaaaacaagaggacacuuuuuaauagacggagaccuccaaucugcgaaacaacugaggcccauauuagacacuuuccuacuaucauuacaagaagagcaaaacuuaagugucucuuuaagcgaaaaucaaaaagaugaauaugaagagauuuuaaaaaaucgaagcauagcaaagagugaaaaaguaaaaaagcuaaaaaaucucuuugagauuuccgacgaauuggaaaaagaagagaaaaaagcccagucagcuguaauagaaaacuuuuguaaauucaucguagggaauaaaggagauguauguaaauuuuuacgaguaagcaaagaagaacuugaaauagauuccuuuucauuuucagaaggaaaauacgaagacgacauagucaaaaaccuagaagagaaaguucccgaaaaaguauauuuauuugaacaaaugaaagcaauguaugacuggaacauucuuguugacauauuagaaaccgaagaauacauaucuuucgcaaaaguaaaacaguacgaaaaacauaagacuaacuuaagacuuuuaagagacauaauucucaaguauuguacaaaagaugaauacaauagaauguucaacgacgaaaaagaagccggaucauacaccgcauacgucggaaaacugaaaaaaaacaauaaaaaauacuggauagagaaaaaaaggaauccagaagaauucuacaagagccucggcaaacuuuuagacaaaauagaaccuuuaaaagaagaccuagaagucuuaacaaugaugauagaagaaugcaaaaaccacacucuauuacccauacagaaaaacaaagacaauggggugauaccccaccaaguacacgaagucgaauugaaaaaaauuuuagaaaacgcaaaaaaauauuauuccuuccuaaccgaaacagacaaagacggauacucaguaguccaaaaaauagaaucaauauuuagauuccggauucccuauuacguggggccauuaagcacacgccaucaagaaaaagguucuaacgucuggaugguaagaaaaccaggaagagaagacagaauauauccauggaacauggaagaaaucauagauuuugagaagucaaacgaaaauuuuauaacaagaaugacgaauaaguguacuuauuugauaggagaggacguacuaccaaaacacucacugcuauacucgaaauacaugguacuaaacgagcuaaacaauguuaaaguacgaggaaagaaauugcccacaagucucaagcaaaaagucuuugaagacuuauucgaaaauaaaaguaaagucacaggcaaaaaccuguuagaauaccuacaaauacaagacaaagacauacagauagacgaucuaucgggauuugauaaggacuucaagacaagccucaaaucguaccuugauuuuaaaaaacaaauuuuuggagaggaaauagagaaggaauccauccagaacaugauagaagauauuauuaaauggauuacaauauauggaaaugacaaagaaaugcuuaaaagagucauaagagcuaauuacagcaaccaacuaacagaagagcaaaugaaaaaaauaaccggauuucaguacucaggauggggaaauuucaguaaaauguuucucaaagguauaucagguuccgauguaagcaccggagaaacguucgauaucauaacagcaaugugggaaacagacaacaaucucaugcaaauccuuuccaagaaauucacauucauggacaauguagaagauuucaacucaggaaaagucggcaaaauugacaagauaaccuacgauucaacagucaaagaaauguuuuugucaccagaaaacaaacgcgcaguguggcagaccauacaagucgcggaagaaauaaaaaaagucauggggugcgaaccgaagaaaauauucauagaaauggcaaggggaggagaaaaagugaaaaaacgaacaaaaucaagaaaagcccaauuauuggaacuauaugccgccugcgaagaagacuguagagaauuaauaaaagaaauugaagacagagaugaaagagacuucaacucaaugaaacucuuucuuuauuauacccaauucggaaaaugcauguauucuggugaugacaucgauauaaacgaacuaaucagggggaacucaaagugggaucgcgaccauauauauccacaaucuaaaauaaaagaugauucgauagauaaucucgugcucgucaacaaaacauacaacgcgaaaaaaaguaaugaauuacuaucagaagacauacaaaaaaaaaugcacucuuucugguuaucauuacuaaauaaaaaacucauaacaaagucaaaauacgaccgacuaacaagaaaaggggauuuuacugaugaggaacucucaggauucauagcaaggcaacucguagaaaccaggcaaucaacaaaagcaauugcagauauauucaaacaaauuuauaguagugaaguaguuuacgucaaaucaucccucguaucagauuuccgaaaaaaaccauuaaauuaccuaaaauccagaagaguaaacgacuaccaccaugcuaaagacgccuaucuaaauaucguagugggaaacguauacaacaaaaaauucacaaguaauccaauucaauggaugaaaaagaacagagacacaaauuacagcuugaacaaaguauuugaacaugacguuguaaucaacggagaaguaauaugggaaaaauguacauaucaugaagacaccaacacauacgauggaggaacacucgaccgaauaagaaaaauaguggaaagagauaacauacuguauacugaauaugcauacugcgaaaaaggugaacuauucaaugcaacaauucaaaacaaaaacgggaacagcacuguuucacuaaaaaaagguuuagacgucaaaaaauacggaggauacuucuccgcaaacacaucauacuuuucacucaucgaauuugaagauaaaaaaggcgacagagcaagacauauaauuggaguaccaauauacaucgcuaauaugcuagagcauucaccaagugcauuucuagaauauugugaacaaaaaggauaccaaaauguacgaaucuuaguagaaaaaauaaaaaaaaauagcuuacuuauaauaaauggauacccauuaagaauaagaggugaaaacgaagucgacacuucauucaaacgcgcgauccaacuaaaacuugaucaaaagaauuacgaauuaguacguaacaucgagaaauuucuggaaaaauauguagaaaaaaaaggaaacuauccaaucgaugaaaacagagaucacauuacacaugaaaaaaugaaccaacuauaugaaguacuacuaaguaaaaugaaaaaauucaauaaaaaaggaauggcugaccccucagaucguauugagaaaagcaaaccaaaauucaucaaacuagaggaccuaauagauaaaauaaacguaauaaacaaaauguuaaaucuacuccgaugugacaaugauacaaaagcggaucuaucauuaauagaauuaccaaaaaacgcagguaguuuuguuguaaaaaaaaauacaauagggaaaucaaagauuauacuagucaaucaaaguguaacaggccucuaugaaaaccgacgggaauuauga

SEQ ID NO: 5408 - RNA, 4098 nt, Artificial Sequence
  Cas9 variant
auggacacugccaaaaccaacaaacaacccuauuacauuggcuuagacauggguaccucgucagucggaugggcugucacagacgcuuccuacaauguggucaagaaacacggaaaagccuuaugggguguccguuuguuugaagaagcacaaaccgcagcugacagaagguuacaucgaacagcuaggcgucgaauacaaagaagaaaacaaaggcuugcauuauuacaagaauuauuugcaaaagaaauaugcaaagucgauccgggcuucuucauacgacuacacgaaagcagacuauggcaagaagauaaaagcauagaucaaccuaacacuuuauuuaaugaugaagauuucgacgacaaagcauaccauaaagccuauccaacaauauaccaccuuagauacgccuuaaugacagaaaacaagagcuucgacgucagacugguuuauuuagcuauacaucauauaauaaaacaccgcggccauuuccuacuagaaaauuaugaccucaguaaucaagaaacaaguggauuugacgaaucuuauauugcccugacaaacgcaauuaaagaacuucuccaaaaagagauuccaguuggacauguggagaaaauucaaauaauacuuaaagacaaaucgcuaucaaaaagagagaaaacagagaaaauccuacaaguuugggacguaauaaaagauaaacaauuaaaagaagugguacaauuaauauguggcgguacagcaaaucucucaaccuuauucauggacgaaucccuaaaagaagcacuaaaaguauuugaaaucaaagacucaaaaauuagcuucucaacugcgguguaugaagaaaaagaaucagaccuacaaagcguacuagaacaacgauuugaccuagucuaugcugccaaaaugcuguacgauuggucucuucuagcagaacuaaugggcgauagaaaaacccuaucagaagcaaaaauugcaauauacgaaacacauaagaaagaucuagaagucuuaaaacguuuaacaagacaagauaaaucucuauaccgcaaauuauuccgaggaaccgacaaagauucauauagcgcauacgugggaagcugcaugauacauggagaaaaauuaguaauagagaaaagaggcucaaccgaagaauuuuacaaauuucucaagaaagaaauuucgaaacuaccagauugcgaagauaaaauuuacguacucucaaaaauugaggcagaaaacuucuuaccaaaggcaguauccaccauaaauggaauaaucccuuaucaacuacaagagcaagaauuagacaucauucuaaagaaggcggaacaguaucuaccauucuuaauggaaaaagacgcauauggaacaauaagugagaaaauaaaacaauuacucacauuccguauuccauucuacguaggacccuuaaauagacacagcgauaaaucaugggcuguucacacugauaaagaaggaaggauccucccuuggaacuuuaaugaacgcauaaaugaagagaaaagcgccgaaaaguucauaacaagaaugaccaacaaaugcaccuacuuguuaggaaaagacguacuacccaaaaacucucuauuauauacugaauauaugcuauuuaaugaacugaauaacgucaagaucggcaaggcaggaaccuauuugacugaagaacaaaaagaaaaacuguggaaagaacuauuucuuacuacaaagaaaguaacacuaaguaaauucaguaaauuccuaauuaaagaaggaaucgauaaagaagaagcggucgaaauaaaaggauuagacgguggauuuaaaucaucguuagcaccguggauagaucuuaaaaacauacuaggggaagacuuuacaagggacaaagcagaagaaauaauaaaggcuaucacauuauuuagcauggauaagaaaauacucaagaaauauuuaaugagaauaguuagugaaccaguugcaaaacaguuaucaaaacuacgauauacugguuggggcagauucucaaaagaguuccucacggaaauaacaccccgagugacagacgauguccaaguacuugucgacacaagcacuggugaaauaaugaacaucauaacagcuuuaaagaaaacgucauuaaaccuaauggaaauauuaaguucaacguacgguuacucagcagcaauuucugaagccaacaaagaacugguugguaauacaguacucagcuacgaaacaguuaaagaacugacgguaagcccagcuguaaaaagaccaauauggcagacacuaaaaauaauaaaagaaauaacucauaucaugggugcagaacccgcacgaauauucaucgaaauggcgcgagacaaacaaccugacaaagguagaaccgauucacguaagaaacaauugaucgaacuauacaagaaauguaaagaagacguucgcucuuggagcaaucgagaaagcaaagacugggucgaagaaauagaaucaaaaucagauucccaacuccgauccaauaaacuauuucuauauuacacacaaaugggcaaaugcauguauacaggcaaaccuauagaccucggagcacuccuaaagggacaacuauacgacagagaucacauauacccgcaaucacaaacgaaagacgauagucuagacaaccuaguaauagucgacaaucgagaaaacagagacaaguccaacacauauccauuauccaaaaauaucagagaaagacaaauuggauucuggaaacuauuaagagacaaaggauucauaucuaaagaaaaauacuuccggcuaacuaggaauacccccuuuuccgacgcggaaaaagcggaauuuauagcgagacagcuagucgaaacccgacaaucaacaaaagcagucgccgaaauacuuaaacguguauuaccaaaaucaauuauaguguauguaaaagcgggacugacaucaagauucagacaauauggagaauuuauaaaaguaagggaucuuaaugauuaccaucaugcaaaggaugccuacuuaaauauaguaacuggcaacguacauuacacaaaauuuacauccaaucccauacgcuucguaaaagauugccaaauuuauucacugaacgaacacgcccucuacaaauauacgguagaaagaaauggaguaguugcaugggccccuaaugaagaaggaaugaugccauccguaacgagauggaugaacaaaaacaacauccuagucacccgcaugagcuauguuggucaaggcgaacuauucgaucaacucccucucaagaaaggcaaaggacaaguaucauuaaagaaagaaggagcgauuucugacauuucuaaauacggcggauauaacucugccucaacugcauacuucauguacguugaaggagaagacaacaaaggaaaacccgucuacguaauagaaaccaugccccuacauuuagcagcacgccucacaacacuagaagaaaaacaaaaguauugugaagaauuauggauguccacaggcggcaaacuuaaaaacccuaaaguucuaauagaacaaaucccuauacaaaguuuauucucaguagacggauucagagugaccaucgcaggaaaaacuggaaaacaauacgggugccgauuagcagaagaacucguacuaaacaacggauaugcaaugacgcuaaaggcuguauuaaaauucgugaaucgaagaaaaaugaauaaagaagcacuuauuacaaguuaugaccaucuagaagaaagccaguuacuagcauuguacgacguauuuuuagacaaacuagagcacucguguuuuaguaaaagauucagcacacaaagagauguuuuaaagaaugggcgcgaaaguuacaucgcacuaucacuagaagacaaaugccaaauacucucagaaauccuacaucuuuuucaaugcaacgcuacauuauccaaucuguccuuacucggaucuuccaaacaguccggacgauuauacaugagcaaaaaucuaucagauaaagauucaugguacauaauccaucaaagcguaacagguuuuuacgagcaacacauaccacuagcacccuacaagaaaucauga

SEQ ID NO: 5409 - RNA, 4098 nt, Artificial Sequence
  Cas9 variant
auggugaaaaagaaauaugccauuggcauagauauaggaacaaacucgguagguuggucggucgucacagaugacuacaaaguacccaguaagaaaaugaaagucuuuggaaauacagaaaaacgauauauuaagaaaaauuuauuaggaacauuauuauuugaugaaggcaauacagcagaaaaccgaagauuaaaacgaacagcaaggagaagauacacucgcagaagaaauagaauacucuacuuacaagaaauauucgcagaagaaauuaacaaaauagaugacucauucuuucaacgauuagaugacucauucuuaauaguggaagauaaacaaggauccaaacacccaaucuuuggaacguuacaagaagaaaagaaauaccauaaacaauucccaacaauauaccaucuaagaaaacaacuagccgacuccucacaaaaagccgacauacggcuaauauaucucgcacuagcucacauaauaaaauaccgaggacacuucuuguucgaaggugaccuaaaaucagaaaacaaagauguccaacaucuuuuuaaugacuucguagaaauguuugauaagacgguugaaggaucauaccucagugagaauuugccaaacguagcugacguauuagucgaaaaagucucaaaaucaagacgacucgaaaacauacuacacuauuucccaaaugagaagaaaaacggacuauucggcaacuuuuuagcauuagcacuaggcuuacagccaaauuuuaaaaccaauuucgaacucgcugaagacgccaaaauccaauuuucuaaagaaacauacgaagaagaccuugaagaacucuuaggcaaaauuggcgaugauuaugccgaucucuuuauugcaaccaaaucucucuaugacgguauucuacucgcuggaauacugagcacuacggauucaacaacaaaagcacccuuauccucuucuaugguaaaucgauacgaagaacauaagaaagaccucgcucuacugaaaaacuucauucaccaaaacuuaagugacucauauaaagaaguauucaacgauaaacugaaagauggauaugcaggauacaucgaaggcaaaacaacccaagaaaacuuuuacagauucauaaagaaagcaauagaaaagauagaagguucagacuacuuuauagauaaaaucgacagagaagauuucuuaagaaaacaacgcacguuugauaauggcuccauuccacaccaaauccaucuccaagaaaugcacgcaaucauuagacgacaagcagaguucuauccuuuccucguagaaaaccaagauaaaauugagaaaauucucacauuccgaauaccuuauuacguaggaccccucgcaagaggcaagagcgaguucgcauggcuaaaccggaaaucugacgagaaaauacgcccauggaacuucgaugaaaugguagauaaggaaacaucagcagaaaacuuuauaaccagaaugaccaacuaugaucaauauuuaccagaccaaaaaguccuaccuaaacauucucuacuuuaugaaaaauuugcaguauauaacgaacuaacaaaaguaaaauuuauugcggaagguaugcgagacuaucaguuccucgacuccgggcaaaagaaagacauaguuaaaacacucuucaaaaccaaacgaaaaguaacagcaaaagacauaaaagccuaucuagaaaacagcaacggauaugccggcguagaacugaaaggucuugaagaacaauucaaugcgagccuaccgacauaccacgacuuacugaaaauauuaagagauaaagcauucauagacgcagaagaaaaucaagaaauauuagaagacauaguucuaacauuaacacuauucgaagacagagaaaugauacgaaaaagauuagaaaaauacaaagauauacuaaccgaagaacaaagaaagaaacucgaaaggcgucacuauaccggauggggacgauugagugcaaaauugauaaacggcauacuggauaaaguaacccgcaaaacaaucuuaggauacuuaaucgaugacggaacgagcaaucgaaauuucaugcaacuuaucaacgacgauacccucuccuucguagacgaaauaagacuagcacagggaucaggagaagcagaagacuaccgcgccgaaguacaaaauuuagcuggaucuccagccauuaagaaaggaauccuucaaucgcuaaaaaucguagaugaacucaucgaaguaaugggauaugacccagaacacauugucguagaaauggcaagggaaaaucaauuuacuaaccaaggucgacgaaacucacaacaaagauacaagaaaaucgaaaacgccauuaaaaacuuagacucaaacuuaaacagcaaaauauuaaaagaauaccccacuaacaaccaagcucuacaaaaugacagauuauuuuuguauuaucuccagaacggaaaagauauguauacagacgaagaauuagauauagaccaacucagucaauaugacauagaccacauuauaccccaagcauucaucaaagacgauaguuuagauaacaaaguucuuacaaaaagugccaaaaacagaggcaaaagcgacgauguuccauccuuagaaauaguucacaaaaagaaaaauuucuggaaacaauuguuagacucccagcucauaucacagcgaaaauuugacaauuuaacaaaagcagaaagaggcggacuaacgaaugaggacaaagcaagauuuauucaaaggcaacucguagaaacacgccaaaucaccaaacacguagcuaggauuuuagacaccagguucaacacgaaacuagacgaagccgggaaccgaauaagagaucccaaaguaaacauaauaaccuuaaaaagcaauuugguuagucaauucagaaaagacuaucaacuauauaaaguacgagaaauuaacaauuaucaccacgcacacgacgccuaccuaaacgcuguagucgcuacagcucuccuaaagaaauacccacaacuagcaccggaauuuguauacggggacuaccccaaauacaauagcuauaaaucuagaaaaagcgccacugaaaaaguacucuucuauuccaacauuaugaacuucuuucgcagaguccuaguauauagcaaaaccggugaaguacgaauaagaccaguaauugaagucaauaaagaaacaggcgaaauaguuugggauaagaaaagcgacuucagaacaguaagaaaaguacucucauacccacaaguuaacguugugaagaaaguagaaaugcaaacaggagguuuuucaaaagaaucaauacuacaacacggcgauucagacaaauuaaucccuagaaaaaccgaaaaauucuaccuagauaccaagaaauauggagguuuugauuccccuacaauagccuacagcguauuauuaauagccgauauagaaaaaggaaaagcaaagaaauuaaaacgcguaaaagaacucauaggaauaaccauaauggagaggauggcuuuugagaaaaaccccauagaauuuuuagaacacaaaggcuauaaaaauauuuuagagaaaaacauuauaaaacuaccaaaauauaguuuauuugaacuagaaaacggaagacguagacuccucgcuucugcaaaagaauuacaaaaaggaaacgaaaugaucuuaccaccacauuuaguaacccuuuuauaucauaguucaaauauccauaaaauaacagaaccaauccaccuaaauuacguaaacaaaaauaaacaugaguucaaggaauuauuaagacauauaagcgauuucucaaccagguauauauuagcacaagaccgauuaucaaaaauagaagaauuauacgacaaaaaugacggggaugacauauccgauuuaaccucgaguuucgucaaucuucucacuuuuacagcuaucggcgcccccgccgccuuuaaauucuuaggcucggucauagauagaaagagauauacaagcaucgcggaaauauuagaagcuacccuuauacaccaauccguaacgggauuauacgaaacaagaauagaccucagcaaauuaggcggcgacuga

SEQ ID NO: 5410 - RNA, 4101 nt, Artificial Sequence
  Cas9 variant
augaagaaaccauacucaaucggucucgauauaggaaccaacuccguggguugggcagugauaacggacgacuauaaaguaccagcaaagaaaaugaaagucuuaggcaauacaaacaagaaaaccauaaagaaaaaccuaauaggugcacuacuuuuugaugcaggaaacacagccgcagauagacgcuuaaaaaggaccgcgagaagaagauauacaagaaggaggaaccggauuuuguacuuacaagaaaucuuugccgcugaaaugaauaaacuagaugaaucauucuuucaccgacuagacgauucguuuuuaguaccggaagacaaaggaggguccaaauauccaauauucggaacauuagaagaagagaaagaauaccacaaacaauucccaacaaucuaucaccuacgaaaaagccuagcagauagcaaggaaaaagcagaucuuagauugaucuacuuagcccuugcucauauaauaaaauauaggggucauuuccuauacgaggacacuuuugacauuaaaaauaaugacauacagaaaauauuuaacgaguucacaucaauauacaacaacaucuuugaagaaucaucccuaucuaacgaaaaugcacaagucgaagaaauauucaccgacaaaauaucuaaauccgcaaagaaagauaggguucuaaaacucuuuccugaugaaaaaucuacaggcuuauucagugaauuucuaaaacuaauaguaggaaauaaagcagacuuuaagaagcauuucgaucuggaagagauggcaccauuacaauucagcaaagauaccuaugacgaagauuuagaaucauuauuggggcaaaucggagacgacuaugcagacuuauucguugucgcaaagaaacuauacgacgcgauuuuacuagcaggaauccuaaguguaaaagacccagccacaaaagcaccauuaucagcaucaaugauagaaagauaugauaaucaucaaaaugaucuaucagcacuaaaacaauucauaagaaguaaccuaccagaaaaauacgcagaagucuuuucagaugacucaaaagaugguuaugcaggauauaucgacggaaaaacaacucaagaaggauucuauaaauacauuaaaaaccaaauaaguaaauuugaagguacaaaauauuuccuagagaaaauagaaagggaggauuuucuaaggaaacaaagaacauucgauaacggaucaauuccacaucaaauccaccuacaagaaaugaaugccauuuuacaaaaucaaggagguuauuaucccuuccuaaaagcgaacaaagagagaauagaacaaauacuaacauucagaauaccauacuaugucgggccuuuagcuaggggaaacucugacuucgcauggcuuaccagaaacucagaugacgcuaucagaccguggaauuucgaagaaguuguagauaaagcaaguucugccgaagauuucauaaacaagaugacaaauuacgacuuauauuuaccagaagaaaaaguccuccccaaacacucauuauuauaugaaacauuugccguauacaacgaacuaacaaaggugaaauucaucgcggaagcaaugaaggauuacgaguuccucgacucgggacaaaagagaaaaaucguugaaaauaucuuuaagaaucauagaaaaguuacagaaaaagauauuauuaauuacuuacauaacguugauggauacgacggaauagaaauaaaaggcauagaaaaacaauuuaacgcaucauuauccacauaccaugaccucuugaaaauaauaaaagauaaagaguucauggauaauccuaaaaacggagaaauacuagaaagcauaauccacacccuaaccauauuugaagacagagagaugauaaaacaacugcuagcacaguauaauucaguauucgacgaaaaaguaauaaaagcacuaaguagaaaacauuacacugguuggggaaaauugucagcaaaacuaaucaauggaaucagagacaaacagacgggaaacucaauucuagacuaucuuauggaugaugggaaaucuaaucggaauuuuaugcaacuuauuaaggaugauggccugagcuuuaaagaaauaauagauaaggcccaaguugugggcgaaacagauaauuuacgccaaguaguacaaaaccuaccaggauccccagccaucaagaaaggaaucuugcaaucgauuaagcuaguugacgaauuaguuaaaguuaugggaucagacccagaauccaucguaauagaaauggcaagagaaaaucaaacaaccaacaaagguaaauccaaaagccaacaaagacucaaaacacuaagcgacgcgauaucugaauuaggcagcaacauuuuaaaagaacacccuacagauaacauacaauugcaaaacgacagacuauuccuguacuaucuacagaacggcaaagauauguacacaggugaagcacuagauauaaaccaauuaucaaauuacgacauagaccacaucauaccucaagcauuuauaaaagacgauucacuagacaauaguguguuaacgucaucaaaagacaacagagguaaauccgacaauguaccuucguuagaaauaguagagaaaaugaaaggcuuuuggcaacaauuauuagauucaaaauuaauaagcgaaagaaaauuuaacaacuuaacaaaaguagaaaggggagguuuagaugaacgagacaaaguaggauucauaaaacgacagcuaguagaaacaagacaaaucacaaaacacguagcccaaaucuuagacgcaagguuuaacgccgaaguaaaugagaaaaaucaaaaauuacgaagcgucaaaauaaucacacuaaagagcaauuuaguaucuaauuuccgaaaagaguucggcuuauauaaagucagggaaauaaacgacuaucaccacgcacaugacgcauaccucaacgcgguaauagcgaaagccauacucaaggaauauccgaaauuagaaccagaguucgucuacggugacuaccaaaaauacgaccuaaaacgauauauaucccgaacuaaagauccaaaggaaauagaaaaagccaccgaaaaauauuucuuuuauucuaauuuacuaaacuucuuuaaagacaaaguguauuacgcagacggaaccauaauccaaagagggaauguagaauacucuaaagacaccggagaaauagcauggaauaaaaagagagacuuugcuauaguccguaaaguauugucauauccacaaguaaauaucguuaagaaaacagaagaacaaacaggagguuucucuaaagaaaguauacuaccaaaagguaacucagacaaauuaaucccaagaaaaacuaaaaauauccaacuagacacaacaaaauacggaggauuugauucuccaguaauagcuuauucaaucuuauuagucgcagauguggagaaaggcaaaucgaagaaacucaaaaccgucaaaucacucauaggaauaaccauuauggagaaagucaaauucgaagcgaauccagucgccuuccucgaaggcaaaggcuaucaaaauguagucgaagaaaauauuauacgucuaccaaaauacaguuuauucgaguuagaaaacggccgaaggagaaugcuagcaucaaguaaagaacuucaaaaaggcaaugaaaugguauuaccaaguuaucuauuagcgcuacucuaucacgcuaagaaaauccaaaagaaagacgaaccagagcaucuagaauacauaaaacaacaucauucagaauuuaaugauuuacuuaauuuuguaucagauuuuucacaaaaauacguuuuagcagaaaguaauuuagagaaaauuaaaaacuuguauauagauaaugaacaaacaaaucuagaagaaauagcaaauaguuuuauaaaccuacuuacuuucacugcauuuggugccccugcaguuuucaaauucuucggaaaagacauagaacgaaaacgauacuccaccguaaccgaaauacuaaaagcaacgcucauccaccaaucuaucacaggcuuauacgaaacgagaaucgaucucagcaaacuaggagaagaauga

SEQ ID NO: 5411 - RNA, 4101 nt, Artificial Sequence
  Cas9 variant
auggauaagaaauauaacauaggcuuagacauaggaacaucaucaauaggcuucguagcaacugaugaagauaaucacguuauacgcgcaaaaggcaaaaacguaauuggagucagauuauucgaugaaggucaauccgcugcagaaagaagaggauuuagaacaacuagaaggagauuaaaucgccgaaaauggagacuaaauuuacucagagagauuuuugaaccccacauauauccuauugaugccaguuucuuuaugagacaaaaauacucaaacuuaaguaaacaagauccaaaucagaaaauagaguuuaaagacauacuauucucagauaaaucagaugcagaguucuaccgacaauacccuacgaucuaucacuuaaggcaagcccucaugaccgagaaaagacaauuugaucuccgagaaauuuauuuggcaauacaccacauuguaaaguacagggggcacuuuuuagaugaaaccccuacagauaaauucucuuuugaccaacucgaccuaacccaagaauuugaacgucucaauguacucuuuagcgaacaaaacccugaagaaccauuugaaauaguuguaaaccaaaaccaaagcauagaagauauccuuucaaaccaauccaugacagcauccgaucgaagaaaacaagccuuaguaguauucuaucaacaaagcgaaaauaaagaaaacgaaaagcaauacaaagcaauagcuacagaaauauuaaaucuacuuuuaggaaacaaagcgaaacuuaaugucauuuuagcucaagaagucgacaaagaagcagccaaagauuggucacuaucauuaucaagugaaacauuugacgacgacuuagaaaaagccucaucaggacuaaacgacucccaauuggaaaugguuggaauauuugaacgaauauauaguucucugauucuaaaaucaauaauuggagaccauaauucgcucucugcagcuaugguagauaaauucaaaacccacgcgcaacacagggaccucuugaaggacgucauuaaaaauucagacgccacaaaaggcgaacaacuucaguucgcuuacgaccacuaccuucaaagacacagcgccgacgggaaagcauauggaaaagacgacuucuauaaagaaguaaagaaaaaucuagacgauagugaugcugcacaacaaauccaacaacuaaucgacacagaccaauucaugccaaaacaaagaacaaaagccaacggugcuauuccucaucaaguccaacaaaaagaacuagacuuaauaauagaaaaucaaugucaauauuacccauggcuagcggaagaaaauccgaauagcgaaagacauaauguagccaaauauaaauuagaugaauuagugucuuuccgaguuccauacuacguugggccgcuaauuucgccggcagacgaugaaacagauccccaggccauccaaaauacaaaauucgcauggaugauacgaaaagaugcgcaaggcagaauaacacccuggaauuucgaugacaaaguggauagagaaaaaucagcagauaaauuuauaaaacgaaugacaacaacagauaccuaccuuaucggagaagacguccuaccagaucagucccuaauauaccaaagauacaaaguccuaaacgaacuaaacaacguaagaaucaacggacgacccauagaaguccaaauuaaacaaaacauauauaccgaccuauucaagaaauucaaaucggucucggucaagaaauuaagauccuaucuugaggaaauguccuauuauccaggcucauucaaaauaucaggauuaacgaacccaggcaaauucgacaauggacuuacuucauaucucgauuacaaaaacauccuaggagacucugucgacgcuaaugauaaaagagcggacauagaacaaaugauagaauggucaacaauauucgaagauaauaaaauauuugcacaaaaacucgagucaaugacauggcucaccgcagaacaacguaaagcaauaucaagaaaaagauacacgggcugggggagacucucaaauaaacuucucacacaacuuaaaaaccaagacaacagaucuauuauggaucuauuaugggagacagaagaaaauuucaugaaaauacaauccgcaccugacuuuucuaaaaugauagaagcgcauaaucaacaauuuaucaaaaacgaagcaaacauccaacaaguaaucagcgaucuuuacacaucuccacaaaauaaaaaggcuauaagacaaauacuauuaguuguagaugauauacaaaaagcagucggacaugcuccagagcauaucgcuaucgaauuugcaaaaggggaagacaaaaaucccagaagaacuauaagucgagaaaugaaaauucaagacguuuaccaacaaaucucagaugauaucuuagucucgccggaaguacgagcacaacucaaugagaaaauagaaaauagacacggacgccucagugaccggcuauuuuuauacuuuaugcaaggaggaagagacauguauacuggcaaaccuauuaacauaaacaauauaagucauuaugacauagaccacauccuaccccaggcuuucaucaaggaugacucccucgauaauagaguauuagucucagacaagcucaacagagaaaaaucagauacagugccaagagacuuguuuggccgagaaaugaugucuaccugggagaaaauggcagacagaggccuaaucacgaaaagaaaacuggcgaacuuaaaaacaauaccuggaagcaucgacgcacacaaagcacaaggauucauaaacagacagcuaguagaaacaaggcaaguaaucaaacuugcuguaggaauaaugauugaccaauauccugaaacacaaaucguaagcgucaaagcuaacuuaacccacgaaaugagggagauguuugaccucguuaaaaaccgagacgugaaugacuaccaccacgcuuucgaugcauaucucacugcauucgucggaaacuaccuauuacaaagauauccgaaacuugagcccuacuuuguauaugauaaauucaagaaauuaaaagaucaaaacauaaguaugcgugacuuuaacuuacuguacgacuugaagaaaaaugaggacguauacgaccaacguacaggucacucagcacacaaaauaugggaucaacacgggucuauagacuauauuagacaccuauucgcauauaagaaaauacuuguuucucacgaaguacaccaaaacggaggcgcauuauauaacaugacaguauauggaaaagcagaugacgcaaaaagaaaacugauaccaauuaaagccgauaaaccaacagaacuuuauggcggauauaccucaaggaaacuagccuacauggcaauaguaaaaacaaagaaaggaaagaaagaacaauaccaaguaacaggaguuccaguuagcgcacuaacaacccuacgacaauuuaaagaagacucaccagaacaaaaacaagcauuagaagaaauaguuagaaggaauuuugaugagaaaacagaaguagaaauaauaguacccaaaguacucuuuaaucaauuaauaguagacgaaaaauguagauucaugguagggagugauacauaccgguacaaugcacaacaauuaguacuaucagcggacgaucuggaaaucaucaaugcuucucauaaagacauacaaacgauugauucauccgauuacucacaacaacuggaccaaguauaucaaaauauucucacuauaguagauaaacauuuuccuauguacgacauaaacaaauuuagaacaaaacuacaugacauuuaugaacaauauauagaacuaccuaaugaagacgugugggaaaauaacaaauuaacaacacuaggcaaacauacuaucauuauaagaauccuccaagguuuacaugccaacgccacaguaguagaucuaaaacaacucggaauaaaaacuccauucggcuuuaugcagcaggcccgcgggauuguagugagcccggaugcacaauuaauauaccaauccccaacaggacucuaugagagacgcguucgguuaggagacuuguga

SEQ ID NO: 5412 - RNA, 4101 nt, Artificial Sequence
  Cas9 variant
augggcgauagaaaauacaauuuagggcuagacaucggaacauccaguaucggauuugccgccguggaugaaaacaaucagccaaucagagucaaagguaaaacugcaaucggaguucgacucuucgaagaaggaaaaacagccgcggauagaaggggauucagaacaacucgaagaagauuaucuagaagaagauggagaauaaauuuacuaaacggaauauuugacgcacacuuagcugaaguagaucccacauucuuagcuagacugaaagaaaguaauagaucaaaccuagaucccaagaaaucguuccaaggcagccuucuauucccugaacgaaaagacuaccaauucuacaaagaguaucccacgauuuaccacuuacggaaagcauugauggaagaagauagaaaauucgauauccgagaaaucuauuuagcaguucaucacauaauaaaauacagagggaauuucuuaaacggcacaccaaugaggucauuuaaaguagaaaauauagaauuggacacacucuucgacagguuaaaucaauuauaugaagaaauaauaccggacaaugaguuggcuuucgaccucgaacaaguggcagaugucaaagaaguacuuagcucaacaacaauauauaaaauggacaaaaagaaacaauuaguaaaaaugauguuauuacccaccaguaacaaagcucuacaaagcgaaaauaagaaaauagucacccaguucguaaaugcaauucugaauuauaaauucaaacuagaugugcuacuacaggucgaaacagaugccgacuggucucuuaaauuaaaugacgaaggagcagacgacaaauuagaagaguuuacaggagacuuagacgaaaacagacucgaaauaauagaccucuuacagagacuacacaauugguuuucauugaaugaaauaaccaaagacggaaauucguuaagcgcugccaugguggaaaaauauaaagaucacagacaucaccuagaauuacuuaagaaaguaauagaagaccauccugacgcaaagaaagcaaaagcgcugaaagaaacauauacagcauacguaggaaaaacagacgauaaaacgcaaaaccaagaugacuucuauaaagccguagagaaaaauuuagacgacucgccagacgccaaagagauuaaacgcuuaauacaacuagaucaauuuaugccaaaacaaagaacagggcaaaauggcgccauaccacaucaauuacaccaacaggaacuugaccaaaucauagaaaaacaaucuaaauacuacccauuccuggcagaaccaaacccaaauguaaaaagacgaaaggaugccccauauaaacuagacgaauuaauagcguucaaaaucccauacuacgucggcccauuaguuaccccagaagaacaagcucaaaacggugaaaacguauuugccuggaugaaacggaaaguugcaggacccauaaccccauggaauuucgauaagaaaguagaucgaauggaguccgcaaacagauucauaagaagaaugacgacaaaagauacguaccuauucggugaagacguacuaccagcagaauccaugauauaugaaaaguucguuguacucaaugaauuaaacaaucuaaaaauuaauggcaggcaucuaucacugaaagacaagcaagacaucuacaacgacuuauuuaaacaacagaaaacuguaucuaucaaagcacuccaaaauuacuacguaacaaagaagaaagcagcaaccgcaccaacaguugggggucuagcugacccaaagaaauuucuuuccucacuuucaaccuauauagauuucaaaaacauguucggagaacaggucaaugacccacaauuccaagaagaccuagaacaaauugucgaaugguccacaauauuugaggaccgcggcauauuuaaagcaaaauuacaagcacuaggaugguuauccgaaaaacaaauacaacagcuaguugccaaaagauauaaaggauggggaagguugucaaagaaauuacuaacaggccugaaaaacgcagaaggauacucaauacuagaugaaauguggagaagcaccgaaaacuucaugcaaauacaaagccgaccagaauuugcagcacuuauacaacaagcuaaugaaaaacaauucgaggguaaugacccuaauaauguaugggaaaauaucgaaaacauauugggugacgcauauacgagcccucaaaacaagaaagcaauaagacagguagugaaaguuguacaagacauagaaaaagcaguaggaaacccacccgagaaaauugccauagaguucaccagggaagcagcagcaaacccgcaacgcacucaaucacgauuaagaacauuagaaaaacuauaugaaucugcagaagaaguaguugaugcaagacuuacggcagaauuagcagaguucaaagaaaacaaacacguauuauccgacaaauauuauuuauacuuuacacaauuagguagagauguauacacaggagacaccauaagccucgacagacucaacgacuacgauguagaucacauacuuccacaauccuucauaaaagaugauaguuuagacaaucgaguuuuaaccauaagagcaguaaauaauggcaaaucagacaauguaccugccaaaauguuuggaaagaaaaugggcaguuuuuggagauaucuacuagauaacggcaugaucaguaaaaggaaauacaacaauuuaauaacagacccagacaauaucuccaaauaugcacaaaaaggauuuauaaaucgacaguuaguggaaaccagucaggucauaaaauugacugcgaauaucuuaaauggaaucuacgauaaagauacagaaauaauugaaguaccugcaaaaaugaacucacaaaugagaaaaauguucgaucuagucaaaguaagagaaguaaacgacuaccaucacgccuuugacgcguaccuaacaauauucauuggcaacuaccuuuacaaaugcuaucccaagcugagaccauauuuuguguauggaaaauucaagaaauucagcgauaacgaagacauagaagucggugacggaagauucaauuuccuaaauagaauagaacgacuuaaaaauguaacagauccagaaacaggagaaauauuauggucaaauguugcaccaaacgaaacuauaaaaagaauaaagaaaguauauaacuauaaauuuaugaucgugucucgggaaaucacuacaagacgcgccgaacuauucaaccaaaccgucuauccgaaaaauuaucgaggaaaacuaauuccaaucaaagaagaccguccaacagacuuguacgggggauacaguggaaacacugaugcauacuuagcgauaguagcacucgaagauaaaaagaaaggaaaauauuucaaaguugucggaauaccaaccagagcggccgcuaaacuagagaaauuaaaacaacaggauucucaacaguaucuucaagcaguccacgaagucauagcaccucaauuuacaaaaagcacuaagaaaggaauaaagaaaacugaguuccgcauaguacuagauaaaguucauuauagacaguuaguucaggacggaccagugaaaaugaugcuaggaagcuccacauauaaauauaaugcaaaacaacugguguuaucagaaaaagcccuacagguaauaaaagacgaccguaaauucgaugaaacccaaaaagaugacaaccuuauagccguuuacgaugaaaucuuaaguauuguaaaccaaucuuucgacuuauacgauaucaacggauuucggaagaaacuaaacgacaaucgaaaucaauuuauagaccuuccugcagaaacaaaauacgaaggccguaaaguaguagcacauggaaaacgagaaaugauacuagaaauacuuaaaggacuucaugcaaacgcuaguuuuggcaaucuuaaaccaauuggauucgcaacuccauuuggacaaaugcaauccaaaaaugguauagaauuaucagaaaaugcauucuuaauacaccaaagccccaguggucuauuugaacacaaaauuaaacuuuccgaucuguga

SEQ ID NO: 5413 - RNA, 4101 nt, Artificial Sequence
  Cas9 variant
augacaaaauuaggaaaaccauauggaauagguguagacauuggauccaauucaauaggauuugcagcagucgaugaaaauucccaccuaauaaggcuuaaagggaaaacaguuauaggagcaagauuguucgaagaaggaaaagcagcagccuauaggagagcaucaagaacuacaagacgacgacucuccagaaacagauggagauuauccuuucuuagagacuuuuucgaaucacauauaacaccaacagauccuaacuuuuucaugcgucaaaaauauagugaaauaucaccaaaagauaaagcucgauauaaauacgagaaaagacuauucaaugacagaacagaugcagaauuuuaccaacaauaccccaccauguaucacuuaagaacaagguuacucacugauccaucaaaagcagacguacgagaaauauacuucgcaauacaccacauacuaaaaucuagaggacacuuccuaacuccaggguacgcuaaagacuuuaauacuaacaaaguugcacugaaugaaauauucccagcgcuacaagaugcauacgcccagguauaucccgaucuugacauaacauuugacgaaaacaaagucaaugaauuuaaaacaguguuacuaaacgaaaaagccacccccuccgauacacaaagagcgcuagucaacuugcuauuagccaaagagggugaccgagacauauuaaaacaacaaaaacaaguccuaacagaguucgcgaaagcaguagugggucuuaaaacuaaacuaaacguagcauuaggaacagaaguugacucuagugaagcaacagcuuggaauuucagcuuaggacaguuggaugacaaaugggcagguauugaaucggcuaugacugacgaaggaacagagauucuagaccagauucgagacuuauacagggcccggcuauuaaacggcauagucccagcuggaaaaacacucucacaagccaaaguagaugacuacgcacaacaccacgaagaucucgaacuauuuaaagauuaccuaaaacaacucgaagaugauggaacagccaaagcuauucgacaacuguacgaccgauauauagacggcgaugaugccaaacccuuuguaagagaagacuucgucaaagcacuaacaaaagaaguuaccgcccaccccaacgcaaaaagcccagaacuauuggagcgauuagcccaaccugauuucaugcuaaaacaaagaaacaaggccaacggcgcaauaccgguacaaaugcaacaaagagaacuugaucaaaucaucaaaaaccaagcaguuuauuacgauugguuagcagccccuaacccugucgagaaacauagacaaaguaugacuuaccaacuugacgaauuacuuaauuuucgaauaccauacuacgucggcccccuaguaacagcuaaggaacaaaaggcugcacaagggggaguuuucgccuggauggugagaaaagauccagauggaaacaucacaccauacaacuucgacgaaaaagucgauagagaggccagcgcaaacacauucauacaacgaaugaaaacuaccgauacauaccuaaucggagaggacguacucccaaaacaaucacuauuauaccaauccuaugaaguuuuaaaugaacuuaauaacguucguguaaaugauaauaaacucaguuucgaucaaaaacagcaaguacuaggugaguuauucgaacgacacaacacagugacaauaaaacaauuuguugauaacuuacuagcacacggagauuacgauagaauaccagaaguuaggggccuagcagacgagaaaagauucuugucaagccuaucaacauacaaucaauuaaaaggcauucuacacgaagcgauagaugaugcagauaaacaaacagacaucgaaaauauaauagcauggucaaccauauucgaagauaaagcaaucuucaaaacaaaauugaacgagauaagcuggcuaaacgcgggaaugaucaauucccuagccaacauacguuacagaggauggggacaauucagucacaaauuacuaaaugaauuaacauuauccacuggaagaacaguauuugaagaacuacucaucucaucaagaaacuugaugcaaauuuugacugacgaaguacuaaaacagaaaauugccgaauuaaacgcccacgaauuaaaagcaagcgggauauaugcagcuaucgaugacgcguacaccucucccaguaacaagaaagcacuacggcaaguacuaucgguaauagaugauauaacaaaugcagcaggacaagcuccgaacuggcuuuacaucgaaaccgcagauggagacgguguucccggcaaacgaacuaauucaagacaaagaaaaauacaagaaauuuaugcuaaugcagcacaagaacuaaucaccgguucaguaagaggagaauuugaagacaaaaucgcaucaagagcugauuuuaccgaucgcuuaguacuauauuucaugcagggugguagagacauauacacaggagaaccacucaauauagacaacuuaucaucauaugacauugaccacauucuaccacaaucacucauaaaagauaacucacuagacaacagaguucuuguccacccucuuguuaauagagaaaaagacaccauauucgcauccacaagauucgccaaacaaaugaauggaauguggcggcaguggcacgcggcaggacucauaucaucaaggaaacuccgaaaccuacaaaugcgaccagacgaaauugacaaauaugcuagcggguuugucgcaagacaacugguagagacaagacaaauaaucaaacuaacagaacaaauagucgcagaccaauauccagacacaaaaauuauagccguaaaagcaggacucucaucacaacucagaaaagaauuagacuuccccaaaaaccgcgaagugaaucauuaccaucacgcuuuugacgcuuuucuugcagcuagaauuggaacauauuuacucaaacgauacccaaaucucgaaccauuuuucacauacgguaaauuuaagaaaacagaagugaagaaacuaaaaaguuuaaaaucacuaaaaucauucaacuuuaucagagauaugacgcacgcgaaagauaaaauuguagcaaaggaaacaggugaaauuguaugggauaacgcaucugauauuaacgagcucgauagaauuuauaacuucaaacgaauguuaauuacccacgaaguccgcuuugaaacugcuagccucuuuaaacaaacucuuuaugcagccaaaaauuccaaaaacaggggaggaucuaggcaacuaauaccaaagaagaaaggauaccugguugacauauacggggguuauacacaagaaacuggaagcuacuuaaguguaguacgacuuacaaagaaagcaauguaugcuguagucaaagucagcacaagagacgcagcaaaauuagcaguagccaaaucgaucagcgaacaaaaagaaaacgaaacgcuaaagaaaaucauagauggaaaacuaucaaaaaccucaaagaaaggaaaaacaacacaucaacucuuugaaaucguacuaccaaggguaggacagaaaacacuauuuaaaaauucuaaauacaaucaauuccuagucaauagcgauaccuauaugcauaauuaucaagaacuauggaugccaagagaguaccaaagaauguggaaagauauacuauuauccaaucauggagaugcacaaauugaaggacaacuggaccaaauauuuaaauucaucguuucgcaaguaaacucauacuuuaaucuuuacgacauaaaccaguuuagaaagaaaauagcagacgcuacugacaaauucgcaaaacuacccacacacgacacugauaacgcaagaggcaaaauagcaacaaucggucaacuauuaaucggacugcaagcaaacgcaaugcgaucagaucuacggaaccuggauaucaaaacacccuucgguuuauugcaaaucggcacgggaaucacacuagauuuagauacaucgaucauuuaccaaucaccaacaggacuauucgaacgagaaguaccucuuacagaucuauga

SEQ ID NO: 5414 - RNA, 4101 nt, Artificial Sequence
  Cas9 variant
augacuaaagacuacucauuaggacuagacauaggcacaggaagcguagguuuugcagccuuagauacgaacuaucgauuacuacgagcaaaaggcaacaauguaauuggaguccgacuauucacucccgcagaaacagccgaagaacgacgcggcuuccgaacagcaagacgaagauuaucaagaagaagauggagacuaggagcccuuaacgggauauuugcaccagaguuagcaaaaguugacccuaacuuccuacaucgauuaaaauacgcuugggugcauccagcagaccaacaaaacaaggggaaauacucagccgcuccauuauuuaacgacgcagcuuuggaucgacaauuucacgacgacuauccaaccauauaucacuuacgcuuaaaacuaaugacagacaccucacaacaugaucuacgcgaagucuaucuugcuauacaccauauaauaaaauuuaggggaaacuuuuuacgaggagaaggaccaauaaacgcuucugaggcuuucgacaucaauaccuuuauagaucaaaugacagcuuucuacgaucaggcuuuucccgauuuuaaaauugucgaccaaguagaccaacaaauuauuuuuaaaggauuaaccgacaugacgcuaucuccagcagauagagcuaauaaagcacucaugggauuuaauaaugcagcacaacaaccuaauaagcggauuuuuaaagccauccuaagcggcuuaguaggcaaucaggucgaccuaauggcaaucuuucaauuagauggcauuccaaaagaagaccaaaaagaguucaaguuuaaauucgucgacaaugacauagaagaaaaacuagccgcauuaggagacaauccagcccuuucagaugaacaaaacgaguuccuaacaacauuauacgcggcauuuaguggacuuacgcucaaaggacuucuaggugacgccaccucaauuucugcagcaaugguagcacguuacgcaucacauagaacggauuggacauauaucaaggaccacguucucacaccacaaaacaaccgagaauuaagacuugccuacgcugaucuuaugacagacaacgaagacguaagacuaaaagcaggaaagaaauuugccaaagccauagaagcagcagauauacccgcagcuaagaaaagugaauuuucacuaaaaauagauaacaaugaguuccuuccacgucaaaggacaaaagcuaauggcacaaucccccaucaacuucacuuaaaugaacuacaacaaaucauugaaaaucaagggcaauacuacccuuuucuaaaagcgacauuugaacaggacggucauacauuaaacaaaauagaagguuugguaaaauucagaguaccauacuacguggguccgcuaguuccaaaacacaaaguggcagguaauaaugcaaaucauuggaugguaccaaaagaacccggagcaaucacaccauggaacuacacugaaaaaguagacagagauaagucaggcaacgaguucauucgacgaaugacgggaacagacaccuaucugcuaggggaaccgacacuuccuaaaaauagccuuguuuaucaagaauuuaacguccuacaagaacugaauaacuuaagaauagaaaagaggcgauuagauaucgcagugaaacaagauauauucgaacacguuuuuaagacuaauaaaacagugaccguaaaacgcauagaagaauauuuaacaacagaauuuggcucgccagucacacuaucaggauucgcaaauguaaaugaaagaaagcugaacucaucuuuaucaacuuaucacuacuucguaggaauuuuuggagcugaauuuguagacgauccuaaaaauuuaacccuauuagaacaaauaguugaacuacaaacuguauuugaagaucguaaagccuuacaaagacaguuaaaacuucguccagaacucucggaaaaacaagucaaacaacuggcacgcacccauuauacaggauggggaagacuuucucaaaaacuguuaaccaguaaaauaguacacguagcccucgaaggugaaagagaaccaggacaauauaguauacuugaaacucuauaugguacccagaugaauuucauggaaauugucaacgauaugaaggacagauauggaguuaaaagcuggcuagaccaggaaaacucggguucagaaaacaaccuaucuuuaaaacaaaggauuuuagauaugccaggacccaaaaauaucaagagaggaauuaaccaagccuuucacauaauagacgaaauaacgagagcuguaggaaaugcuccaucucguauauacauugaauuugcaagagaaagucaacagucaaaucugacaaacgcaagggucaacagacuuaaacaacuguacucaaaucaagcauuaaagaaagaguucgcgaaacuagcaagcgaaaucaaagauuuaacaaaagaacaacuaaaagacgaccguuuauaccuauacuauuuacaacaaggaaaagacauguacacagaaacugacauagacauaacaaaaauaucaucaaacuaccagaucgaccauauaaucccacaggcuuacaccaaaaauaauucacuagacaacagaguauuagucaacagugaaaugaacgcacgaaaauccgauucgccuacauuuuugcccucauuaauucaagaacgaaaagcaugguggaggcaacuaagagacacagguuuaaugucgacaauaaaauauaacaacuuaacucgaaccucugacgacuucagugcagaucaaaaagaaagauucauagcaagaucgcuuguagaaacuaggcagguuaucaaaaacguagccacauuaauaaaagaauacuaugacgacagccaaguagaagcauuacccagcgaaauaacugcagaaaugagaagauacuuaaauguacguaaaaaccgagauauuaacgacuaucaccaugcacaugaugcuuugcuuuucgcaacggcuggcgaauuuuccagaaaaguaggcauaauggaaaaaggacgagucucagauggugcugggaacauauauaaucgauacaccaaagauauaauccaaagagcaagagcaaaagcaggacaagacaagaaaguaagacccuuuacauuuauaguaggaucuauggcaaauccagacacuaaauuucaaacuaaucaaacuaccggagaaauaguauggacaccagaagacguagcuuaccuaaggaaaguaauugacuacaagaaaauguuagugacaaaaaugacuuuagaucaaacaggcacauuguacaaugaaacuagauacggcucaggagauaaacauguugccguggcgcuaucgaaagauaaagcugcugaucucuauggaggguuuggaucucuaaaaccggcauaugcugcgcuuguauacaguaaaaagaaauucaggcuaguaaacguguuaagacuuugguuacccgaaauaaagaaaaaugccucaguacucgaacggaaaguacaaucuguauuaggagacgauaaugcaaaagugauacgagcccacgucccaugcggucaauuauuaauaaaagauggagcauuaguaacaguuagcucugccaccgaauuacauaauuuuagacaacuauggcuuccuaaagcagacuaccaagauauuuccauccuucuuggagcuccugacaaagugacagcagaaaaucgucuacaagcggaaucacauuucgacgauguagaucaaagauuugaaaguuuacuuaaagauguaauugaucaagccaggcaauauuacccacuaaaaacacaucaaacaucccuggaaaaacuaauagggaaaauaggaaaauucgacgaauugaaauuugcacagaaacaacaaguauuuaguagacuucuaagugcauugcaugcuaacgcuacaaauucggaucuaaaacaaauaggccuaucaacagcaugggguagacuaauuuauccaaaagggguuucacuaacagacgaagacaaauuaauaaauucaaguuuuacuggacuuuucaacgauguaaugucgauuaaagaauuucaugauuuuucaauaaacuga

SEQ ID NO: 5415 - RNA, 4104 nt, Artificial Sequence
  Cas9 variant
augaaaaaacaaaaauuuucagauuauuaccuagguuucgauaucggcaccaacagcguugguugguguaucacagaccuagauuauaacgugcuaagguucaacaaaaaagacauguggggauccagacucuucgaagaagccaagacagcggcugaaaggcgcguacaaaggaacagccgccgacgacugaaacgaaggaaauggcgauuaaaccuauuagaagaaaucuuuucuaacgagauauuaaaaauagacagcaacuuuuuccgaagacuaaaagaaagcucauuauggcuagaggauaaaagcuccaaagaaaaauucacauuauucaacgacgacaacuacaaggacuaugacuucuacaaacaauauccaacaauauuucaccugcgaaacgaacuaauaaaaaacccagagaagaaagacauccguuuaguauaccuagcgauacauagcauuuucaaaagcagaggccauuuccuuuucgaaggucaaaacuuaaaagaaauaaaaaauuucgaaacauuauacaacaauuuaauugccuuucuggaagauaacggaauaaauaagaucauagacaaaaacaauaucgaaaaguuagaaaaaauuguaugugauagcaaaaaaggauuaaaagacaaagaaaaagaauuuaaagagauauucaacucugacaaacaauuaguagcuauauuuaaacuaucaguggguucaagugucagucuaaacgacuuauucgacacagacgaauauaagaaaggagagguggaaaaagaaaaaauaaguuuccgagaacaaaucuacgaagacgacaaaccaauauacuauucaauauugggggaaaagauagaacuucuagauauagcaaaaucuuuuuacgauuucaugguucuaaacaacaucuuggcagacagccaguauauaagugaggcaaaaguaaaacuauacgaagaacacaagaaagacuugaaaaaucucaaguacaucauucgcaaauauaauaaaggaaauuaugacaaacucuuuaaagauaaaaaugaaaauaacuacagcgcauauauaggauugaacaaagaaaaaggaaaaaaagagguuguagaaaaaaguagauuaaagauagaugacuuaauaaaagucaucaaaggauaccuacccaaaccagagaggauagaagaaaaagacaaaacagucuucaaugagauauuaucaaaaauagaacuaaaaacaauauugcccaaacaaaggauaucagauaacgggacuuuaccauaucagauccacgagguugaacuagagaaaauacuagaaaaccaaucaaaauauuaugauuuccugaacuacgaagaaaauggcguaagcaccaaagacaaacuacuaaaaacauuuaaauuccgaauaccauacuacguaggcccacuuaacagcuaccauaaagacaaaggaggaaacaguuggaucgugaggaaagaagagggaaaaauacuaccauggaauuuugagcaaaagguugacaucgaaaaaucagcagaagaauucauaaaaagaaugacaaacaaaugcacauaucuuaauggagaagauguaauuccaaaagauacauuccuauauagcgaauauguaauccuaaacgaacucaauaaaguacaaguaaaugacgaauuucuaaaugaagagaauaagcgcaaaauaauagacgaacuauuuaaagaaaauaaaaaaguauccgaaaaaaaauuuaaagaauaucuccuugucaaacaaauaguagauggaacaaucgaauugaaggguguuaaagacagcuucaacucaaacuauauaagcuacauucguuucaaagacauauuuggugaaaaauugaaccuagacauuuauaaagaaauaagugaaaagucaaucuuguggaagugccucuacggagacgacaaaaaaaucuucgaaaaaaaaaucaaaaacgaauauggagacauccugacaaaagacgagaucaaaaagauaaacacauucaaauucaauaauuggggccgacucagcgaaaaacuauuaacgggaaucgaauucauuaaccuagaaacaggcgaaugcuauucaucaguuauggacgcucuacggcgcacaaauuacaaccuaauggagcuauugagcuccaaauucacguuacaagaaaguauaaauaacgagaauaaggaaaugaaugaagcaagcuaucgagaucuaauugaggaaucauacguaaguccuagucuaaagcgagcaaucuuucagacucuaaaaaucuaugaagaaauacggaaaauaacaggcagaguaccaaaaaaagucuucauugaaauggcaagaggcggagacgaaagcaugaaaaauaaaaaaauacccgccaggcaagagcaacucaaaaaauuguaugacuccugcggaaacgacaucgcaaacuucaguauagacauaaaagagaugaaaaacucacuaauaucuuacgauaauaauucauuaaggcaaaaaaaacuauaccuauacuauuuacaauuuggaaaaugcauguacacaggccgagaaauagaccucgacaggcuacuacaaaauaaugacacguaugauaucgaccauauuuacccgcgguccaaaguaaucaaggacgacucauucgacaaucuuguacucgugcuaaaaaacgaaaaugcagagaaaaguaacgaauauccaguaaaaaaagaaauccaagaaaaaaugaaaucauuuuggagauuucuaaaagaaaagaacuuuauaucagacgaaaaauacaaaagauugacagguaaagacgauuuugaacuacguggauuuauggcaagacaauuagucaacguccgacaaaccacaaaagaggucgguaaaauacuccaacaaauagaaccagaaauaaaaauaguauauaguaaagcggagauagcgucaagcuucagggaaauguuugacuuuaucaagguacgagaauuaaaugacacacaccacgccaaagacgcuuacuuaaauauugucgcaggcaauguauauaauacaaaauucacggaaaaaccauaucgcuacuuacaagaaauaaaagaaaacuacgacguaaaaaagauauauaacuacgauauuaaaaaugccugggauaaagaaaacucacuagaaauaguaaaaaaaaacauggaaaaaaauaccguaaacauuacacgauucauaaaagaagaaaaaggacaacuauuugaccuuaacccaaucaaaaaaggagaaacaucaaacgaaauaauaagcauaaaaccuaaggucuauaacggcaaagacgauaaauuaaaugaaaaauauggauacuauaaaagcuuaaacccugcauauuucuuauacguagaacacaaagaaaagaacaaacgaauaaagagcuucgaaagaguuaaucuaguagacguuaacaauauaaaagaugaaaaaagccuagucaaauaucuaaucgaaaacaaaaaauuaguagaaccacgcguaaucaaaaaaguauauaaaagacaaguaauucuaauaaaccacuacccauacaguauaguaacauuagauagcaauaaacuaauggacuucgagaauuuaaaaccauuauuccuagaaaacaaauaugaaaagauacuuaaaaauguaauaaaauuucucgaagacaaucaagguaaauccgaagaaaacuacaaauucauauaucuaaaaaaaaaagacagauacgaaaaaaaugaaacgcuagaauccgucaaagaucgauacaaucuagaauuuaacgaaauguacgauaaguuccuagaaaaacucgacagcaaagauuauaaaaauuacaugaacaauaagaaauaucaggaauuacuagauguaaaagaaaaauucauaaaguugaaccucuucgauaaggcauucacacuaaaaucauuccuagaccuauuuaacagaaaaaccauggcagacuucucuaaaguaggacuaacaaaauacuuaggcaaaauucaaaaaauauccucgaacguccuaucaaaaaaugaauuauacuugcuugaagaauccgugaccggccucuuuguaaagaaaauaaaacuuuga

SEQ ID NO: 5416 - RNA, 4104 nt, Artificial Sequence
  Cas9 variant
augaaaaaacagaaauucagcgacuauuaccuagguuucgauauaggcaccaauucaguaggauggugcguuacagaccuagacuauaauguacuacgauucaacaaaaaggauauguggggaucccgauuguuugacgaggccaaaaccgccgcugaaagaagaguccaaagaaauagucguagaaggcucaaacgacgaaaauggagacuaaaucuucuagaagaaauauucagcgaugaaaucaugaagaucgacagcaacuuuuuccgaagacuaaaagaaucaucccuauggcucgaagauaaaaacaguaaagaaaaauucacacuauucaaugaugacaauuauaaagauuacgacuucuauaaacaguaccccacuauuuuccacuuaagagaugaacuaaucaaaaacccggaaaaaaaagacaucagacuaauuuaucuagcacuacacucaauauuuaagagcagaggccacuucuuauucgaaggccaaaaccugaaagagauaaaaaauuuugagacacuauauaacaacuuaaucaguuuuuuagaggauaacggaaucaauaaaucaauagacaaggauaauauaaaaaaacucgaaaaaauuauaugcgacucgggcaaaggccuuaaagacaaagaaaaagaauuuaaagaaauauucaacuccgauaagcaacuaguagccauauuuaaacuuucaguaggcaguagcguuucccuaaacgacuuguuugacacagacgaauacaaaaaagaagagguagaaaaagaaaagauuaguuuuagagaacaaauauaugaagacgacaaaccaauauacuacagcauacuaggagaaaaaauagaacucuuagacauugcgaaauccuuuuacgauuucaugguccuuaacaauauauugagcgauagcaauuacaucucggaagcaaaaguaaagcucuacgaagagcacaaaaaagaccuaaagaauuuaaaauauauaauacgaaaauauaacaaagaaaacuacgacaaauuauuuaaagacaaaaaugaaaauaauuacccagcauauaucggccucaauaaggaaaaagggaaaaaagaaguuguagaaaaaucaggacuaaaaauagaugauuuaauaaaaguuauaaagggcuaccuuccgaaacccgaaaggauagaagagaaagacaaaaccaucuuuaaugagauacuuaacaaaauagaacuuaaaaccauacuaccaaaacaacgaauaagcgauaauggcacacugcccuaucaaauccacgaaguagaacuagagaaaauacuagaaaaucaaagcaaauauuaugacuuccucaauuaugaagaaaauggagucagcaccaaagacaaauuacuuaaaacauucaaauuccgaauaccauacuacgucggaccgcuaaauagcuaccacaaggauaaaggagggaauucauggaucguaagaaaggaagaaggaaaaauucucccauggaauuuugaacaaaaaguagacauugagaaaagcgcugaagaauuuauaaaaaggaugacaaauaaaugcacauaucuaaacggagaagacgugauaccaaaagacagcuuccuguacagcgaauacauaauccuaaaugaacuaaacaaaguacaggucaaugaugaauuucuaaacgaagagaacaaaagaaagauaaucgacgaauuauuuaaagaaaacaaaaaaguaucagagaaaaaauucaaagaauaucuacuagucaaccaaauagcaaaucgaacaguagagcuuaaaggcauaaaagacagcuuuaacucaaauuauguaucauacauuaaguuuaaagacauauuuggugaaaaauuaaaucuugacauauacaaggaaauaagcgaaaaaucaauacuuuggaaaugccuauacggugaugauaaaaagauuuuugaaaaaaaaauaaaaaacgaauacggugacauauuaaauaaagaugaaauaaaaaaaauaaacucguuuaaguucaauacuuggggccgauuaucagagaagcuauuaacagggauagaguuuauaaaccuagaaacaggagaauguuauuccucggucauggaagcucugagaagaaccaacuacaauuugauggaauuacuaagcucaaaauuuacauugcaagaaucaaucgauaauggaaauaaagagaugaaugaagugagcuacagggaccuaauugaagaaucauacguuucaccaagccucaaacgagcuauacuacaaacacucaaaauuuacgaagaaauaaaaaaaaucacuggcagagugcccaaaaaaguauuuauugaaauggcacguggaggagacgaaacuaugaaaaauaagaaaauaccagcaagacaagaacaacuuaagaaacuauaugauucaugcggaaacgacauugcgaacuuuagcauagacauaaaaaaaaugaaaaguucacuauccucuuaugacaauaacagccuaagacagaaaaaacuauaccuauauuaucuacaauucggcaaaugcauguacacuggaagagaaaucgaccucgacagacuucugcagaacaacgacaccuacgauauagaucauauuuacccacgaucgaaagucauaaaagaugacagcuuugacaaccuaguguuaguacuaaaaaacgaaaacgcagaaaaaucgaacgaauaccccguaaaaaaagaaauacaagaaaaaaugaaaucauucuggagauuccuaaaagaaaagaacuucauauccgaugaaaaauauaaaagacuuacaggcaaagacgauuucgaacuaagaggauuuauggcaagacaauuagugaacguaagacaaacaaccaaagaaguaggcaaaauauuacaacagaucgagcccgaaauaaaaauaguguauucaaaagcagaaaucgcuagcagcuucagagaaauguucgauuuuauaaaaguacgcgaacuaaacgauacccaccacgcaaaagacgcauaucuaaacauagucgcugggaacguuuacaauaccaaauucaccgaaaaaccauauagauauuuacaagaaauaaaagaaaauuacgacgugaaaaaaauauauaacuaugauauaaaaaaugccugggacaaagaaaauucacuagaaaucgugaaaaaaaacaugaaaaaaaacacagucaauauaacacgauuuauaaaagaggaaaaaggacaguuauucgaccuaaacccaaucaaaaaaggagaaacaaguaaugaaaucauaaguauaaaaccaaaacuguauaacggcaaagaagaaaaacucaacgaaaaguauggauacuauaaguccuuaaauccggccuauuuccucuacguugaacauaaagaaaaaaacaaacguaucaaaucauucgaaaggguaaauuuaguggacguuaauaacauaaaagacgaaaaaucauuaguaaaauaccuaauagaaaacaagaaacuaguugaaccacgucucauaaaaaaaguauauaaacgacaaguaauacuaaucaaugauuacccauauaguauugucgcacucgauucaaauaagcucauggacuucgaaaaccuaaaaccucuauuccuagaaaacaaauacgagaagauauuaaaaaacguaaucaaauuucuagaagacaaccaagguaaaagugaagaaaauuauaaauuuaucuacuugaaaaaaaaagaccgguaugaaaaaaaugaaaccuuggaaucaguaaaagauagauauaaucuagaauuuaacgaaauguacgacaaauuccucgaaaaacuagauaguaaagauuauaaaaacuauauuaacaauaaaaaguauaaaaaccuacuagauguaaaggaaaaauuuaucaaacugaaucuauucgauaaagcguuuacuuuaaaaucauuccuggaucuauucaaucgaaaaacgauggcugacuucagcaaaguaggacuaaccaaguacuuaggaaaaauacaaaaaaucuccaguaacguauuaucaaagaaugagcucuaucuccuagaagaaagcguaacaggccucuucguaaaaaagauaaaacuuuga

SEQ ID NO: 5417 - RNA, 4104 nt, Artificial Sequence
  Cas9 variant
augaaaaaacaacaauucagcgacuacuaccuaggauucgacauaggaacaaacucaguaggguggugcguuacggacuucaacuacaacguuuugagauucaacaagaaggauaugugggggucccgauuauucgaugaagcgaaaacagcagcagaaagacgaguucaaagaaauagcagacgcagguuaaaaaggcgaaaauggcguuugaacuuacuagaagaaauuuucucagacgaaauacucaaaauagauuccaauuucuucagaaggcuaaaagaaucaucccuaugguuagaagauaaaaguagcaaagaaaaauuuacacucuucaaugacgacaauuacaaagacuaugauuucuauaaacaauacccgaccaucuuccaccucagaaaugaauuaauuaaaaacccagaaaaaaaagauauacgacuuguuuaccuggccuugcacucaauauucaaaucaagaggacauuucuuauucgagggacaaaaucuaaaggauaucaagaauuucgaaacacuauacaacaaucuaauggcauuccuagaagacaaugacaucuacaaaaacaucgacucaucuuauaucggcaaccuagagaacauaauaugcgauucaaaaaagggacuaaaagacaaagaaaaagaauucaaagaaaucuucaacagcgacaaacaacuaguaggcuucuucaaauuaucaguuggaucaucaguaucacucaaugaucucuuugacacagacgaauauaaaaaaggagaaguugaaaaagagaaaauaucuuucagagaacaaauuuaugaggacgacaaacccauauauuauaguauacuuggggaaaaaauugaauuccucgacauagcaaaaaguuuuuaugauuuuaugguucucaauaauauuuuagcagauagccaauauaucucagaagcuaaaguaaaacuguaugacgaacacaaacgcgaucuaaaaaaccuaaaguacauaauccgcaaauacaacaaagaaaacuacgauaaacuauucaaagacaaaaacgagucaaauuacucagcauauauaggucuaaauaaagaaaagggaaaaaaagaagugauagagaaauccagacuaaaaauugacgauuucgcaaaaauuauaaaaggauacuuaccgaaagccgagaaaaucgaugaaaaagacagaaguauauucaacgaaauauuagauaaaaucgagcuuaaaaccauacuacccaaacaacgaauaagcgauaacggcacccuaccauaucaaauacaugaggcagaacuggaaaagauauuggagaaccaagccaaauacuacgacuucuuaaaccaugaagaaaauggaauauccacaaaagacaaauuacuuaugacauucaaauucagaauacccuauuacguggguccacuaaacucauaccacaaaaacaaaggaggaaacagcuggauaguucgaaaagaagaaggcaaaauucuaccauggaacuucgaacaaaaaguagacauagaaaaauccgcagaggaauucauaaaaagaaugacaaacaaaugcaccuaucucaauggggaagauguuaucccgaaagacucauucuuauacucagaauacauaauauuaaaugaauuaaauaaagugcaaguuaacgaugaauucuuaaauaaggaaauuaaaaaaaaaauaauagaagauuuauucaagaaaucaaaaaaaaucagcgaaaaaaacuucagagaauaucuacuaguaaaucagauaacaaacaaaacaguggagcugaaagguguaaaagacgccuuuaacucaaauuauguaucguauaucaaauucaaagauaucuucggagacaaacuaaaccuggauaucuacaaagaaaucagcgaaaaaaguauacuauggaagugcuuauauggagaugacaaaaaaauuuuugaaaagaaaauuaaaucaguauacggcgacauccuaacaaaagacgagauaaaaaaaauaaacucguuuaaauucaacacguggggccgauuaagcgaaaaguuguuaacagaaaucgaauucauagauuuggaaacaggagaauguuacucaaguguaauggacgcacuaagacguacaaacuauaauuuaauggagcuucuuagcucaaaauucacacuccaagagaacauagacaacgaaaacaaagaaguaucagaauuuagcuauagagaccucgucgaagaaagcuauguuuccccaucuuuaaaaagggcaauacugcaaacuuuaaaaauauacgaagaaaucaggaaaauaacagguaggauaccaaaaaaaguauucaucgaaauggcaagaggcggagacgaaacuaugaaaaauaaaaaaauacccgcaagacaagaacaauugaaaaaauuauaugacucaugcggaaaagacauauccaacuucucuaucgacaucaaagaaaugaaaaacagcuuaaacagcuaugauaauaauucacuaagacaaaaaaaacucuaucuauacuaccuacaauucggcaaauguauguauacaggaaaagaaauugacuuaaauagacuauuacaaaacaacgacaccuaugacauagaucauauauacccacgaucgaaaguaauuaaagacgauuccuucgacaaucuaguacucguacuaaagaacgaaaaugccgaaaaaucaaaugaauauccacuaaaaaaagaaauacaagaaaaaaugaaaaguuucuggaaguuucuaaaagaaaaaaacuuuaucucagacgaaaaguauaaacgacuaacagggaaagaugaauuugaacuaagaggguucauggcucgucaacuuguaaacguacgucaaacuacaaaagaagcuggaaaaauccuacaacagauagagcccgaaaucaaaauuguauauuccaaagcagaaauagcaagcucauuucgagaaauguuugacuucaucaaaguccgagaacuuaaugauacccaucacgcgaaggaugcauaccugaacaucguagcuggaaacguuuacaauacaaaauucacugagaaacccuaccgauaucuacaagagauaaaggaaaacuacgauguaaaaaaaauauacaauuacgacaucaagaacgccugggauaaggaaaaaucccuugaaaucgugaaaaaaaacauggaaaaaaacaccguaaacauaacuagauucauaaaggaagaaaaaggccaacuauucgaccuuaaccccauaagaaaaggagagacaagcaaugaaauaauagcaauaaaaccgaaauucuacgaaggcucaaccgagaaauuaaaugaaaaauauggauauuacaaauccuuaaauccugcauacuuuauauauguagagcauaaagaaaaaaacaaaauaauaagaaguuuugaaagaguaaacuuaguagacguaaauaagauaaaagacgaaaaaucacuaauuaaauaucuuauugaaaacaaaggguuaauagaacccaaaguaauaaaaaaaguauauaaacgccaaguaauucucauaaacaacuuccccuacagcauaguggcccuagauuccaauaaacuaauggauuucgagaacuuaaagccccuguuccuugaaagaaaauacgaaaaaauacuaaagaaugcaauaaaauuccuugaagacaaccaaggaaaaacagaagaguacuacaaauuucucuaccugaaaaaaaaagacagaaacgaaaaaaacgaaacaauagacucagucaaggaacgauauaauauugaauucaaugaaauguacgauaaguuccuagagaaacuagacucaaaagacuauaaaaauuacauaaacaauaaaaaauacucagaacugguuaacguaaaagaaaaauucaucaaacugaauuuauucgacaaagcauucacccuaaaaucuuuucuagaccuuuuuaaucguaaaacaauggcagauuuuagcaaaguuggucuuacgaaauacuuaggaaaaauacaaaaaauaucaucaaacguacuuucaaaaaacgaacuacaccuccuagaagaaagcgucacaggccuauucgucaaaaaaauaaaauuauga

SEQ ID NO: 5418 - RNA, 4104 nt, Artificial Sequence
  Cas9 variant
augaaagacuauuacuuaggguuagacauggguuccucaucaguuggaugggcgcucuccgacgaaagauauaacuuacuaagagcaaaaggaaaagaccuauggggaguacgauuguucgaugaagcaaaaacagcugcagaaagaagaacauuuaggucucaacguagacgacuugaaagguccaaauggagauuaucacuacuuacaucuuuauucgaagaagaaauaucuaaaauagacgauaaauucuuugauagacuaaaagauaguaaauucuucauugaugauaaaucagaucaacaaccaaauacacuauucaacgauguaaacuucacagauaaagaauaccacaaaagguacccaaguauauaccaucuaagaaacgcauuauuuaaucaaaacgacaaauucgacauccgccuuauauuucuagcauuaucacauauagucaagaaaagaggacacuuucuuuucgauggagauaaagcaggguuuggggaagacauagacguaaucuuagaugaauuaaaagcauacuuacaagacgcauuucacacaaaacuagaauuuacuagcgaauuuaaaucaaucaugcuagauaaaaaccuaaggaagaaacaaaaagaagaagaacucaaaaacucaauaaaaauaucaagugacacaauaaauucaaaagacgggaaaaguauacucauaaaauuauuucuaggauacgaagcuaaucuaaaacccuucuuucucgaauacaaagucgaaaaagacaacgaauacaaaauaaauuuuucgaaagaagacuaugaagaaaaacuauuagacaugacuucaaaauucgaagaaacaacauauuuuauugaaaucgcaaagaaaauacacgauuacuuccuuuuagaagaaauaaugcucggauucaaaaacauaagcgcaucaaaaguuucgauuuaccaaaaacacaaaaaugaccuaaaaacccugaaaaacauugucaaaaaucaaauaaauaauucuuacaacgccauauucaaagauauaggacuggauaacuacccagcuuacguaagcuguuggaacagcaagaaacacaaagaaaaacaaaaaggauguacaaaagacaaauuuuacgcuuucuuaaaaacuaaacuuaaaaauauuaauaacgcaaaagaaauccucgacuccaucgacaaugaugacuuucuacccagguuaguggacaaaaacucaauuaucccacaucaaauacaucucgcagaauuaaucaaaauaauagacaaucaaagccaauauuaccccuuccuuaaagaaauaaaagacaaaauaauaucaaucuucaaauuucgcauaccauuuuacgucggaccacuaaauaauuuccauaaagauaaaggaggaaaugcuuggaucgaaaaacuaaaagaugaacgaaucuuuccauggaacuucaacgacgucguggacuuaaacaaaucagcugccaacuuuauagagaaaaugauaaaugaaugcucauaccuaaaaggugaaaaagugcuugccaaaaacucuuuacuauacacaaaauauucgguauuaaacuugauuaauaaacuaaaaaucaaugguacagcaguuucaguagaaacaaaacagaaaauauacaacgaauugcuacugaaacagaaaaauaucaagaaaaccgcuaucaagaaauuccuuaucaacaacucaauaauagauaaaaacgacgaaauaagcggcauagaugauucacuaacaagcaaucuagcagucuucauagauuuugagaaaauaaguaaccgguuaagauacgaccaaaaagaagacauuauaaaaagcaucuccuuauucggauacgacaacgcaaugcucaagaaacaaaucauuaccauagcucccgaucuguccgaagacgaauuagaaaaacugucuaaacuaagauauuccggauuuggacgauuauccaaaagauuauuaacaagcauaaaacacaauggaaaaaguauuauugaaaugcuaugggacacaaacgauaaccuaauggaacuccuuucagauagauauacuuucaucgaacaaauaaacaaacacaacgacggauuuaaagaagauauuaaccuuaacuuccaaaauguagacacucucuacgucucaccgaguguuaaacgacaaauuuggcaagcauuuaaaguaauaaacgaauuaauuagcguuauggguagagagccaaagaaaaucuuugucgaaauggcccgcgaagaaggcgaaaagaaaagaacgcaagccagaaaagauaaaguauuagaacuauauaaaaguaucaaaaacaacgaaauaucaacauuccuuacaaacuuuaaagacauuaaaacgaaacucgagggagaauccaacuuaaauagcaagaaacucuaccucuacuauuugcaacuuggaguagauauauauacaggagagaaaauacccuucgaaaaacuuuuugaccaaaacauauacgacauugaccacguaauacccagaucccuaaagaaagaugacucauucgauaaucuaguacuaacaucuaaaacaaauaaugcaaagaaaacggaugaauuucccguuucgucagaaauucaaaguaaaaugcaaaccuuuuggaaaguacuuaaagacaaagacuuaaugucagaaauaaaauacacaaaucucaccagaaaaacacauuuaucagaugacgaauuaggcgacuuuauagccagacaacucgucgaaacucgccaaaguacuaaagcacucacacaaauacucaaaaacguauacgcaaacucagauaucguauacguuaaagcagggauagucuccgaauuucgacaacaauuugauaugcuaaaaauaagagaacuaaacgacuuccaccaugcuaacgacgcauacuuaaauauaguuauaggaaauguauauaacauaaaauuuacuaaaaacccgcgcaacuacguaaaagaauacuauaagaaaggcgaacacuauaaucuuaaaauagagaaaaugcuagaaaaagauauagcacgaggagguaacuuuggaugggacaagaaacacaguauagaaaccguacagaaaacaaugaagaaacaauccccacuuauaacuuacagaaccuucgaaaacaaaggugaauuuuucaaccaacaacccucuaaagcaucagccaaucuucuagcccugaaaucaagcgacaaaagauuacuagacacagugcgauacgggggauauaaaggaacgcaauaugcacacauguucuuaguugaacauuucaauggaaaaaucauaaaagaaauaaugggcguaccaauuuacuuaaguaaagaaauaaaagacgacaaagcaaaacucuuagaauauuguaaugacguacuaaaacucaaaaaccccaaaauacuauucucuaaaauacccuacaacucacuaauaguauacaacggauauccaauucuacuaaggggacuaaccggaguaagaggagcggcacaauuaaaguuagaucaaacaucaacacaaguagugaagaauauaguaaaauuauacgacuggcuuucacaaaaacaaaaagaacucucggaccuauccaagaaaauagaauuuuuccaagaaaacaauaagaaagaugaaguaaaagcugccaugcuagaagcagacaauauauuguucauacucaacgaucguuucaaaaauaccaaaauaggaaaggacauaaugaaugacaaccaccuaaauaacuuauacgauacauucauaaacaaauuggaaaacuccauauauaaaaacaagccaggggguaaacaagauguauuaaugaaggagaaaagagaucuauuccuuucauuuagcauguccaagaaauguauaacauuauacaaaauaaucaaaauauucggaucaugcgaccaagguguagacuuuagcgauaucgcagaaaagauaagcaagucaggaggaauagguggcaaaaacuuaggcaaaaauacuuuugaccuaguauuuaaagaaaauagcaccuauacgcuaguacaaaguucagugacaggacuauacgcuaagaaaacagaucuacauaaacuauga

SEQ ID NO: 5419 - RNA, 4104 nt, Artificial Sequence
  Cas9 variant
augaaaaaacagaaauuuucagacuacuaucuaggauuugacauaggaacaaacuccgucggauggugcguaaccgaucuugacuacaacguccuaagauucaauaaaaaagacauguggggauccagauuauucgaggaagcgaaaacagcugcggaacggagaguccaacgcaauagucgaagacgauuaaaaagaagaaaauggagacuaaauuuacuagaagagauuuucucaaacgaaauacucaaaauagauuccaacuucuucaggagacuaaaggaaucaucguuauggcuugaagauaaaucaagcaaagaaaaauuuacacuauuuaaugaugacaauuauaaagauuaugacuucuauaaacaauacccaacaaucuuccaccuuagaaacgaacuaauaaaaaaccccgaaaagaaagacauaagacuaguguacuuagcaauacauucaaucuuuaaaagccgaggacacuuuuuguucgaaggucaaaaucuaaaagagauaaaaaauuucgaaacuuuauauaauaaccuaaucgcauuccucgaagacaacggcaucaacaaaauaauagacaaaaacaacaucgaaaaacuugaaaaaaucguaugcgacucaaaaaagggauuaaaagauaaagaaaaagaauucaaagagauauucaacagugacaaacaauuaguagcaaucuucaaacuuaguguugguagcagcgucucccuaaacgaccuauuugacacggaugaauacaaaaaaggagaaguagaaaaagaaaagaucagcuucagagaacaaauauaugaagaugauaaaccgauauacuauucaaucuugggggaaaaaauugaauuacucgauauagcaaaaaccuuuuacgacuucaugguuuuaaacaacauacucgcugauucacaauauauaucagaagcaaaagucaaacuauacgaagaacauaaaaaagacuuaaaaaaccuaaaauacauaaucagaaaauacaacaaagguaauuacgacaagcuauuuaaagauaaaaacgaaaauaacuacagugcauacauaggacuaaacaaagaaaaaucaaaaaaggagguaauagaaaaaagcagacucaaaauagaugaucuaaucaaaaacaucaaaggcuaccuuccgaaagucgaagaaauugaagaaaaagauaaggccaucuuuaauaaaauacuaaacaaaaucgaacuaaaaaccauacucccaaaacagcgaaucucugacaauggcacucuaccauaucaaauucacgaagccgaacucgaaaaaauacuagaaaaucagucgaaauacuaugauuuccuaaauuacgaagaaaauggaauaaucacaaaagacaaacuacucaugacauucaaauucaggauaccauauuacgucggaccgcugaacagcuaucauaaagacaaaggaggaaacucauggauaguaagaaaagaagaaggaaagauacuuccauggaauuuugaacaaaaaguagacauagaaaagucugcugaagaauuuaucaaaaggaugacuaacaaauguacauaucuaaacggagaagacguaauuccaaaagacacauuuuuauacucagaauacguaauacuuaaugaacuaaauaaaguccaaguaaaugacgaauuccuaaaugaagagaacaagcgaaaaaucauagaugaacuauucaaagaaaauaaaaaaguaucagaaaaaaaauuuaaagaauaccuccuagucaaacagauuguggauggcacuaucgaacuuaagggagugaaagauuccuuuaauucgaauuacauuucuuauauaagauucaaagacaucuucggagaaaaacugaaucucgauauauacaaagaaauaucagagaaaucaauccuuuggaaaugucuauacggcgacgacaaaaagauuuuugaaaaaaaaauuaagaacgaguacggcgauauucugaccaaggacgaaauaaaaaagaucaauacguuuaaguuuaacaacuggggaaggcuaucugagaaacucuuaacuggaaucgaauucauaaaucuagaaacuggcgaauguuauucauccguaauggaugcacuaagacgcaccaacuauaaccucauggaacuccuaagcucaaaguuuacuuuacaagaaucgauuaacaacgaaaacaaagaaaugaaugaagcaaguuacagggacuuaauugaagaaucauauguuagcccuucuuuaaagagagcaauauuccaaacguuaaaaauauacgaagagauaagaaaaauuacuggaagagucccuaaaaagguauuuauugaaauggcgagaggcggagaugaaucuaugaaaaauaaaaaaauaccugcccgacaagaacaacucaaaaaacuuuacgacucaugcggaaacgacauagcgaacuucagcauagacauaaaggaaaugaagaauagccuaauaaguuacgacaacaauagcuuacgccaaaaaaagcuauaccuauacuaccuccaauucggcaaauguauguauacaggcagagaaaucgaccuagaccgacuauuacaaaacaacgacacauaugauauagaucauauauauccuagaucgaaagugauaaaagacgauaguuuugacaacuuaguacuugugcuaaaaaaugaaaaugcagaaaagucaaacgaguacccaguaaaaaaggagauacaagagaaaaugaaauccuucuggagauuuuugaaagaaaaaaacuucauaucagacgaaaaauacaaaagacuuaccggaaaagaugacuucgaacuccgaggauuuauggcacggcaacugguuaacguccgccaaacaacgaaggagguaggaaaaauauuacaacaaauagaaccagaaauaaaaauaguauacaguaaagccgaaaucgcgaguagcuuccgggagauguucgacuuuauaaaagugagagaauuaaaugacacccaccacgcgaaagacgcauaccugaacauaguagcuggcaauguauacaacacaaaauuuacggaaaaacccuauagauaccuacaagaaauaaaagaaaauuacgacguaaaaaaaauauacaacuacgauauaaaaaaugcgugggauaaagaaaauagccuggagauagucaaaaaaaacauggaaaaaaacaccguaaacauaaccagauucauaaaagaaaaaaaaggccaacuauucgaucuaaacccaauaaaaaaaggagaaacuucuaacgaaaucauaaguauaaaaccaaaagucuacaacggaaaagaugacaaacuuaaugaaaaauauggauacuauaaaucacucaauccggcauauuucuuauauguugaacacaaagaaaaaaacaaaagaauuaaguccuucgaacguguaaaccuaguagauguaaauaacauaaaagacgaaaaaagcuuaguuaaguaccucaucgaaaacaaaaagcucguagagccucguguaaucaaaaaagucuacaaaagacaaguaauccucauaaacgacuacccauauuccaucguaacacucgauaguaauaaacugauggacuuugaaaaucucaaaccacuauuccuagaaaauaaauacgaaaaaauccugaaaaacguuaucaaauucuuagaagacaaccagggcaaaucagaagaaaacuacaaguucauauaucuaaagaaaaaggacagauaugaaaaaaacgagacucuagaaucagugaaagauagauacaaccuagaauuuaaugagauguaugacaaauuccuagagaaauuagauaguaaagacuauaaaaacuacaugaacaacaaaaaauaucaagaauuacuugauguaaaagaaaaauuuaucaaguugaaucuauucgacaaagccuucacguuaaagucauuuuuagaccuauuuaacagaaaaaccauggcagauuucucgaaaguaggacuaacaaaauaucucgguaaaauacaaaaaauaucaagcaacguuuugucuaaaaacgagcuauaccuacuagaagaaucaguaacaggccuauucguuaaaaagauaaaauuauga

SEQ ID NO: 5420 - RNA, 4104 nt, Artificial Sequence
  Cas9 variant
augaaaaaacaaaaauuuucagacuacuaccuuggauuugacauugguacuaacucuguaggauggugcguaaccgauaugaacuauaauguacuuagauuuaacaaaaaagacaugugggguagucgccuguucgaagaagcuaaaacugccgcagaaagaagaguacaaagaaacaguagaagacgucuuaaacgaagaaaauggagacucaacuuauuagaagagauauuuucuaaugaaauacuaaaaauugacaguaauuucuuuagaagauugaaagaaaguucccucuggcuugaggauaaaagcagcaaagaaaaauuuacuuuauucaacgaugacaauuacaaagauuacgauuucuacaaacaauacccaacaauauuucaccuaagaaacgaacuaaucaaaaaccccgaaaaaaaagauauaagauugguauaucuagcaauccacagcauauuuaagucacgaggccacuuccuauucgaaggucagaaccucaaagaaauaaagaacuuugaaacgcuauacaauaauuuaauagcguuccuagaagauaauggaauaaacaaauccauagauaaagauaaccuagaaaaacuagaaaaaauaguuugugacagcggaaaaggacuuaaagauaaagaaaaagaauucaaagaaauauucaacucagacaaacagcucguggccauauucaaacuaagcguaggauuaaguguauccuuaaacgacuuauuugauacggacgaauacaaaaaaggcgaaguagaaaaagaaaaaauaaguuuccgugaacagauuuacgaagacgacaaacccauauacuacaguauccuaggcgaaaagauagaauuacucgacauagcaaaaagcuucuacgacuucaugguacucaacaauauucuagcugauagccaauauauaucagaagccaaaguaaaauuauacgaagaacauaaaagagaccuaaaaaaucuaaaauacauaauuagaaaauacaacagagagaacuaugauaaacucuuuaaagauaaaaacgaaaguaacuacccagcuuauaucggauuaaauaaagaaaaauccaaaaaagaaguaaucgagaaaagcaaauuaaaaaucgacgacuuaaucaaaagcauuaaaggguaccuaccaaaaguugaagagauagaggaaaaagauaaggcaaucuucaacgaaaucuuaaauaagauagagcugaaaauuauauuaccuaaacaaagaauaucugacaacggcaccuugccguaucaaauacacgaagcagaacuagaaaaaauacuggaaaaucaaagcaaauacuacgauuucuuaaauuaugaagaaaacgguauuauaaccaaagauaaacuccuaaugacauuuaaauuucgaauaccauauuacguuggcccuuuaaacucauaucacaaagacaaaggaggaaacucauggauuguaagaaaagaagaagguaaaauacuaccauggaacuucgagcaaaaaguagacaucgaaaaaucagcugaagaauucauaaaaagaaugacuaauaaauguacauaucucaacggagaagaugucauaccaaaagacagcuuucuguacucugaauauauaauauuaaaugaauuaaacaaaguacaagucaacgaugaauuucucaaugaagaaaacaaaagaaaaauaauagaagagcuauuuaaagguaacaaaaagguaucagagaaaaaauuuaaagaauaccuauuagugaaucaaauaacuacaggaaccauagaauuaaaaggcaucaaagauucauucaauaguaacuauaucagcuacauaaaauucaaagacauauucggagaaaaacuaaaucuugauauauacaaagaaauauccgaaaagaguauuuuguggaaauguuuauauggagaugauaaaaaaauauuugaaaaaaaaauaaaaaacgaauauggagacauuuuaacaaaagacgagauaaaaaaaauuaauacguuuaaguucaacaacuggggaaggcuauccgaaaaacuauuaaccggcauagaauuuaucaaucuugaaacaggugaauguuauucaucaguuauggaagcucuaagacguacaaauuauaauuugauggaacuguuaagcucgaaguuuacacuacaagaaaacauagacaaugaaaacaaagacaucucccaauucagcuacagagaucucguagaagagucuuacgucucaccuagccuaaaacgugcaauacuucaaacacuaaagauauacgaagaaauaaaaaaaaucacgggccguguaccaaaaaaaguguuuauagaaauggcaagaggaggggacgaaagcaugaaaaacaaaaaaaucccagcaagacaggaacaacugaaaaaacuauacgauucaugcgguaacgacauagcuaauuucagcaucgacauaaaagaaaugaaaucaucacuaucuuuauacgauaauaauucauuacgucagaaaaaacucuacuuauacuaucugcaauucgggaaaugcauguacacagggagagaaaucgaccucgacagacuuuuacaaaauaacgacacuuacgauaucgaucacauauacccaagaucgaaaguaauaaaagacgacucguuugacaacuuaguauuaguucuaaaaaacgagaacgccgagaaauccaacgaauacccagucaaaaaagagauccaagaaaaaaugaaaucguucuggagauuccuuaaagagaaaaacuucauaagugaugaaaaauacaagagacuuaccggcaaagacgauuucgaauuacgaggcuuuauggcgcggcaauuagucaacguaagacaaacaacaaaagaaguagggaaaauauuacaacaaauagaaccagaaauuaaaaucguauacucaaaagcggaaauagcaaguucauuucgcgaaauguucgacuucauuaaaguaagagaauuaaacgauacacaucacgcaaaagacgccuauuuaaacauuguagcaggcaaugucuacaauaccaaguucacggaaaaaccauacagauauuuacaagaaauaaaagagaacuacgacgugaaaaaaauauacaguuacgacauaaaaaaugcaugggauaaagaaaauucacucgaaauaguaaaaaaaaauauggagaaaaauacagugaauauaacacgcuuuauaaaggaagaaaagggacagcuguucgaucuaaacccaaucaaaaagggagaaacaucaaaugaaauaauauccauuaaaccgaagguauacaacggaaaagacgauaaacuaaacgaaaaauauggcuauuauaaaaguuugaauccggcauauuuuuuauacguagaacauaaagaaaaaaauaaaagaaucaaaucuuucgagagaguaaaucuaguagacguaaauaacaucaaagaugaaaaaagucuaaucaaauaucuagucgagaauaaaaaauuaguagaaccccgcguaaucaagaaaguauauaaacgucaaguaauuuuaauaaaugacuauccuuacucaaucgucgcacucgauagcaauaaauuaauggauuucgaaaaucuaaaaccacuauuccuagaaaggaaauacgaaaaaauacugaaaaauguuauaaaauuucuagaagauaaucaaggcaaauccgaagaaaauuauaaauuuauuuacuuaaaaaaaaaagacagauaugaaaaaaaugaaacucuagagagcguaagagaaagguauaacauagaauuuaaugagauguacgauaaauuccuugagaaacuaaacucaaaagauuauaaaaacuauaucaacaauaaaaaauaucaagaccuauuggaugucaaagaaaaguuuauaaaacucaaccuauuugacaaagcuuuuacacuaaaauccuuccuagauuuauuuaaccguaaaacaauggcggauuuuucuaaagucggauuaacuaaauaccuaggaaagauccaaaaaauauccaguaacguauuaagcaaaaacgagcuauaccuacuugaagagucggugaccggauuauuuguuaaaaaaauugaauuauga

SEQ ID NO: 5421 - RNA, 4104 nt, Artificial Sequence
  Cas9 variant
auggucaaaaagaaauacgcaauaggcaucgacaucggaacgaacuccgucggauggucaguagugaccgaugauuacaaagucccgucgaagaaaaugaaaguuuuuggaaacacagagaaaagauacaucaagaaaaaucuacuaggaacucuucuauuugacgaaggcaauacagcggaaaaccgccgacucaaacgaaccgcuagaagacgcuacacaagacgacguaaccgcauacuauauuuacaagaaaucuuugcagaagaaauaaacaaaauugaugacagcuucuuucaacgucuagacgauaguuuccuaauaguugaagacaaacaaggcagcaaacacccuauuuucgguacacuacaagaagaaaaagaguaccauaaacaauuucccacuauauaccaccuaagaaaacaauuggcagacucaucacaaaaagcugacauaagacuaauuuaucuagcacuagcucacauuauaaaauaucguggacacuucuuauuugaaggcgaccucaaaagugaaaauaaagauguucaacaucuuuuuaacgacuucguagaaauguucgacaaaacaguagaaggauccuacuuaucagaaaacuuacccaauguagcagaugugcuaguagaaaaagucucaaaaagcagacgccucgaaaacauacuccacuauuuucccaacgagaagaaaaacggucucuucgguaacuuuuuaacucuugcauuaggcuuacaaccaaacuucaaaaccaauuucgaauuagcagaagacgccaaaauacaauuuucuaaagaaacauaugaagaagaccucgaagaacuucuaggaaaaaucggagacgauuacgcagaccuauucauagcaacaaaaucacuauaugauggcaucuuacucgcaggaauauuaucaaccacagacucaaccacaaaagcaccacucuccucauccauggugaauagauaugaagaacaucaaaaagaccuagcgcucuugaaaaacuucauucaccaaaacuuaagcgacagcuauaaagaagucuuuaacgauaaacugaaagaugguuaugccggauacaucgaagguaaaacaacacaagaaaauuucuacagauuuauuaagaaagccauagagaaaauagaaggcagcaauuacuucaucgacaaaauagacagggaagauuucuuaaggaaacaacgcacauuugauaaugggaguauaccacaccagauacaucuacaagaaaugcacgcaauaauacgaagacaagcagaauuuuauccauuccuaguagaaaaucaagacaaaauagagaaaaucuuaacauuuagaauaccauacuacguuggcccucucgcucgaggaaaauccgaguucgcuuggcucaauagaaaauccgaugaaaagauacguccauggaacuucgacgaaauggucgauaaagaaacuucagcugaaaacuucauaaccagaaugacaaauuacgaccaguauuuacccgaccaaaaggucuuaccaaaacacagcuuacuguacgaaaaauucgccguuuauaacgaacuaacaaaagugcgauacguaacagaacaggguaaaaguuucuucuuugacgcaaacaugaaacaagaaauauucgacggcguauucaaaguauacagaaagguaacaaaagaaaaacuuauggauuuccuaggcaaagaauuugaugaauuuagaaucguagaccuccucggcuuagauaaagacaacaaaucauucaacgcaucacucggcacuuaccacgaccuuaagaaaauaguuagcaaggaucuacucgacaauccagaaaaugaagauauauuagaaaacgucguacuuacacugacauuauucgaagacagagaaaugauaagaaagcgacuugaaaaauacaaagacguauuaacagaagaacaacguaagaaauuagaaagacgacauuacacuggauggggaagauugucagcgaaacuuauaaacggcauucgcgauaaaguuaccaggaaaaccaucuuagauuaccuuauagaugacgguacauccaaccgaaauuucaugcaacuaauaaaugaugacacacucucauucguugacgaaauaagacucgcacaagguucaggcgaagcagaagacuaccgugcagaagugcaaaacuuagcuggcucucccgcaauaaagaaaggcauacuucaaucacucaaaaucguagaugaacuaauugaaguaaugggauacgacccagaacauauaguagucgaaauggcacgagaaaaucaguucacaaaucaagguagacggaacagccaacaacgauauaagaaaaucgaaaaugcaaucaaaaauuuagauucuaauuuaaauagcaaaauucucaaagaauacccuacaaauaaccaggcccuacaaaacgacagacuauuccucuacuaccuacaaaacggaaaagacauguacaccgacgaagaacuugacauagaccaacucagucaauacgauaucgaucacaucauaccucaagcauucauaaaagacgacucacucgauaauaagguacucacuaaaagugccaaaaaccgcggaaaaucagacgacgucccgucguuagaaauuguacauaagaagaaaaauuucuggaaacaauuacuagauucgcaauuaauuagucaaagaaaguucgauaauuuaacaaaagccgaaagaggaggacuaacaaacgaagauaaagcacgcuucauacaacggcaguuaguagaaacaagacaaauaaccaaacacgucgccaggauucuagacacucgauucaauacuaaacuggacgaagcaggaaaccgaauaagagauccaaagguaaauaucauuacuuuaaagucaaacuuaguuucacaguucagaaaagauuaccaacuauauaaagugagagaaauaaacaauuaucaucaugcacacgacgcauauuuaaaugcugucguagcgacagcauuacuaaagaaauauccgcaacuugcuccugaguucgucuacggcgauuaccccaaauacaauaguuacaaaucuagaaaauccgcaacagaaaagguacuauuuuacagcaacaucaugaacuucuuucgacggguacucguauauucuaaaacaggcgaagugcguauacgaccggucauagaagucaacaaagaaacaggugaaauagucugggauaaaaagagcgacuucagaacuguacgaaaaguacuaucauauccccaaguuaacguuguuaagaaagucgaaaugcaaacaggaggcuuuagcaaagaaucaauucuacaacacggugauucagacaaacuuauuccgcgaaaaacagagaaauucuaccucgauacaaagaaauacggaggauucgacaguccaacgauagcauacucaguucuacuaauagcagacauagaaaaaggaaaagccaagaaauuaaaacggguaaaagaacugauugguauaacuauaauggaaaggauggcguuugagaaaaauccaauagaauuucuagaacauaaagguuacaaaaacauucuagagaaaaacaucauaaaacuucccaaauacagccucuucgaauuagaaaauggccguagacgguuacucgcaucagcuaaagaacuccaaaaagguaaugaaaugauacuucccccucacuuaguaacccucuuguaccacucuucaaauauccacaaaauuacugaacccauccauuuaaauuacgucaauaaaaacaaacacgaauuuaaagaauuacuaagacauaucagcgacuucucaacacgauauauacuagcacaagauagacugaguaaaauugaagaauuguaugauaaaaacgacggugacgauauauccgacuuaacuucauccuuuguaaaccuccucaccuuuacugcaauuggugccccggcggccuucaaauuccuagguagugugauagauagaaaaagauauacauccauagcugagauauuagaagcaacucuaauacaucaaagcguaacaggcuuauacgaaacacgcauagaccuuucaaaauuagguggagacuga

SEQ ID NO: 5422 - RNA, 4104 nt, Artificial Sequence
  Cas9 variant
auggucaaaaaaaaauaugcaauagggauagauaucgguacaaacagugucggaugguccguaguaacagacgauuacaaaguaccaucaaaaaaaaugaaaguuuucgguaauaccgaaaaaagauauaucaaaaaaaaccuuuugggcacacuccuauucgacgaaggcaacacugcagagaaccgcagacucaaacgcacagcgcgcagaagauacacuagaagaagaaaccgcauacucuaucugcaagaaauauucgcagaagaaauaaauaaaauugacgauuccuucuuucaaagguuggacgacucuuuccugauaguagaggauaaacaaggcucaaaacacccaauauucgguacauugcaagaagaaaaagaauaucacaaacaauucccaacaauauaucaccuuagaaaacaacucgccgacagcagccaaaaagcagacauaagacuaauauaucuugcucuugcgcauauuauaaaauaucggggccacuuucuauucgagggagaucuaaaaagcgaaaacaaagauguccaacaucuauuuaacgauuucguggaaauguucgacaaaacaguugaaggaaguuaucuuagcgaaaaccugccaaaugucgcugacguacuaguggagaaagucucaaaaucucguaggcucgaaaauauauuacauuauuuuccgaaugaaaaaaaaaacggauuauucggaaacuuccucgcacuugcacucggacuucaacccaauuucaaaacaaauuucgaacuagccgaagacgcuaaaauucaauuuucgaaagagaccuacgaagaagaccuagaagaauuacuagggaaaaucggagaugacuacgcagauuuauuuaucgcuacaaaaucacuauacgauggcauucugcuagccgguauucugucaacuaccgacucuacaacuaaagcaccccuaagcaguagcaugguaaauagauacgaagaacaccaaaaagaccuagcgcuucuaaagaauuucauucaucaaaaucucagcgacucuuacaaagaaguguucaaugauaaacuaaaagauggauaugcuggguauaucgaaggaaaaacuacacaggaaaacuuuuauagauuuauaaaaaaagcgauagaaaaaauugaaggcaguaauuauuucaucgauaaaauugauagagaagacuuccuccgaaaacaacgcacguuugacaacggaaguauaccgcaccaaauccaucuccaagaaaugcaugcaauaauucgaagacaagcagaauucuaccccuuuuuaguagaaaaccaagacaagauagaaaaaauacucacauuccgaauaccuuacuauguaggcccacuagcaagaggaaaaucagaauucgccuggcuuaacagaaaaucggacgaaaagauuagaccauggaauuucgacgaaaugguagauaaagaaaccagugcagaaaauuuuauaacccggaugacaaacuaugaccaauaccuacccgaucaaaaaguauuaccaaaacacagccuauuauacgaaaaauucgcagucuacaaugaauuaaccaaaguccgcuaugugacagaacaaggaaaaucguuuuuuuuugacgcaaauaugaaacaagaaauuuuugacgguguauuuaaaguauacaggaaagucacaaaagaaaaauuaauggacuuccucggaaaagaauuugacgaauuucguaucguagaucuauuggggcuagacaaagacaacaaaucauucaacgcgucccuaggcacguaccacgauuuaaaaaaaauaguaucaaaagauuuacuagacaacccggaaaacgaagauauucuagaaaauguuguccucacauuaacccuauuugaagaccgagaaaugauaagaaaaagacucgaaaaauauaaagauguauuaacagaggaacagagaaaaaaauuagaaaggagacauuacacaggauggggucgauuaucagccaaauuaauaaauggaauaagagauaaaguuacaagaaagacaauucucgacuacuuaauagaugauggaacaaguaauagaaacuucaugcaguuaauuaacgaugauacacuaucauucguugacgaaauacgacuagcccagggaucaggagaagcagaagacuacagagcugaaguacaaaaccuagcaggcagucccgccauaaagaagggcauacuccaaucacucaaaauaguagacgaacuaauugaagucaugggauacgauccagagcauauaguaguagaaauggccagagaaaaccaauuuacuaaccagggaagacggaacucgcaacaaagauacaaaaaaaucgaaaacgcuauaaagaaucuugacagcaaucuaaauagcaaaauauuaaaagaauacccuacaaauaaucaggcucuacaaaacgaucgacuauuccuuuacuaccuccaaaacggaaaagacauguacaccgaugaggaacuagauauugaucaguugucucaauacgauauagaccacauaauaccacaagcauucaucaaagaugauucccuagacaacaaagucuuaaccaaaucugcaaaaaauagagguaaaucagacgacguuccuucacuagaaauaguacacaaaaagaaaaauuucuggaagcaacuacuagauucacaacucaucagucaacgaaaauuugacaaccuuacaaaagcagaacgaggaggucucacaaacgaagacaaagccagauucauacaacgacaacuugucgaaaccagacaaauaacaaagcacguagcaagaauauuagacacaagauuuaacacaaagcuagacgaagcagguaauagaauaagagacccaaaaguaaauauaauaacacugaagagcaaucuaguaucacaauuccgaaaagauuaccaacuuuauaaaguaagagaaauaaauaacuaccaccaugcucaugaugcauaccugaaugcaguaguugcaacggcccuacuaaaaaaauacccacagcucgcuccagaguucguauacggugacuacccaaaguacaauucauacaaaagcagaaaaucagcaacugaaaagguacuauucuacagcaacaucaugaacuucuuucgacgcguauuggucuauucaaaaacaggagagguacgaauuagaccagucaucgaagugaauaaggaaacgggagaaauuguaugggauaaaaaaagugacuucaggaccguacgaaaaguacuaagcuauccccaaguaaauguaguaaaaaagguugaaaugcaaacuggcggauuuucaaaagagucaauauugcaacauggagauucagacaaacuaauccccagaaaaacagaaaaauucuaccuugacacaaaaaaauaugguggcuuugacucgccaacuaucgcguauucaguucuuuuaauagcagacauagaaaaaggaaaagcaaaaaagcuaaaaagagucaaagaauuaauagguauaacaauaauggaaagaauggcauucgaaaaaaauccaauagaauuccucgaacauaaaggauacaaaaacauacuagaaaaaaacauaauuaaguuaccuaaauauucacuauuugaauuagaaaauggcagacgacgucuacucgcguccgcgaaagaacuacaaaaaggcaaugaaaugauccuacccccccaccuaguaaccuuacuauaucacucgaguaacauacacaaaauaacagaaccaauccaccuaaacuauguaaauaaaaauaagcacgaauuuaaagaacugcuaaggcacauaucagauuucucuacaagguauauccuagcccaagaccgacuuagcaaaauagaagaauuauacgacaaaaacgauggagacgacauaucagaccuaaccucgucauucgucaaucuucugaccuucacagcaauaggcgcaccagcagccuuuaaguuucucgguagcguuauagaccgaaaacgauacaccucaauagcagaaauacucgaagcaacauugauucaccaaucaguaacgggauuauacgagacaagaaucgaucuaucaaaacuaggcggggauuga

SEQ ID NO: 5423 - RNA, 4107 nt, Artificial Sequence
  Cas9 variant
auggacaagaaauauucaauaggccuagauauagguacaucauccauaggcuuuguuggaguugaugagaacggauggccacuuaauauaaaaggaaaacgagcuauaggagcacaccuguuucgagaaggugaagcugcugcagaaacacgcggauucagaacaacccgccgcagauacaacaggcgaaaauggcgauuaagauuacuaagagaaauauucgacgaaccuauaucccguguagaucccacauucuucgccagaaugaaagaauccucaguaagucccaaagacccaaacuacgauggccuugccaaagaaaucuugaucccaagagacaaagaugguaaaaucuuauacccuacaauauaccaccuucgucaugcauuaauguacgaagaccaccaguucgacaucagagagauauacuuggccauacaccauauuguuaaauacagaggccauuuccuacuagacggugccgcuaaaaauuuugagucuucaaaucucgacuuaaaaagcgacauccacgaaaucaaugcaauucuaguaggaauauucggcaacgaacagguccaguucaacgaccaguacguagaaaaauuaaaagagguacuauuagacucuacacaaucucguuccgaccgccaaaaagcagcagcaaaaguccuacuaccaacuaaugauuuagauaaagacaccacaaaaauacuaaaaacugugagcacagaaauaacaaaagcuauuacaggcuuaaaagcuaaauucuuugucauaacaggaaacgacauagcaaaagaccaacaaaaagauuggacauucucaauagauacuuuagaugagaaaaugucagucauagaaccaucauuuucagaaaagaauuucucuuuaauaacaauacuccaaaaauuauauucaucgguuacccuugcugguauaguacccaauggacucucccucagugaagcaaugauucaaaaauacgacagacacgcaucagaccuaguuuuacuuaagaaauacugggacacgaaacccaaaguuuuaaaacaccaacuccaaaacacauaugcagaauacaucgaaauccaucaaguaguagacgaauuuuacucagauuuaucaaaauuaaucaaaaacgacgacgacacauuagcccaagaaauaaagucgaaaaucacaaucgguaauuuccuacccaaacaaagaacaacagaaaauggaguaaucccauaucaacuucaacaaagagaauuagacacaauaaucaaaaaccaacaagaauauuauccuuggcuagcugaagaaaacccaguggccgaucaucagauugcuuucccauauaaacuagaugaauuaguaggauuuagaauaccauauuacgucggcccaaugauagcuaaagaagauaccagcaacaguaagaacucuaaauucgcauggaugauucgaaaacaaagcggagaagucacaccuuggaacuuugacgaaaagauagauagaacugcuuccgcaacagcuuucaucgaucgcaugacaaccacagacacauaucuaaucggugaagacguccuaccaaaacaaagucuaauuuaccaacgauucgaaguacuuaaugaauuaaauaaaauaucuaucgacggacaaccuauaaccagaaaacaaaaacaaucuguauauacucacguauucgaaaagaagaaaacaguucaaguuaaagauguacaaaaauuucuagucucaucuggugaaguaaugucuuuaccgaaaauagguggacuugcaaacgaaaaacaauucaacagcucccuauccacacuauaugacuauaauaaaauaauaccugaugcucuagaagauagaaauaaagucgaugauaucgagaaaaucauccucuggucaacaauauuugaagacaauagcauauuuguugaaaaacuugacucaauagacuggcucaccagcagucaacgcaaaagguuagcacaaaaacgcuaucggggauggggacgauugucccuucgauugcuuacaacauucaaaaacaaagauggauacuccaucuuagaugaacuauggaacucuaaucacaauuuuauggaaauucaagcacagagugacuuuuccgaacaaauagcuacugcuaacaauaauaaccuaucucaaguucuacccgcuaaaugggaacccggcaggaaaaauuuagcuagcuuggacgaguucaucuccaaucuuuauacaagcccacaaaauaagaaagcacuccgaaaagcaauuagaguaguccaggacaugaugacagcagcuggacauaugccagagaaaauauucauagaagucgccagagauacuuccaacucacaucaacaaacaauugcacgacaacggcaauugcaacaauuauaccaaucagaagcaaaagaaguaauagauuccuccguacguuccgaacuagaugauauacuuaaaaaccgagcuaauauaaaagaccagcucuuucuauauuuucaacaaggagguagagauuuguauaccggaaaagcaaucaacauagacaaauuaagucuauaccacauagaucauauucuaccacaaagucugguuaaagacgacucccuagacaaucgaguacuuguaucacaaaagacaaaugaagacaaaggaguuacguuugucucagauaaauacaugaauaacaugcucccuacauggaaacguuggcacgaaaugggacuuaucucagcaagaaaacugaaaaaccuaacaaugagaccugacgaaauagacaaauaugcacccgguuuuauacaaagacaauuaguugaaaccagacaaguaacuaaacucguaauagaacuacuagacgcgcuauuagggaacucucaaacagaaauuauaacaauaaaggcuucauuaucacaucaauuucgccaacaauuugacuuagucaaaauacgagaaguaaacgacaaccaccaugccuucgacgcauuccuagcagcuagaaucggaacauacuuauacaaacgcuacccaaaacuuaggccauauuuuguauacggucaauauaugcaaaaccacaaaaaccuaaaaagcauuaaccuuaucaaaacccuggauucagacaaagcuauaguagaugaagguacaggagaaauccuaugggauaagaaaucagacuuagccaaaaugauaaaaauauauaauuaucaaagacugcuaauaacacaugaaucacgcaccaguuuuggcgcaauguacaaacaaaagauuuuaaaagcaacagacgcuaaacaaaacggcggagguuuuaaacucguaccuacaaaaagaaacuggccaguagauauauacggugguuacaccgggcaaacugcagccuaccuaacaauaguuagagucuacagcaagaaaaccagcgaacuccgcguguuacccaucuacacaaauaaaguccaacaaauugaaaaagcaaugacgcaaggcgacaaagccacaauguuagccuucaagaaaguaaucgcuccucaauuaggaaaagaaaacaagaaaacacaugaaauaaaaauaccagaguucgauguuguaauaccuaaagugcuuuuagaucagcuaguuauugacgacauagcagguucaccacaccgcuuccgauuaggaacagauacauacuaccauaauucacaacaauuauuucugcccuuaaguaugcaacgccaauuaauggaucgagaaagcgaugauaaagucuaccuugacauuuuuaacgauguauuaaaacaaguugacucauacuuuaaccucuacgacgucaacggcuuuagagcugcccuacaaaaauccaagaaagcauuugaacaacucccaauaaacgacuuuccuaaagaugucccugacaacaagaagaagaaaggaaaaagauccauacugaaagaaauauucauuggacuccaugcaaaugcaacucuaggaaauuuaaaacaaaugggaauuaaaacagacuucgguaaacuccagaaauccaacggcuuaaggauaacagaaaacugcaaaaucauucaucaaaguccuacagguuuauucgaaagaauaguaccuauuaaauga

SEQ ID NO: 5424 - RNA, 4107 nt, Artificial Sequence
  Cas9 variant
augucgagaccauacaacauagguuuagauaucggaacaucauccauagguugguccguaguugacgaccaaucaaagcuaguaucgguacgaggcaaauauggauacgggguccgccuauacgacgaaggucaaacugcugcugaaagaagaucauuucguacuacaagaagacgucuaaaacgaagaaaauggaggcuaggacuccuccgagagauuuuugaaccuuauauaacaccuguugaugauacauucuuccugaggcagaaacaaucgaaucuaucaccaaaggaccaaagaaaacuauauccgcagacuagcuuauuuaacgaucgcacagaccgcgcauucuacgaugacuacccuacaauauaucaccuacguuauaaacuaaugacagagaaaagacaauuugauauccgcgaaaucuauuuagcuaugcaccacauuguuaaauauaggggacacuuucucaaugaagcaccaguuucaaguuuuaagucaagugaaaucaaucuaguagcgcacuucgaucgucugaauacaaucuucgcugaccuauuuagugaaaguggcuuccaacucgaaaccgacaaauuagcagaagucaaagcauuacuccuggacaaucaacaaagcgcaucuaaucgacaaagacaagcccucucacuaaucuauacaccgaguacaaauaaggcuguagaaaaacaaaacaaagccaucgcaacagaauuacuaaaagcuauucuaggauuaaaagcaaaauucaacguauuaacuggaauagaagcagaagacguaaaagccuggacuuugacauucaaugcugaaaauuuugaugaagaaaugguaaaacuagaaagcucuuuggaugauaaugcucaccagauaaucgaaagucuacaagaacuauauagcgguguacuuuuagcuggaaucguaccagaaaaucagagucugucacaagcuaugauaacaaaauaugacgaccaucaaaaacaccuaaaaaugcucaaagcuguacgcgaagcucuagcaccugaggacagacaaagacugaaacaagccuacgaucaauaugucgauggucaagaaaacacaaaagcauauagcaaagaagauuuuuacggugauauuacaaaagcacugaaaaacaacccagaccacccaauaguaagugaaaucaaaaagcuaauagaguuagaccaauucaugcccaaacaacgaacgaaagauaauggcgccauaccacaccaacuccaccagcaagaauuagaccguauaauagagaaccaacaacaauauuacccaugguuagcugaauuaaauccuaacucaaaacgacagacgguagcuaaauacaaacuagaugaauuaguagccuuccgcguucccuauuauguaggaccauuaauaaccgcugaacaacaaagacaaucaucagacgcaaaauucgccuggcugauaagaaaagcagaaggacgaauaacacccuggaauuucgacgauaaaguggaccgccaagcaucagcaaaugaauuuauuaaaagaaugacaacaacagacaccuauuuauuagccgaggauguccucccaaaacaaucccuaaucuaucagcgauuugagguacuuaacgaacuuaacggauuaaaaaucgacgaccagccuauaacgaccgaacucaaacaggcgaucuuuacagaccuguuuaugcagaaaauuucaguaacagugaaaaacauucaagauuacuuaguaagugagaaaagguacgcaucacgaccugcaaucacaggacuaucagaugaaaacaaauucaauaguagacuaaguaccuaccaugauuugaaaaugauagucggugacgcaguagacgaugucgauaaacaagcugauuuagaaaaaugcaucgaaugguccacaauauucgaagaugguaaaauauacagcgcaaaauuaaacgaaauagacuggcucacagaucaacaaagaguacaacuagcggcaaaaagauacagaggauggggaagauuaagugcaaaacuuuuaacacaaaucguuaacgcaaauggacaaagaauuauggacuuauuaugggacaccaccgacaauuucaugaggauaguucauucagaagauuucgacaaacuaauaacagaagccaaucaaaugaugcuagcagaaaaugacguacaagacguaauaaacgaucuauauacaucaccccaaaauaagaaagcucuaagacaaauuuuauugguaguaaaugacauucagaaagcaaugaaaggccaagcacccgaacgaauauuaauagaauuugccagagaagacgaaguuaacccccgacuaucaguucaaagaaagcgucaaguggaacaaguauaccaaaacauaaguaaugaacugcuuaauaacacagaaauaagaaaugaacuaaaagauuuauccaauucagcauuguccaauacuagauuguuucucuauuuuaugcaaggaggacgugacauguauacaggagacucacuaaacauugacagacuaucuacauacgauauagaucacauauuaccucaauccuuuguaaaagauaacucucuagauaacagagugcuaguaucccagaaaaugaaucggucaaaggcagaucaaguaccaacggauuucacgagcguugaauuaggaaagaaaaugcaacuacaaugggaacaaaugcugcgagcaggauuaauaacgaaaaagaaauacgacaaccugacguuaaaccccgaccacaucucaaaauaugccaugaaaggcuucaucaaucgccaacucguagagaccagacaaguaauaaaauuagcuacaaaucuccuaauggaacaauacggagaagacaauauagaacuaaucacugucaaauccggacugacacaucaaaugagaacagaguucgauuuuccgaaaaacagaaaucucaacaaccaucaccacgcauucgacgcauacuuaacugcauuuguaggacuauaccuacuaaaacgguauccaaaacuaaaacccuauuuuguauacggagaauaucaaaaagcaucccaacaagauaaauggagaaacuuuaauuuccuaaauggacugaagaaagaugaguuaguagacgaaaacacagaggcaguaauuugggacaaagaaucaggauuagcauaccuaaacaaaauauaucaauuuaagaaaauauuagugacacgagaaguacacgaaaacagcggagcccucuuuaaccaaacuuuguaugcagcgaaagacgacaaagcaucaggucaagguggaaaacaauuaauucccgcaaaacaagauagaccaacugcauuauacgguggauauucgggaaaaacaagcgccuaucuaugccuggucaaaaucaaaaauaaaucagaauauauuuaucgcauuuucggaguaaacacaaguugguccagugaauuaaaacagauccaagacccagccgaaagacuuguacgccuagaaaaauuacuaacgccacaauuaacaauuaacaaaaagaagaaaggcgaaccaguacccguaaccaaagauuucaaaaucauacuuccuaggauauuaauaaaucaaaaauucuauucucgaggccaagacauaaguauugccucugaguucuaucuacacaaugaacaggagcuaguccuggacaaaagugauaucaaaauucuaaauggagcaauaaaaguaaacaauagcaauaaacaaguuauaaaccuuuucaaucauauacuagaacaaguaaaccaguauuuuccgguuuaugauauuuauaaauccagggaaguucuaaacucaagcaaagaaauauuugaaaaucuuaccuggaacgaucaauggcguaaucguaaacuaaucaauguaggacagaaaacuauccucaaucgcauacuaauaggauuacaugccaacgcagcuagaauaaaaauaagugaacucggauuuaaaaacgacuucggucucuuaacacaaacaaguggaaucaccuucaccccagacacucaaauuaucuaccaaagcccaacgggacuauuugagcgaagaguagcuuuaagagaucuauga

SEQ ID NO: 5425 - RNA, 4107 nt, Artificial Sequence
  Cas9 variant
augaaacgaucauauaauauaggauuagauauaggaacaaacucuauaggaugggcaauaguugacgaccaaucaaaguuaauaucggucaaagguaaauauggguacggaguaagauuauaugacgaaggucaaaccgccgccgaacguagaaguuuucgaaccacaagaaggagacugaaacgacgcaaauggcgacuaggccuacuaagagaaauauuugaaccauauauaacuccaauagauucgacauucuuuuuacgacaaaagcaaucuaacuuaucaccuaaagaucaacgcaagcucuacccucaaacaucacuuuuuaaugaucgaccagacgcagauuuuuaccaacaauaccccacaauauaucaucuucgcuaucaacucaugacggaaaaacgccaauuugacauacgagaaauauauuuagcaaugcaucacauaguaaaauacaggggucauuuccuaaacgaggcaccuguagccucguuuaaaagcucagaaauuaauuuagcagaacacuucgaccaacugaauaccauauucgccgaucuauuuagagaauccggauuucaacucgagacagacgaauuaguugccguaaaagcacucuugauggauaaccaacaaagugcgucaaaccgacaacgaaaagcauugccaaaacuauacacgccaucagcggacaaaaguauagaaaaacaaagaaaggcaauagccacagaaauacuaaaggcaauucuaggauuaaaagcaaaauucaacguugugacuggaauugaagccgaagacgugaaagccugggcccucaccuucaaugcagagaauuuugaugaagaacuugcaaaacuagagaguucauuagacgacaacggccacgagguaauaggaaucuuacaagaauuauacuccggaauauuacuagccgguauagucccagaaaaucaauccuuaucccaagcuaugauuacuaaauaugaagaacaccaagcacacuuaaaaaugcuaaaagccguaagagaugaucuagcgacggccgaccaacaaaaguuaaagaaagcauacgaucaauauaucgacggccaagaaaauacuaaagcauacucaaaagaggcuuucuacgacgaugucacaaaagcacuaaaagacuacagcgaacaacccuuaguaagugaaauucaaaaauuaauugaauuagaccaauucaugccuaaacaaagaacuaaagauaacggcgcuauaccucaccaacuucaucaacaagaauuagaccgaauaauagaaaaucaacagcaauauuauccuuggcuugcugaauuaaacccgaauccaaaaagacaaacaguagcuaaguauaaauuagaugaauuaguagccuuucgagucccauacuaugugggaccauuaauaaccgcggaacaacagcaacaaagcucaaaugccaaauucgccuggaugauuagaaagaccgaaggccgcauuacaccauggaauuucgaugauaaagucgaucgacaagccagugcaaacgaauuuauaaaaagaaugaccacaacagacacauaucuuuuggcggaagacguacuaccaaaacagucacuaaucuaucaacguuucgaaguacuaaaugaacuuaauggccuaaagauagaugaccaaccaauaacaaacgaauuaaaacaagcuauuuuuaacgauuuauuuaugcagaaaacauccguaucggucaaaaacauucaagauuacuuagugagugaaaaacguuacgcaucgcguccagcgauuacaggccucucagaugaaaagaaauucaacaguagauuauccacauaucaugaccuuaaagucauuguaggagaugcuguagacgacguagacaagcaagcugaccuagaaaaguguaucgaauggagcacgaucuucgaagauggaaagauauauagcgcaaaacuaaaugaaauuacaugguugaccgaacaacaaagaggacaacucgcaacgaaaagauaucgcggauggggcagacuuuccgcaaaauuauuaacgcaaaucgugaaugcaaacggacaacgaauuauggaucuccugugggacacaacugacaacuucaugcgcauagugcacuuugaagacuucgacaaauuaauaaccgaagcgaaucaaaugguuuuggcagaaaacgacguacaagacguaauaaacgaucuauauacaaguccccaaaauaagaaagcccugagacaaauucuauuagucguuaacgacauacaaaaagccaugaaaggucaagcucccgaacguauccuaaucgaguucgcccgcggggcucaaaaagacaaaucacuaacggugagacgaaaacggaaacuagaugaaauguauucccaaauaucagacgcuguucuagccgaugaauccguaagacaagaacuaaaaucaagcaaccaagaugaccuaguaaaagaaaaaguuuauuuguauuuuaugcaaggaggaagggaucuauauaccggaaaugcucuaaauauugaucgauuaucagauuaucacguagaucacauaauaccacaagcauacaucaaagaugacagccuagauaauaaagcucuaguuagcucaagaaugaaugaaaucaaagcagacagggucccccuacaagucguacaaaaacaauuugguaaaaacauggcaagugaauggggauacaugcaccgagcaggacucauaucuagaaagaaauaugauaaucuaauguucaacccagaaaaucuaaauaaauaucaaauuaaucgcuucauaucucgacaauuaguagaaacucaacagguaauaaaauuaguugcaaacuuauuaucaaaucaguacgaaggagacaaugucaaaauuauaaccguaaaaucaaaacuuacacaaacaauaaggucagaauuugacuuucccaaaaauagggagguaaauaacuaccaccaugcauuugacgcauauuuaacagcauucguuggaauguaccuucuaaaaagauacccaaaauuaucaucauauuucacauacggagaauaucucaaaggaaaccaacaagauaaauggagcucauucaauuuccuaaacgaucucaaaagagccaaacucgaagauaaaacuaacaaagaaaucuuuuggcacaaggagucaggucuagcauaccuuaacaaaauuuaccaguuuaagaaaauucuaguaacacgagaaguucaugaaaacucaggagcauuauuuaaccaaacacuauaugccgcaaaagaugacaaagccuccggacaaggaggaaaacaacugauaccagcuaaacaagccagaccaaccgccuuauacggcggauauagcggcaaaacuguggcuuacaugugcauugucagaauaaagaacaagaaaggagaucucuauaaagucugcggaguagaaacaagcugguuagcucagcuuaaacaguugaaagacgaagauucacaaaaagcguucuuaaaacagaaaauaagcccacaauucaccaaagcaaagaaacaaaaaggaacaauaguaaaagucgucgaggacuucgaaguaauagcgccacauauacuaauaaaccaacgacuauuugacaacggacaagaacucacauuagguagcgcaacguacaaacauaacgaacaagaacuuauacuagauaaaacugcgguaaaacuguugaacggagagcucccccucgcacaaagcgaagaacuagccgaacugguauacgaugaaauacuagaucaaguaaugcacuacuucccauuauaugacacgaaucaauucagagcaaaauuacucgcuggcaaaacagccuuuaugcaguuaccuuggaaaagcaauccagacgauaacaaaacagugcaaauuacucaacccauagugcucaagaaaaucuuacaaggauuacaugcagaugcaggcagagucucacucaaagaacuugggaugacaaccgauuucgggaugcuacaaaaagcaacugggauaacauuuacaccugacacccaaaucauauaccaaaguccuacaggauuauucgagagaagaguagcccuaagggaucuauga

SEQ ID NO: 5426 - RNA, 4107 nt, Artificial Sequence
  Cas9 variant
auggauaaaaaauauaguauaggucuagacauuggaacuaacucuguuggcugggcaguaauaaccgaugacuauaaggucccaucaaaaaaauucaaaguucuuggaaacacagauaggcacaguauaaaaaaaaaucucauaggagcauuacuauuugacucaggagagacggccgaagcuacuagauuaaaaagaacagcaaggagaagauauaccagaagaaagaauagaauaugcuaccuacaggagauuuucuccaaugaaauggcaaaaguagacgauaguuucuuucacagauuggaagaaucauuccuugucgaagaagacaagaaacacgaacggcauccaaucuucggcaacaucguugacgaaguggcauaccaugaaaaauauccaacaauauaccaccuaagaaaaaaauuaguagacucaacugacaaggccgaccuccgacuaauauaucucgcucucgcucauaugauaaaauuucgaggccacuuccuuauagaaggcgaccuaaacccagauaauucugauguagacaaacucuucauacaacucguacaaacuuauaaucaauuguuugaagagaacccaaucaaugccagugguguagaugcaaaggcuauccuaucagcaagauugucaaaaucccggagacuagaaaaccuaauagcucagcuccccggcgaaaaaaaaaacggacuauuugguaaccuuauagcccuaucauuaggucuaacaccaaacuuuaaaucgaauuuugaccuagcugaagaugcaaaacuacaauuaucaaaagacaccuaugacgacgaucuagauaacuuacucgcucaaauaggcgaccaguaugcggauuuauuucucgcagcuaaaaaucuuagugaugccauccuguuaucagauauacucagggucaauacagaaauaacaaaagcaccccuaagcgcaagcaugauuaagagauacgacgaacaucaucaagacuuaacauuacugaaagcccuaguuagacaacaauuaccggagaaauacaaggagauauucuuugaucagucuaaaaacgguuaugcaggcuacauagacggaggcgcuucccaagaagaauuuuauaaauucauuaaaccaauccuugaaaaaauggacggaacagaagaauuacuaguaaaacugaacagggaggaccuuuuaagaaaacaaaggacauuugacaacggaagcaucccccaccaaauacaucuuggagaacuacacgcaauacuacgaagacaggaagauuuuuacccauuuuugaaagacaauagagaaaaaauugaaaaaauucuaacauuuagaaucccauacuacgucggaccccuagcaaggggcaacucuagguuugcguggaugacaagaaaaucggaagaaaccauuacaccauggaacuucgaggaggugguagauaaaggagcaagugcacaauccuucauugaaagaaugaccaauuuugauaaaaaucuaccaaacgagaaaguccuaccgaaacacucauuacuuuacgaguauuucacuguuuauaaugaacucacaaaaguuaaauacguaacggaaggcaugagaaaaccagcauucuuaucaggugagcaaaagaaggcaauaguagacuuauuauuuaaaacaaaccgaaaaguaaccguaaaacaauugaaagaagacuacuucaaaaaaauugaaugcuuugauucagucgaaauaucaggaguagaggacagguucaacgccucacuagggacauaucacgaucuucuaaaaauaaucaaagacaaagacuuccucgacaaugaggaaaaugaagacauauuagaagacauaguauuaacguuaacacucuuugaagauagagagaugauagaagaaagacuaaaaaccuaugcgcauuuauucgacgauaaaguuaugaaacagcugaaaaggagaagauauacagguuggggaagacuaucuagaaaauuaauaaacggaauucgcgacaaacagucaggcaagacaauccuugauuuucucaaaucugaugguuucgcaaaucgcaauuuuaugcaauuaauucacgaugacagucucacuuucaaagaagauauccaaaaggcacaagucagcggacaaggcgauagcuugcacgaacauaucgccaaucuagcaggaagcccagcaauaaagaaaggcauucuacaaacgguuaaaguagucgaugaacuaguaaaaguuaugggacgacacaaaccagaaaacauagucauagaaauggcucgggaaaaucaaacaacacaaaaaggacagaaaaacucacgcgaaagaaugaaacguauagaagaaggaauuaaagaacugggaucccaaauucucaaagaacacccaguagaaaacacucaacuucaaaacgagaaauuauaucuauacuauuuacaaaacggcagagauauguacguugaccaagaauuagacaucaacaggcucuccgacuacgacguagaccauauaguaccacaaagcuuucuuaaagaugacucaaucgauaacaaaguacucacccguucugacaaaaacagaggcaaaagcgacaacguaccgucggaagagguaguuaaaaaaaugaagaacuauuggagacaacuacuuaacgcaaaacuaauaacacaacgaaaauuugauaacuuaaccaaagcagaaagaggcggacuaucagaauuagacaaagccggcuuuauaaaaagacaauugguagaaaccagacaaauuacaaaacacguagcacaaauacucgacucacguaugaacacaaaauaugacgaaaaugauaaacuaaucagggaagucaaaguaauaacauuaaaauccaagcuaguaucagauuuuagaaaagauuuucaauucuauaaagucagggaaauuaacaacuaccaucaugcacacgaugccuauuuaaacgccgucguugggacagccuuaauaaaaaaauaccccaaauuagaaagcgaauucguuuacggugauuauaaagucuacgacguacgaaaaaugauagccaagucagaacaagaaauaggaaaagcaacagcuaaauacuuuuuuuauuccaacauaaugaauuuuuucaaaacagaaauuacccuagccaacggugaaauaagaaaaagaccauugauagaaacaaacggagaaacuggagaaauuguaugggacaaaggaagggacuuugcaacgguucgcaaaguucuaaguaugccacaagucaacauaguaaaaaaaaccgaaguacaaacaggaggcuuuucaaaggagucaauacuacccaaaagaaacucagacaaauuaaucgcucgaaaaaaagauugggauccaaaaaaauacggcggauucgacuccccuaccguugcauauucagucuuagucguugcgaaaguagaaaaagguaaaucaaaaaaauuaaaaagcguaaaagaguuacuaggaauaaccaucauggaacgaagcaguuucgagaaaaacccuauagacuucuuagaagcgaaaggauacaaagagguaaaaaaggacuugauaaucaaacuuccaaaauacucucucuuugaacuugaaaauggcaggaaaagaauguuagcaucagcaggugagcuucaaaaaggcaacgaauuagcacucccuucgaaauaugugaacuuccucuaccuagcuucccauuaugaaaaauuaaaaggaaguccagaagacaacgaacaaaaacaacuauuuguggaacaacacaaacauuaccuagacgaaauuauagaacagauaucagaauuuucaaaaagaguaauacuugcugacgccaaucuagauaagguuuugagcgcauauaauaaacacagagacaagccuauaagagaacaagcggaaaauauaauacaucuauucacacuaacgaaucucggugcaccugcagccuucaaauacuucgacacaacaauagaccgaaaacgauacacaucaacgaaagagguuuuagaugcuacacuuauucaccaaucuauaacaggacuauaugaaacucguauagacuuaucgcaacucggcggcgacuga

SEQ ID NO: 5427 - RNA, 4107 nt, Artificial Sequence
  Cas9 variant
auggacaagaaauauaguauaggucuugacauaggaacaaacucaguagggugggcaguaauuacggaugacuauaaaguuccauccaagaaacuaaaaggccugggaaauaccgauaggcaugguauaaagaaaaacuugauaggagcucuacucuucgauuccggagaaacagcugaggcgacccgucuaaaaagaacagcaaggagaagauauacacgaaggaaaaacagaauuugcuaucuacaagaaauauucuccaaugaaauggcaaaagucgacgauucauucuuucacagacuagaagagagcuuucuuguugaagaagauaagaaacaugaacggcauccaauauucggaaauauuguagaugaaguugcuuaucaugaaaaauaccccacaauuuaucaucugcguaagaaacuagcagacaguaccgauaaaguagaucuccgccuuauauaucucgcacuagcucacaugauaaaauucagaggucacuuccuuauugaaggagaucuaaauccugauaacucagaugucgauaaacuauucauacagcuaguacaaacuuacaaucaacucuuugaagaaaaccccauuaacgcaucucgaguagacgcaaaggcuauucuuucagcgagauuaucuaaaucaagacgguuagaaaaccuuauagcgcaacuuccuggugaaaagaaaaacggccuauucgguaaucuaauagcucuaucacugggacuaacgccaaauuuuaaauccaacuuugaucuagccgaagaugccaaacuccaacuaucaaaagauacauacgaugacgaccuagacaaucuacucgcacaaauaggagaccaauacgcagauuuauuccuagcagcgaaaaacuuauccgacgcaacacuacuaucugacauuuuaagaguaaacucugaaauaacaaaagcaccucucucagcauccaugauuaaaagauacgaugaacaccaucaagauuuaacacuccuaaaggcucuaguaagacaacaauuacccgaaaaguacaaggaaauauucuuugaccaaucaaagaacggauaugcgggguacauagacgguggcgccucacaagaagaauuuuauaaauuuauaaaacccaucuuagagaaaauggacgguacagaagaauuauuagcuaaauuaaaccgagaagaucuuuuaaggaaacaaagaacuuuugacaacgggucaauacccuaucaaauccacuuaggagaacuacacgcaaucuuaagaagacaagaagacuuuuaccccuuuuuaaaagacaauagagagaagaucgaaaagauauuaaccuuuagaauaccuuauuaugucggaccacucgcaagaggaaacucaagauucgcauggaugacccgaaaauccgaagaaacaauaacaccuuggaauuuugaagaaguaguagacaaaggagcauccgcacaaucauuuaucgaacgaaugacuaauuuugacaaaaauuugcccaaugagaaagucuuacccaaacauucauugcuauaugaauauuuuacgguauacaaugaacuuacgaaaguuaaauacguaaccgaaggaaugagaaaaccagcauuucuauccggggaacaaaagaaagcaauaguagaucuacuauuuaaaacuaauagaaaaguuaccgugaaacaauuaaaagaagauuauuuuaagaaaaucgaaugcuuugacucgguagaaauaucuggcguagaggaccgcuucaacgccucauuaggcacauaccacgaccuacuuaaaauaauaaaagauaaagacuuucuggacaaugaggaaaaugaagauauacuagaagauauuguccuuacccuuacacucuucgaagacagagaaaugauagaagaaagacugaaaacuuacgcccaucucuucgacgauaaaguaaugaaacaauuaaaaaggagaagauacacaggauggggacguuuaaguagaaaacuuauuaacggaaucagggauaaacaaagcgguaaaacaauacuagauuuccuaaaaagcgauggguucgcuaauagaaauuucaugcaacugauacaugacgacucauuaacguuuaaagaagauauacaaaaagcacaaguaucaggucaaggagacucguuacaugaacacauagcaaacuuagcaggaucuccugcgauaaagaaaggcauacuacaaacaguaaaagugguagacgaauuagucaaagucaugggccgucacaaaccagagaacauaguuauagaaauggcuagagaaaaucaaacgacacaaaaaggacagaaaaauucacgcgaacgaaugaaacguaucgaagaagggauaaaagaguuaggcucagacauacuaaaagaauauccaguagaaaacacacaauuacaaaaugagaaacuauaccuauauuauuuacaaaauggaagagacauguaugucgaucaagaacuugauauaaaucgacuaucagauuacgauguagaccacauaguaccacagagcuucuuaaaagaugacuccauugauaauaaagucuugacucgaucagauaaaaacagaggaaaaagcgauaaugucccaagugaggaaguaguaaagaaaaugaagaacuauuggcgacaauuacuuaacgcgaaacuuaucacccaaagaaaauucgacaaucuuacuaaagcagaaagaggaggccuauccgaguuagauaagguuggauucauaaaaagacaacugguagaaacaagacaaauaacuaaacacgucgcccaaauacuagacucacgaaugaacacuaaauaugaugaaaacgauaaauugauacgcgaagucagaguaauaacccuaaaaucgaaacuuguaucagacuuuagaaaagauuuccaauucuauaaaguacgagaaauaaacaacuaucaccacgcucaugaugcauaccuaaacgcaguuguaggaacggcauuaauaaagaaauauccaaaacuagaaucugaauuuguauauggugauuauaaaguauaugacguacggaaaaugaucgcuaaaucagaacaagaaauagguaaagcuacagcaaaauacuucuuuuauaguaauauaaugaacuuuuucaaaacagaaauuacauuagcgaacggggaaauaagaaaaagaccguuaauagaaacaaacggugagacuggcgaaauaguaugggauaaaggacgggauuuugcaacagugagaaaaguccuaucaaugccacaagucaauauugugaagaaaaccgagguacaaacaggaggauucucuaaagaaaguauuuuaccuaaaagaaauagugacaaacuuauagcuagaaagaaagacugggauccaaagaaauacggagguuuugauagcccuacaguagcuuacagugucuuaguagucgcaaaaguagaaaaaggaaaauccaagaaauuaaaaucaguaaaagaacucuuaggaauuacaauaauggaacguaguucauuugagaaagauccaauagacuuccuggaagccaaaggauacaaagaaguuagaaaagaucuaauaaucaaauuaccuaaauacagucucuuugaacucgaaaauggcaggaaaagaaugcuagcaagugccggggaacuacaaaaaggaaaugaacuagccuuacccucaaaauauguaaacuuucuuuaucuggcaagccacuaugagaaacuuaaaggaucaccagaagauaaugaacaaaaacaauuauucguagaacaacacaaacacuaucucgaugaaauaauugaacaaauaagugaguuuaguaaacgaguaauauuagcggaugcaaaucuagauaaaguccuaucagcguauaauaaacaccgagauaaaccaauaagggaacaagccgaaaacauaauucaccucuucacacuaaccaaucucggggcgccagcggccuuuaaauauuucgacacuacaauagaucgaaagagguauacaagcacaaaagaaguacucgacgccacucucauacaucaaucaaucaccggauuauaugaaaccagaauagacuuaucgcaacuagguggcgauuga

SEQ ID NO: 5428 - RNA, 4107 nt, Artificial Sequence
  Cas9 variant
auggacaagaaauauucaauugguuuagacauugguacaaauagcguaggaugggcaguuauaacggacgacuauaaagucccuucaaagaaauucaaaguccuaggaaacacagacagacauaguauuaagaaaaaucucaucggugcauuacuauuugauaguggcgaaacugcggaagcuacgcgacucaaaagaacagcgcgacgaagauacacuagaaggaaaaacagaauuugcuaccuacaagaaauauuuagcaacgaaauggcaaaaguugacgauagcuuuuuccacagacuagaagaaaguuuucuuguagaagaagacaagaaacaugaacgacauccaauauucggcaacauaguagacgaaguggcauaucaugaaaaauaccccacuaucuaucauuuaagaaagaaacuggcagacucaacggauaaagcagacuuaagacucauauauuuggcguuggcacauaugauaaaauucagaggacacuuuuuaauagagggcgacuuaaacccagacaacagugacguugauaaacuauucauacaauuaguccaaacauauaaucaauuauucgaagaaaaccccaucaaugcaucaagaguagaugccaaagcuauacucucagcuagacuaucuaaaaguagaagacuagagaaccuaaucgcccaauuaccaggagagaaacgaaacggauuauuuggaaaucucauagccuuaucauuaggacuaacgccaaauuucaaaaguaacuucgacuuagcagaagaugcaaaacuacaauuguccaaagacacauacgacgaugauuuagauaaccugcuugcacaaauaggagaucaguacgccgacuuauuucuugcagcgaaaaauuuaagcgaugcaauauuacuuucagauauacuacggguaaacuccgaaauuacuaaagccccucuuagcgcgaguaugaucaaaagauaugaugaacaucaucaagaccuaacacuauuaaaagcccuuguacgacaacaguuaccugaaaaguacaaagagaucuucuuugaccaaucgaaaaauggauacgcaggauacaucgaugggggagcaucacaagaagaguuuuauaaguuuauaaagccaauucuagagaaaauggacgguacagaagaauuacuagccaaauuaaacagagaagaucuacuaagaaaacaacgaacauuugauaaugguucaauaccacaucaaauacauuuaggagaauuacacgcaauacuucgccgacaagaagacuuuuacccauuucuuaaggauaaucgagagaaaauagaaaagaucuuaacauuccgaauaccauacuacguuggucccuuagccagaggaaauucaagauucgcauggaugacaagaaaauccgaagaaacgauuacaccguggaauuucgaagaaguagucgacaaaggagccuccgcccaaaguuuuauagaaagaaugacaaauuucgauaaaaauuuacccaacgaaaagguccuaccaaaacacagucuacuauaugaauauuucacaguauauaaugaacuaacaaaagugaaguauguaacagaaggaaugaggaaaccugaguuccuaucaggagaacagaagaaagccauaguagaucuauuauucaaaacgaauagaaaaguuaccguuaaacaacuaaaagaagacuauuucaagaaaauagaauguuucgauucaguagaaauaaguggaguugaagauagguucaacgcuucucuaggaacuuaccacgaccuucucaaaauaauaaaagacaaagacuucuuggacaaugaagaaaacgaagauauacuagaagacauaguucuaacucucacacuauuugaagaccgggaaaugauagaagagaggcucaaaacauaugcacacuuauucgacgacaaaguaaugaaacaauuaaaaagacguagauacacaggcugggguaggcuuucaagaaaacuaauuaacgguauaagagauaaacagucaggcaaaacgauucuagauuucuuaaaaagugaugguuucgcgaauagaaauuuuaugcaauugauacaugacgauagccuaacuuuuaaggaagauauacaaaaggcccaaguuaguggacaaggagacucacuacacgaacacauagcaaauuuagcagguucaccggcgaucaagaaaggaaucuuacaaacagugaaaguugucgaugaauuaguuaaaguaauggguagacacaaaccagaaaacauagucauugaaauggcaagagaaaaucaaacgacacaaaaaggacagaaaaacucacgggaaagaaugaaacggauagaagaagggauaaaagaacuuggaucagacauucucaaagaauaccccguugaaaauacacaacuccaaaacgaaaaacuauacuuauauuaucuacaaaacgggcgugauauguauguagaccaagaauuagacauaaacagguuaagcgacuacgaugucgaccauauaguaccacagagcuuuauaaaagacgacucaauagacaacaaaguucuaacucgaagugacaaaaauagaggaaaaagugacaacguaccaucagaagaaguaguuaagaaaaugaaaaauuacuggaaacaacuuuuaaaugcaaaacuaaucacacaaagaaaauuugacaauuuaacaaaagcagaaagaggaggccuaucagagcuggacaaagcaggcuuuauaaaaaggcagcuaguugaaacgagacaaauuacaaaacauguugcgcaaauccuagauagccguaugaacacaaaauaugaugaaaaugacaaguuaauaagagaaguuaaagugauaacucucaaauccaaacucguaucagauuuccgaaaagacuuucaauuuuacaaagucagagaaaucaauaauuaucaucaugcacacgaugcauauuuaaaugccguaguugggacagcguuaauuaagaaauauccaaaauuagaaagugaguuuguuuacggcgacuauaaaguguacgaugugcgaaaaaugauugccaaaucagaacaagaaauaggaaaagccacagcuaaauacuucuucuacucaaacaucaugaauuucuucaaaacugaaauuacgcuugcaaacggagaaauaagaaaacgacccuuaauagagacuaacggagaaacaggugaaauuguuugggacaagggcagagauuuugcuacuguaagaaaaguacuaagcaugccccaaguuaauauugucaagaaaaccgaaguacaaacaggaggguuuuccaaagagaguauacuuccaaaaagaaauucagacaaauuaauagcgagaaagaaagauugggacccgaagaaauacgguggauucgacagcccaacaguagcauauucaguucuaguuguagcaaaaguagaaaaaggaaaaaguaagaaacucaaaucaguaaaagaauuacuagguauuacaauaauggaaagaucaucauuugagaaaaacccuauagauuucuuggaagcuaaagguuauaaagaaguaagaaaagacuuaaucauaaaacuuccaaaauauucacucuucgaauuggaaaacggcagaaaaagaauguuagcaucagcaggagaauugcaaaaaggaaacgaauuggcacugccaaguaaauauguuaauuuucuauaccuagcaagucacuacgaaaaacuaaaaggaagcccugaagauaaugaacaaaaacaacuuuuuguagaacagcauaaacacuaccuagacgaaauaauugaacaaauaagugaguucucaaaaagaguaauucuagcggaugcaaacuuggauaaaguacuaucugcuuauaacaaacacagagacaaaccaauaagagaacaggccgaaaacauaauccaucucuuuacucuaacuaacuucggagcaccagcagcauuuauauauuucgauacaacaauaggaagaaauagauauaaaaguauaaaagaaguucuugaugcuacuuuaauccaucaaaguaucaccggacuguacgaaacaagaauagaucuaagccaacuaggaggagauuga

SEQ ID NO: 5429 - RNA, 4107 nt, Artificial Sequence
  Cas9 variant
augaaguaugaaucugaagaauauuacauuggacuugacaugggaacaucaucagucggaugggcaguaaccgauccgcauuaccaucuaauccgaaaaaaaggaaaagaucucuggggagcacgccucuuugaaaaagcaaacacugcucaagagaggcggaccaaccgaaucaacagacgucgaaaucaacgcaggaaacaacgcaucgcauucauacgagaagcuuuuagaaaagaaguagaaaaaguagauguaaauuuuuuucgaagacuugacgaaucucaauuauauuuagaagauaaaucaauaaaggaaccauaucuacuuuuuaacgacuuaaauuauacagacaaggacuuuuaccaucaauacccaacgguguuucaccuaauaacagaccuauuaacaucagaccgcaaauucgauauucgagaaaucuacauagcaguuucaagucuauacaaccacagaggcaacuuccuaaacaaaaguuuaggaaaugaaacucaggacgaagaccuuguauucaaaaauuuagaugaagcuuucuccgccugcgguaugaacuggaacaccaaagcagaaaauaucgaaguaguaaaacaaauucuuugugacagaagccuaaauaaaaaggaaaaacaagaccaacuagcacacugccuugagauuaacaaaaaaaccgaaaaagaaaaaaucgaauuucucaaacuacuaacaggaggaaaagcagauuccaaaaaaauguucccacaguaccacuaugaacgagacgaaaaauuauccuucgcguuugcagaugaaaacggcgacgaaaauugggaagaaacauuaaacgcaauugaagaaagacuaacuucagaugaauacgggcuaaucuuagcacucaagagcguuuaugauugguccauauuagccgaccuaaugaaaaaugaaaaaacgggagaaacauacccauaccuaucaauggcaagaaaagacuccuaugaaaaacacaaagcugaucuaagguugcuaaaaaguguaauaaagagacucauaccuaacgaauacaaccacuucuuucggcaauaugacgguaaaggcaaaacguacacaaacuauauaggcucaguucaguaccaugaaaaaagacauagauucaagcauauaacaacaaaagaauuuuaugauggauuaaagaaacuacuuaaaccuuauucagaagaugaagaaauuaaacaaauccuacaagauauagagucagaaacuuucuugccgaagcaaauaacuaauaugaacggaguaaucccaaaucaaguccaugccaaagaacuuaaaguaauauuagagaaagccucucaacauuaugauuuccuuaaugaaacaaacgaaucuggauugacaguaaaagaacaaauaaugcaaauguuuacauuucagauaccuuacuauguagggccucuugcaaaucucaauggcaaaggcaauggaugggcuguaagauacguagggaaagaaagaacaaaagucuauccauggaauauggacgaagucauagacgaaaaagaaacagcagaucaauuuauaaaaaggaugauaucaaccuguacuuaucuaggagacgaauacguacuaccaaaaucauccauucuauaugaaaaguucgcagucuuaaacgaguuaaacucacuuaaaaucaauggacaaccagucucgguugacuuaaaacaaaaaauauacagagauuuauucacaaaaggcaaacgcguaacacaaaagggacuuuuacuuuaccuaaaaagggaaggagucauaucaaaaagugaagagacaauauugaguggguuugauauugacuucaaaaauacucuaucaucuuaucgcaaauucugugaagucuuugcaacaaacgaacuuaacgacgaacaaauccgcauggcagaagacauaauagaauggcuaaccgucuucggagauucuaagaaauucguaagggaaaaaauacauggaaauuacccacaaauaacagcaaaucaacuaaaaagaauacuaucauuuaauuucaaagacuggggaaaacuaucaaaacaauuucuggaauuagaaggagaagauagagaaacggguaaaagcuguucucucauacaagcgcucugggacacaaauaacaacuuaaaccaacuauuaucauccagauuuacauauaaagaaaaucuagaaaagaaacguaaaaaaauagagauggaucuauuugaauucacucaugaggauuuagacgaccuuuauauuucagcaccaguaaaacgaaugauauggcaagcauuaaaaauaaugaaggacauaguaauaguaaugaaagaauccccaacuaaacucuucauugaaaugacaagaaacaacgaaaaugaaaaaacccgaacaguaucaagaaaaaacaaacuugucgacuuauauaagaaaauaaagggagaaucacgagauuggauaaaagaacuagaacguuaugaagaaaaagauuuucgaaguaaaaaauuauacuuauacuauacacaaauggggaaaagugcuuauucaggagaaccuauugacauggauaaacucuucgauaaaaacgucuacgacauagaucacauauacccaaaaucaaaaguaaaggaugauagucuauugaacaauugcguucuaguaaagagaaaagaaaacauggauaaaggaaacaauuuuccuauugacccagacauacagacaaaacaagaacaucuuuggaaauucuggcuagaaaagggacucauaacccaagaaaaauucaacagacuaaccagaaagaaacccuuuacuaaugacgaacuugcugacuuugucaaccgacaacuaguagagacaggacaagccaccaaaaccauugcggaucuguucaaaaugacauuuccaaacagcgacaucguauauguaaaagcaggaaacguaacugauuucagacaauacauagaagucuacaaaugccgagaaguaaauaaccugcaccacgcauaugaugcuuacuuaaauguaguagucggcaacguuuacgauaccaaguucacaaaaaacccuaugaacuacaucaaagaacaaaggaaagaaaacucaaaugaacgguaucauauggacaaaauauucgaauuucccgugauacgcaacggcaaagaagcauggauaacaaaaaaagaugaaaguauaaacauuguaagaaaaacacuagcaagaaaaacgccuuuaguaacaaaacgaaauuucgaagcaaaugggacaauagccaaagcaacuaucuacccaaaaggcaacgucaaagaccagggauaccuaccaagaaaaaccuccauuccagcacuaagagacaugaaaaaauacggugguguaaccagcauacaaauagcauacuuuuuucuuguugaacacgaaguuaagaaaaaacgcauccggacaauugaauguguaccgaucuaucgaaaagaagaacugaagacaaaagaacaacuagaacgauauuguagagaggaacuaaaacuuauaaacccaucgauuaggcuugaaaagauaaaaccauacucacuacuuaaaaugaacggaaacuuuuucuacauaacaggaaaaaccaacgauagauucagucuugccaaugcaauggaguuauauguggacaaaguuucugaaaaccacauaagagaccuaguaaaauauaaaaauugcggauacuuuaacgucgacgauaaagaagccagaaaacgaaaugaacgucuauacacaauacuuacaaaaaaacauuuaacugucuucaaaggcagccccaaaccaaugggagaaaaacuucaacaauaucaacaacucuuucuagaacucgagguuagcaaacaaguauacguccuucuacaaauauuacaacuuaccgcuacuaacgugaaaaccaaagcugaccucaccgcgaucggaggaaaagcgaacgaaggcacaauggauauaagcaaaaaucuagaaaacgucauaaaaaaucaaauuaaaaaaggacucguaccagagcuaaugcugaucaaucaaucaccaacaggacucuuugaauccgaaaucgaccuauuaacgaucuga

SEQ ID NO: 5430 - RNA, 4107 nt, Artificial Sequence
  Cas9 variant
augagcaggccauacaacauaggucuggacaucggaacaagcagcauaggauggucaguaguggaugaucaauccaaauuagucucaguacguggaaaauacggcuacggaguucgccuauacgaugaaggccaaacagcagcggaaagacgcuccuucagaacaacuagaagaagacuaaaaagacgaaaauggcgacucggauuacuaagagaaauauuugaaccuuacauaacaccaguagaugauacuuucuuuuuacgaaagaagcaaucaaacuuaucaccuaaagaccaaagaaaauuauacccacagacgucccucuucaaugacagaaccgaucgagccuucuacgaugacuacccgacgaucuaccaccuacgcuauaaacuaaugacugagaaaagacaauuugacauacgagaaauauaucuagcaaugcaucacauagucaaauaucgcggacacuuccuaaaugaagcaccuguaucgucauuuaaaagcucagaaauaaaucucguagcccacuucgacagauuaaauacuauauucgcagaccuauuuagcgaaucaggguuccaacucgaaacugauaaacuagcagagguaaaagcauuacuacucgacaaccaccagucugcaaguaaucgccaaagacaagcccuauuacuaauauauacuccuucaaccaauaaagcuguagagaaacagaauaaagcaauagccacagaacuacuuaaagcaauacuaggucucaaagccaaauuuaacguucuaacagggauugaagcagaagacgucaaaacuuggacucuaacauucaacgcagagaacuucgaugaagaaauggucaaacuugaaaguagccuagacgacaaugcacaccaaauaauugaaucauuacaagaguuauauucuggcgucuuacuugccgggauaguuccagaaaaucaaagccuuucccaggcaaugauaaccaaauaugacgaccaucaaaaacaccucaaaauguuaaaagcaguucgagaagcacuugcaccugaagaccgucagagacuuaaacaggcuuaugaucaauauguagacggccaagaaaacacuaaagccuauucaaaagaggauuuuuauggggauauaacaaaagcgcucaaaaauaaccccgaucacccaauagugagcgaaauuaaaaagcuaauagaauuagaucaauuuaugccaaaacaacgcacuaaagacaauggagcgauaccucaucaacuacaucaacaagaauuagauagaauaaucgaaaaccaacaacaauacuacccguggcuagcagagcucaacccaaauagcaaaagacaaacugucgccaaauacaaacuagacgaauuaguggcauuucguguaccauacuauguagguccccuaauaacagccgaacaacaacaacaaaguagugaugcgaaauuugcuuggaugaucaggaaggcagaaggacaaauaacuccauggaauuucgaugacaaaguagaccgacaagccagugcaaacgaauuuauaaaaagaaugacaacaacagauacuuaucucuuagcugaagacguccugcccaaacaaucgcucauauaucaacgauucgaaguccuaaacgaacuaaacggcuuaaagaucgaugaccaaccuauaaccacagaacuaaagcaagcuauauucacagaucuuuuuaugcagaaaacaucaguaacuguuaaaaacauucaagauuauuuaguauccgagaaaagauacgccucacgcccagcaauuacaggacuuagugacgaaaauaaauuuaacucaagacuaucaacauaucaugauuuaaaaacaauagucggagaugcaguagaugauguagacaaacaagcagaccuagaaaaaugcaucgaauggagcacaauauucgaagacggcaaaaucuacucagcuaaacuuaacgaaauugauuggcucacagaucaacaaagaguucaacuagcagcaaaaagauacagagguuggggaagacuaagugcaaaacuacuaacacaaauaguuaaugcuaauggucaaagaauuauggacuuauuaugggacaccacagacaauuuuaugagaaucguacauucagaggacuuugauaaacuuaucacagaagcaaaucaaaugaugcuagccgaaaacgacguacaagauguaauaaacgaccuauacacaagcccacaaaauaagaaagcucuacgacaaauccuuuuaguaguaaacgacauacaaaaagccaugaaaggucaagccccagaacggauuuugauagaguucgcacgcgaagacgaagucaaccccagacuaagcguacaacgaaaaagacaaguagaacaaguauaucaaaacauauccaacgaacuauuaaauaauaccgagauccgaaaugaauuaaaagaccuaucuaauuccgcucuauccaauacccgucuauuucuuuauuuuaugcaagggggccgugauauguauacaggugauagcuuaaauauagacagauuauccacauaugacauugaccacauacuaccacagagcuucauaaaagauaacagccuugauaaucgcguguuaguaagccaacguaugaauagaagcaaggcagaucaaguaccuacugauuucacaagcguagagcuaggccagaaaaugcaaauacaaugggaacaaauguuaagggcuggacuaauaacuaaaaagaaauaugacaauuuaacacuaaacccggaucacauuaguaaauacgcaaugaaagguuucaucaacagacaacuggucgaaacaagacagguaaucaaauuagccacuaaucuacuaauggaacaauacggagaagauaauauagagcucaucacuguaaagaguggacuaacccaccaaaugcguacugaguucgauuuccccaaaaaccguaaucugaauaaucaucaccaugccuucgaugcauaccuaacagcauuuguuggacuauacuuacuuaaacgauauccaaaacuaaaaccuuacuucguuuauggugaauaccaaaaagcgucccaacaggauaaauggcgaaauuuuaacuuuuuaaacggauugaagaaagaugaacuuguagaugaaaacacagaagcaguuauuuggaauaaagaaagcgggcuggcguaucuaaacaaaauauaucaauuuaagaaaauauuagugacaagagaaguacaugaaaauucgggugcacuuuucaaucaaacccucuacgcagccaaagacgauaaagcauccggacaaggagguaaacaacuaauaccggcgaaacaggacagaccuacugcauuauacggaggauauagcggaaaaacaguugccuacaugugcauuguaagaaucaaaaacaagaaaggggaccuauacaaaguaugcggugucgaaacuucauggcuggcacaauuaaaacaacuaacagacgaagacucgaagaaagccuuccuaaaacagaaaauuucaccucaauuuaccaaaguaaagaaacaaaaaggaaccauagugaaaguaguagaagacuuugaagucauagcaccccacauucucauuaaucagcgcuucuuugauaacggccaagaacuuacccuagguucugccacguauaaacauaacgaacaagaacugauacuggacaaaacagcaguaaaauuacuaaacggagccuuaccauuaacucaaucagaagaauuggcugaacaaguuuaugaugaaauacucgaccaaguuaugcauuauuuucccuuauaugauacaaaucaguuccgggcaaaauuauccgcaggcaaagcugccuuuaugaaauugccuuggaaaucccaaugggacgggaacaaaaugguacagguaggacaacaaguaaucuuagacagaguacucauuggauugcacgcaaaugcagcugucucugacuuaggaguauuaaaaauaucuacuccauuagguaagaugcaacaacccaguggcauaucccuuucaccagacacucaaauaauauaccaaucaccaacuggauuauucgagagaagaguugcacuaagagauuuauga

SEQ ID NO: 5431 - RNA, 4107 nt, Artificial Sequence
  Cas9 variant
augaguaggccauauaauauugguuuagauauaggaacaaguucaauagguuggucaguagucgaugaucaaagcaagcuaguauccguacguggaaaauacggcuaugguguccgauuauacgaugagggacagaccgcugcagaaagaagaucauuuagaacaacaagacgaagacuaaaaagaagaaaauggagacucggccucuugcgagaaaucuuugaacccuacaucaccccagucgacgauacuuucuuucuuaggcaaaaacagagcaaccucucacccaaagaccaaagaaaauuauauccccaaacuucucuauuuaaugaccgaacagaucgugcauuuuaugaugauuaucccacaaucuaccauuuacgauacaaauugaugacugagaaaagacaauucgacaucagagaaauauauuuagcaaugcaccauauagucaaauaccguggacauuuccuaaaugaagccccuguaagcucauuuaaaucauccgagauaaauuuaguagcacauuuugauagacuuaauacuauauuugccgauuuauucucagaaucaggcuuccaacuagaaaccgauaaauuagcagaagugaaagccuuauuacucgauaaucaacaaucugccagcaacagacaaagacaggcauuaucacuaauauauacccccucuacaaacaaagcaguagagaaacaaaauaaagccauagcgacagaacuuuuaaaagccauacucgggcugaaagcaaaauucaauguccuuacacgaauagaagcagaagauguuaaagcauggacauuaacuuuuaaugccgaaaacuucgaugaagaaaugguuaaauuagaaagcucauuagaugacaaugcucaccaaauuaucgaaucauuacaagaauuauacucaggaauccuacuagcgggaauaguucccgaaaaccaauccuuaucacaagcuaugaucaugaaauacgaugaccaucaaaaacaccugaaaaugcuaaaagcaguaagagaagcauuagcgccagaagaucgacaacgacucaaacaagcauacgaucaauauguagaugggcaagaaaauacaaaagcauauucuaaagaagacuucuacggcgauauuacaaaagcauuaaagaauaauccagaccacccgauuguauccgaaauaaagaaauuaaucgaacuagaccaauucaugcccaaacagagaacaaaagauaauggagcaauuccacaucaacugcaccaacaagaacuggacagaauaauagaaaaucaacaacaguauuacccaugguuagcagaauugaacccaaauaguaaaagacagacaguggccaaauacaaacuugaugaacucguagcauucagaguaccauauuacguaggaccauuaauuaccgcugagcagcaacggcaaagcucagacgcaaaauucgcuuggcuuauaagaaaagcugagggacgcaucacuccauggaauuucgacgauaaagucgaccgacaggcaucagcgaaugaguucaucaaacgcaugacuaccacagauaccuaucuacuagcagaagacguucuaccaaaacagagccuuauauaucaacgauuugaagugcuaaaugaacuuaaugggcuuaaaaucgacgaucagccuauaaccacagaacuaaaacaagcuauauucacagauuuauucaugcaaaagacaucaguaucggucaaaaacauacaagacuaccuuguaagcgagaaaagguaugcaucacgcccagcuauaacaggucuaucagacgaaaacaaauuuaacagucgccuaagcaccuaucaugaucuaaaagccauaguaggcgacgcuguagaagauguugauaaacaaguagaucuugaaaagugcguugaauggucuaccaucuucgaagaugguaaaauauauucagcaaagcuaaacgaaaucgacuggcuaacagaucaacaacgaguacaauuagccgcaaaacgcuaccgaggauggggccguuugagugcaaaauuacuaacacaaaucguaaaugcaaauggacaacguauuauggacuuacuuugggauacaacagacaauuucaugaggauaguccacagcgaagauuucgacaaauuaauuacagaagccaaccaaaugaugcuagcugaaaacgacguucaagauguaauaaacgaucucuauacaagcccacaaaacaagaaagcccuaagacaaauauugcuaguaguuaacgacauacaaaaagccaugaaaggacaagcgccggaaaggauacuaauugaguucgcaagagaagacgaaguuaacccgagacuauccguacaacgaaaacgacaaguagaacaaguauaucaaaacauuaguaaugaacuucuaaacaauacagaaauaagaaacgaauuaaaagaucuaucaaacucugcucucucaaacaccagacuauuucuauacuuuaugcaagguggaagggacauguauaccggagacagucucaacauagauagauuaagcacauacgacauagaccacauacucccccaaucuuucauaaaggacaauucauuagacaaccguguauuagucucccagaaaaugaaucguucaaaggcagaucaagucccuacggacuucacuucgguugaauuaggaaagaaaaugcaacuacaaugggaacaaauguuacgagcaggguuaauaacuaaaaagaaauacgacaaucuaacacuuaauccugaccacauuucuaaguaugcaaugaaaggauuuauuaaccgacaacuuguagaaacccgucaaguaauaaaacucgcaacaaaucuucucauggaacaauauggagaagacaacauagaauuaaucacaguuaaaucaggcuuaacacaucaaaugagaaccgaguucgacuucccuaaaaacagaaauuugaauaaucaccaccacgcauuugaugcuuauuuaacugcuuucguaggguuguacuuacuaaaacgauacccaaaguuaaaaccuuacuuuguauacggagaauaucaaaaagcgucccaacaagacaaauggagaaauuucaacuuucuaaacggucuaaagaaagacgagcuaguagacgaaaacaccgaagcuguaauaugggacaaagaaucagguuuagcauauuuaaacaaaauuuaucaauucaagaaaauacucguaacaagagaaguacacgaaaacucuggagcacuauuuaaucaaacgcucuacgccgccaaagaugauaaagcaaguggucaaggcgggaaacaauuaauuccagcuaaacaagacagaccgaccgcauuauauggcggguacuccggaaaaacaguagcauacaugugcauaguaagaauuaaaaacaagaaaggagaucuauauaaaguauguggcguagaaacgucauggcuagcacaacuaaaacagcuuaccgaugaggacagccaaaaagcauuucuaaaacagaaaauaagcccacaauucacuaaagugaagaaacaaaaagguaccauagucaaaguaguagaagacuucaaagucauagcaccgcauauacuaauaaaccaaagauucuuugauaauggacaagaacuaacccucggaagugcaacuuauaaacauaacgaacaagaacuuauauuagauaaaacagcaguaaaacuguugaacggcgcacuuccauuaacacaauccgaagaacuagcugagcaaguauaugacgaaauauuagaucaaguaaugcauuauuuuccucuuuacgacaccaaccaauuuagagcaaaguugucagcaggaaaagcagccuucaugaaacugccuuggaaauccaucugggacgguaacaaaaugacacagauuggacaacagauaauccuagaccguauacuaaucgguuuacacgcgaacgcugcuguaagugaccuaggaguccuuaaaauaaguacuccauuaggaaaaaugcagcaacccaguggaauuagcuuaucuccagauacccaaauaauauaccaaucacccacuggauuauucgaaagacgcguagccuugagagauuuauga

SEQ ID NO: 5432 - RNA, 4107 nt, Artificial Sequence
  Cas9 variant
augguugaaaagaaaagcuauucuauuggcuuagacauaggaacaaacuccguaggaugggcaguaauaaccgaugauuauaaagucccugccaagaaaaugaaaguucuuggaaacacauccagacaaucaauuaagaaaaauaugauaggagcucuccucuuugaugaagguggaccugcagcaucaacucgaguaaaacggacaacucggcgaagauauacuaggaggaaaaacagacuuuguuauuuaagagauauauuugagucugagaugcacacgaucgacaaacacuucuuuuuacgccucgaagauucauuuuuacauaaaagcgauaaaagauaugaagcacacccaauuuuuggaacucuacaagaagaaaaagcguaccacgauaacuacccaaccauuuaucacuuaagaaaagcccuagcugauaauacugaaaaagcagaccuacgcuuaauauacuuagcauuagcacacauuaucaaauuuagaggacauuuucugaucgaaggagcauuaagcgcaaauaacacugacgugcaacaauugguccaugcucuaguagacgcuuacaauauaauguucgaagaagaccaauuagacauagaagccaucgacguaaaagcaaucuuaacagagaaaauaucuaaaacgaggagauuagaaaaucuaauaucuaauauuccuggacaaaagaaaaacggacuguucgguaaccucauagcacuaagucuaggauuaacaccuaauuucaaaagucauuuuaaccuuccugaagacgcuaaacuacaauuagccaaagauacauacgaugaagaacuuaacaauuuacuaacacaaauaggcgaugaauaugcagauuuguuccuaagcgccaaaaaccucagugacgcaauucucuuaucggauauacuaacggucaacggugacggcacacaagcuccacuauccgcaucuuuaauuaaaagauacgaagaacacagacaagacuuagcccuacuaaaacaaauguucaaagaacaacucccugaccucuauagagacguauuuaccgacgaaaauaaagauggauacgcagguuauauaagcggaaaaacaagucaagaagcauucuacaaauauaucaaaccaauuuuagaaacccuagacggagccgaagacuucuuaaccaaaauuaaccgugaagacuuuuuacgaaaacaacgaacuuucgacaauggaaguauaccacaccaaauccaccuaggagaacuccaagcuauauuggaacgccagcaagccuauuacccauuucucaaagauaaccaagagaaaauagagaaaauacugaccuuccgaauaccauacuauauuggaccccucgcaagaggcaacagcagguucgccuggcuaacaagaacaucagaccagaaaaucacuccauggaauuucgacgaaaugguagaucaagaagccucagcgcaggcuuuuauugaaagaaugaccaauuuugacgaauauuuaccacaagaaaaaguacucccaaaacacucacuaacauaugaauacuucacaguauacaaugaacuaacaaaaguaaaauauguuacugaaggaaugaccaaaccagaauuuuuauccgcagggcaaaaagaacaaauaguagaguuacucuucaagaaauaccgcaaaguaacaguuaaacaacuaaaagaagacuucuuuuccaaaaucgaaugcuuugauaccguagauauaucaggaguagaagauaaauuuaacgcgucacugggaacauaccacgauuuauuaaaaauuaucaaagauaaagcauucuuagacaacucagaaaaugaaaauauaauagaagacauuauauuaacacucaccuuguucgaggauaaagaaaugauagccaacagacucgcagucuacgaggauuuauuugaccaaaacguucuaaaacaauuaaaacgucgccauuacaccggcuggggacgacuaucaaaacaauuaauaaacggcaugagagacaaacauacaggcaaaacaauauuagacuucuugaaagcggacggauucauaaaucgaaacuuuaugcaauuaauaaacgaugauaaucuaucuuuuaaagaagagaucaagaaagcacaagaagggggauuaaaagacucuauaaaugaccaaauaagagaccucgcuggaucuccugcuauuaagaaagggaucuuacaaacaauuaacauagucgacgagauugucaaaauaaugggaaaagcaccccaacauaucguaguagaaauggcucgagacgugcagaaaaccgacauaggaguaaaacaaucuagagaacgaaugaaaagaguacaagaaguacucaagaaauuaggaagucaacugcuaaaagaacacccaguagaaaacuuucaauuacaaaacgaaagacuauaucuauacuaccuucaaaauggaaaagauauguacacaggagaagaauuaucuauaucaaauuuaucgcacuaugauauagaccauauaaucccacgcagcuucauaaaagacgacucuauugauaacaaaguacuaacucgcucagaacacaaucgaggaaaaaccgacaauguacccaguaucgaaguuguaaaaagaaugaaaccauacuggcaaaaauugcuagacacaaaaguaauaucacaacgaaaauuugacaaccuaaccaaagcagaacgcgguggcuuacaagaaucagacaaagcuaacuuuauccagcgccagcuaguagaaacaagacaaauuaccaaacacguagcccaaauucuagauaguagauucaauacagaaagagacgaaaaagauagaccaauaaggagaguaaaagucauuacccucaaaaguaaauucguaucagauuuucgacaagacuucggcuuuuauaaacuccgagagauaaacgacuaccaucaugcacacgaugcauaucucaacgcaguuguaggcacagcgcuacuaaaaauguaucccaaacuagccucagaauuuguauauggggacuaccaaaaauaugaucuaaaacgcaugguagguaaaagcggcaaagcaagcggccacgcaacagcaaaguacuucuuuuauucuaauuuaaugaacuucuuuaaaagugaaguaaaacuagcaaauggaaacauaauaaaacguagccccaucgaaguaaaugaagaaacuggcgaaauaguaugggauaaaaccaaagauuucggcacugucagaaagguacugucagcaccccaaguaaacauugucaagaaaacugaaauacaaacaggagguuuuagcaaugaaacuauacuaagcaaaggaaaaucaagcaaauuaauaccgagaaagaauaaauggcgagacacuacaaaguauggaggauucaauacacccaccgucgccuacucuguauuagucguagcuaaaguagaaaaaggcaaagccaagaaacuuaaaccuguaaaagagcuaguugguauuacuauaauggaacgcacaaaauuugaagcaaauccaauagcauuucuagaaagcaaagguuaucaugacauccaagaacaucuaaugaucacacucccaaaauauucauuguucgaacuagaaaaugguagaagacgacuacuugcaucagcuaccgaacuacaaaaagguaacgagaugguacuaccgcaacauuuagucaccuucuuauacaggguaucaaaacgagacaaagguacccaaagugaaaauauggaauauaucaguaaccauaaagaaaaauuuaucgaaauauuucauuauauaauacgauacgcagagaaaaaugugauuaaaccaaaaguaauugagagauuaaacgauacauuuaaucaaaaauucaaugacagugaucucacagaacuaucaauauccuuucuuaacuuauucaaauucacaucguucggggcaccagaaaaauuuacguuucuaaauucagaaaucaaacaggacgaugucagauauagaucaacaaaagaaugccugaacagcacauugauucaucaaagcgucacuggcuuauaugaaacaagaaucgauuuaucacaauuugggggagauuga

SEQ ID NO: 5433 - RNA, 4107 nt, Artificial Sequence
  Cas9 variant
auggauaaaaaguacaguauuggacucgauauugggacaaacucaguaggaugggcagucauaacagacgacuauaaaguaccaucuaaaaaguucaaagugcuuggaaacacggacagacacagcaucaagaaaaaucuaauaggcgcauuauuauuugauucuggagagacagcugaagcaacaagguuaaaacgaacagcuagacgacgauacacacggaggaaaaacagaauuuguuaccuacaagagauauuuucgaaugaaauagcaaaaguagaugauuccuucuuucaccgacuagaagaaucauuccuaguugaagaagauaagaaacaugaaagacauccuaucuucggaaacauaguagaugaaguagcauaucaugagaaauacccaacuauuuaucaucuaagaaagaaauuagcagauaguacggacaaagcggacuuaagacuaauauauuuagcauuagcacauaugaucaaauucagaggacacuuccuaaucgaaggagaucuuaaucccgacaacucagauguggacaaacuguucauacagcuagugcaaacguauaaucaauuauuugaagaaaauccuauaaacgcaagucguguagaugccaaagcaauacuaucugcuagacuaucgaaaucaagaagacucgaaaaucuaauugcacaacuaccaggcgagaaaaggaacggcuuauucgguaaucugauagcauuaagccuaggacuaacaccaaacuucaaaucaaacuucgaucuagccgaagaugcaaaacuacaacuaagcaaagacacauacgaugaugacuuggacaauuuacuagcucaaaucggcgaucaauacgcagaccuguuucucgcagcuaaaaaucuguccgacgccauccuacuaucagauauuuuacgagucaauacagagauaacaaaagcuccacucucggcuucaaugauuaaaagauaugaugaacaucaccaagaucuaacccuacucaaagcccuaguacgacaacaacuaccagagaaauauaaagaaauauuuuucgaucaaaguaaaaauggauaugcuggauauauagaugguggagcaucacaagaggaguucuauaaauuuauaaaaccuauuuuagagaaaauggauggaacugaagaauuauuagcaaaacuuaaucgagaagaccuacuccggaaacaacgaacauuugacaacggaucuauaccucaccaaauacacuuaggagaacuacacgcaauucuucgucgccaagaagacuuuuauccuuuucuuaaagacaauagagagaaaauugagaaaauacugacauucaggauaccauacuacguagguccucucgcaaggggcaacaguagauucgcuuggaugacaaggaaaucagaagaaacuauaacaccauggaauuucgaagaagucguagacaaaggcgcuagcgcucaaucguucauagaaagaaugacgaauuuugauaaaaaucugccaaacgaaaaagugcucccuaaacauagccuccuauacgaauauuuuaccguuuauaacgaacuuacaaaaguaaaauauguaacagaagguaugagaaaaccagcauuuuuaucuggagaacaaaagaaagcgauaguagaucuauuauuuaaaacgaaucgcaaaguaacagucaaacaacuaaaagaagauuauuucaagaaaauagaauguuuugauaguguagaaauaucagggguagaagaccgguucaaugcuagcuuaggaacuuaccacgacuuguuaaaaauuauuaaagauaaagacuuccuggauaacgaagaaaacgaagacauacuugaggacauaguccuaaccuugacacuguucgaagauagagaaaugauagaggagagacuaaaaacauaugcacaccuauuugacgacaaagugaugaaacaacucaaaagaagacgauacaccggauggggcaggcuaucaagaaaacuaauuaauggaauaagagacaaacaaucugguaaaacaauucuggauuuccuaaaaagcgacggauuugcaaauagaaacuuuaugcaguuaauacaugacgacagccucacuuucaaagaagaucugcaaaaagcacaaguuagcggccaaggggacagucuacacgaacauauagcaaacuuggccggaucacccgcaauuaagaaagggauacugcaaaccgucaaaguaguagaugaauuaguaaaaguaaugggacgacauaaaccagaaaacauuguaauagaaauggcucgagagaaccagacgacccaaaaaggucagaaaaauaguagagaaagaaugaaaaggauagaagaagggauaaaagagcuuggaagugacauacuuaaagaauaccccgucgaaacuacacaacuacaaaacgaaaaacuuuaccucuacuaccuacaaaacggccgugauauguauguagaucaagaacuagauauaaauagauuaucagauuaugacguggaccauauaguaccacaaucauuuuuaaaagaugacagcauugauaacaagguccuuaccagaagcgacaaaaaucguggaaaaucagauaacgucccgagcgaagagguuguaaagaaaaugaaaaacuacuggaaacaacuacucaaugcuaaauuaauaacacagcgaaaauuugacaauuuaacaaaagcagaacgcgguggccuaagcgaacuagacaaagcaggauuuaucaaacgacagcuaguugaaaccaggcaaaucacaaaacacguugcccaaauacuagauagccgaaugaauacaaaauaugacgaaaacgacaaauuaauucgagaaguuagaguuauaacccugaaaucuaaacuuguuagcgauuuucgaaaagauuuccaauucuauaaaguaagagaaauaaacaacuaucaccaugcacaugaugcauaccuaaacgcuguaguuggcacugcacugauaaagaaauauccaaaacuugaaagugaauuuguauauggagauuacaaaguuuacgauauacguaaaaugauagcaaaaagugaacaagaaaucggaaaagcgacagcaaaguacuuuuucuauaguaauauaaugaacuuuuucaagacagaaauaacauuagccaacggagaaauacgaaaaagaccucuaaucgaaaccaacggagaaacaggggagauaguaugggauaaaggcagagacuucgcuacuguccgaaagguacuuucuaugccacaagucaacauagucaagaaaacagaaguacaaacaggaggcuuuucuaaagaaucaauauuaccaaaacgaaacucggauaaauuaauugcaagaaagaaagauugggaucccaagaaauauggaggauuugauagcccgacgguagcauacagcguauuagucguagccaaaguagaaaaagggaaaucaaagaaauuaaaauccgucaaagagcucguaggcauuacaauaauggaacgcucaaguuucgaaaaagauccgguugacuuuuuggaggccaaaggauacaaagagguacgaaaagaucuuauuauuaaauuaccaaaauacaguuuauucgaacuagaaaauggacgaaaaagaauguuagcuagugcaggcgaacuucaaaaaggaaacgaacucgcacucccgaguaaauauguuaacuuccuauauuuagcaucacacuaugaaaaauugaaagggaguccagaagacaaugagcaaaaacaacuauuuguagaacaacacaaacauuaucuagacgaaauuauagaacaaauaagugaguucagcaaaagaguaauauuagcagacgcaaacuuagacaaaguauuaucggccuauaacaaacacagagauaaaccaauacgugaacaagcugaaaacauaauacaucuuuuuacacuaacgaauuuaggagcacccgcagcuuuuaaauguuucgacacaacaaucggaagaaacagauacaaaaguaucaaagaaguacuagacgcaacacucauucaucaauccauuacaggcuuauaugaaacaagaaucgaucuuucccaauuaggaggugauuga

SEQ ID NO: 5434 - RNA, 4107 nt, Artificial Sequence
  Cas9 variant
auggauaagaaauauuccauuggguuagauauaggaacaaguucaauaggauuugucggaguagacgaaaauggguggccuuuaaacauaaaaggcaaaagggcaauaggagcgcauuuguucagagaaggcgaagcagcugcagaaacucgagguuuccgaaccacccgaagacgcuacaaccgaaggaaauggagacuaagauuauuaagggaaauauucgacgaaccaaucucaagagucgaccccacguuuuucgcaaggaugaaagaaaguucuguaucaccgaaagauccaaacuacgacggauuagcaaaagaaauauugaucccaagagauaaagacggcaaaauauuauaucccacuauauaucaccuaaggcacgcauuaauguaugaagaccaccaauuugacauaagagaaauauaucucgcaauacaccacauuguaaaauaccgaggacauuuccuacuagauggagccgcuaaaaauuucgaaucgucaaauuuagaccuuaaauccgauauacacgaaauuaacgcaauauuagucgguauauuuggaaaugaacaaguccaauuuaaugaccaauacguagaaaaacugaaagaaguguuauuagauucaacccaaagucgaagugauagacaaaaagccgcagcaaaacugcucuuacccacgaaugacuuagacaaagauaccacaaaaaucuuaaaaacagucucuacagaaauuacaaaagcaauuacgggacuaaaagccaaauucuuuguuaucacaggcaaugauaucgcgaaagaccaacaaaaagacuggacguucucgaucgauacauuagacgagaaaauguccguaauagaacccucguucucagagaaaaauuuuagccugauaacaauuuuacaaaaacucuacucuucuguaacccuugccggaauaguccccaacggacuaucuuuaagugaagcaaugauucaaaaauacgaccgccacgcaagcgauuuaguacucuugaagaaauauugggauaccaaacccaaaguacucaaacaccaacuccaaaacacuuaugccgaauacaucgaaauacaccaaguaguagaugaguucuauagugaccugagcaaacuaauuaaaaacgaugaugacacacucgcucaagaaauaaaaucaaaaauaacaauaggcaacuucuuacccaaacaacguacuacagaaaauggugucauaccauaccaacuacaacaacgggaauuagacaccaucaucaaaaaccaacaagaauauuacccauggcuagcagaagaaaacccaguugcugaccaccaaaucgcauuccccuauaaacuagacgaacucgucggauuucgcauaccguauuacguagggcccaugaucgcaaaagaagauacaucaaacagcaaaaacagcaaauuugcauggaugauaagaaaacaaucaggcgaagucacaccauggaauuucgacgagaaaauagaccgcacugcgagugcuacagcauuuauagacagaaugaccacgaccgauacauaucugauaggagaagacguacuuccaaaacaaucucucauauaccaacgauuugaaguccugaacgaacuaaacaaaauaucuauugauggccaaccaauuacacgaaaacaaaaacaaagugucuacacucaugucuuugagaaaaagaaaacuguacaaguaaaagacguccaaaaauucuuaguaucuucaggagaaguaaugaguuuacccaaaauuggagggcuggcaaaugaaaaacaauucaacuccagucuaaguacgcuauacgauuacaacaaaauaauacccgaugcauuagaagacagaaacaaaguagaugauauagagaaaauaauacucuggucaacaauuuuugaagacaacaguaucuucguugaaaaacuggauucuaucgacuggcucacuagcagccaacggaaacguuuagcacaaaaacgauauaggggauggggccgacuaagucuaagauuauuaacaacauucaaaaacaaagauggauacucaauccucgacgaauuauggaacucgaaucacaacuuuauggaaauacaagcacaaucugacuuuucagaacagauugccacugccaacaacaacaaccuaucccaaguucuaccagcaaaaugggaaccaggacgcaaaaaccuagcuucccuagacgaauuuauaucuaaccucuauacaucaccacagaauaagaaagcauuaagaaaagcgauaagagucguacaggacaugaugaccgcugccgggcacaugccagagaaaauauucaucgaaguggccagagauacguccaauucacaccaacaaacaauagcaagacaaagacaguugcaacaauuauaccaaucagaagacaaagaagucauagauucaucaguaagauccgaacuagacgacauacuaaagaacagagcaaacaucaaagaucaacuauucuuauacuuccaacaaggaggacgagauuuauacacuggaaaagcaaucaauaucgauaaauuaagucuauaccacauagaccacauacuuccucaaagccuagucaaagaugauagucuagacaaucgaguucuaguuucacagaaaacaaaugaagacaaaggcguaaccuucgugagugacaaauacaugaauaacaugcugccuacguggaaaagguggcaugaaaugggacuuauaucugccagaaaacugaaaaacuuaaccaugcggccugaugaaaucgacaaauaugcaccaggauucauacaacgacaauuaguggaaacacgccaaguaaccaaauuaguuaucgaacuucucgaugcccuauuaggaaauagccaaaccgaaauuauuacaauaaaagccucacuaagucaccaauuuagacaacaauucgacuuaguaaaaauuagagaagugaacgauaaccaccacgccuuugaugcauucuuggcagcaagaauuggaacauacuuauauaaaagguauccuaaacucagaccauauuuuguguacggacaauacaugcaaaaccacaaaaacuuaaaauccauuaaucugauaaaaacauuagauuccgauaaagcaauagucgaugaaggcacaggagaaauccugugggacaagaaaucagacuuagcaaaaaugaucaaaauauacaauuaucaacgacuucucauaacacaugaaucaagaacauccuuuggagcaauguauaaacagaaaauacuaaaagcaacagacgcaaagcagaacggagguggauucaaauuagucccaacgaaaagaaacagacccguagauaucuaugggggcuacacaggccaaacagcagcuuaccuaacaaucguacgcguauacucuaagaaaacuuccgaauuaagaguauugcccauauacaccaacaaaguccaacaaauagaaaaagcaaugacucaaggggacaaagcuacaauguuagccuuuaagaaagucaucgcaccgcaauuaggaaaagagaauaagaaaacccacgaaauaaaaauccccgaauuugacguuguaauccccaaaguauuguuagaccaacugguaauugacgauauagccggaagcccucacagauucagauuaggaacagauacauacuaccacaacucucaacaacuuuuucuuccacuaucuaugcaacgucaacuaauggaucgagaaucagacgacaaaguguaccuagacaucuucaacgauguccuaaaacaaguugacuccuacuuuaacuuauacgauguaaacggcuuucgcgcagcacuucaaaaaucuaagaaagcauucgaacaauuaccaauaaaugauuuuccuaaagacgucccagacaauaaaaagaagaaaggaaaaaggagcauccuaaaagaaauuuuuauuggauuacaugcaaacgccacgcuaggaaaccuaaaacaaaugggaauaaaaacggauuucggcaagcuccaaaaaucaaacgguuuaagaauaacagaaaacugcaaaauuauucaccagucccccacaggacuauuugaaagaauagucccaauaaaauga

SEQ ID NO: 5435 - RNA, 4107 nt, Artificial Sequence
  Cas9 variant
auggauaagaaauauagcauuggccucgauauagguacuaacagcguagguugggccguuauuacagacgauuacaaaguaccaucgaagaaauucaaaguucuugguaauacagauagacauucaauaaagaaaaacuuaauaggagcacuguuauucgauucaggcgaaauugccgaagcaacuagacucaaaagaacagcgagaaggagauauacccgacgcaaaaaccgaauaugcuaucuacaggaaauauuuucuaacgagauggccaaaguggacgacuccuuuuuccauagacucgaagaaaguuucuuagucgaagaagacaagaaacacgaaagacacccaauauucgggaauauaguggaugaaguagcuuaucacgagaaauauccuacgauauaucaccuaagaaagaaauuaguagauuccaccgacaaagcagacuuacgacuaauuuaccuagcgcucgcacauaugauuaaauuccgcgggcacuuccugauagaaggagacuugaauccagauaauucggauguugacaaacuauucauucaacucguucaaacauacaaucaacuuuucgaagaaaaccccauaaaugcaucaggaguagacgccaaagcaaucuugagcgcgagacuauccaaaucaagaagacuggaaaacuuaauagcccaguugccaggugaaaagaaaaauggucuauuugggaaucuaaucgcacuaagccuagguuuaacuccaaauuucaaaucaaauuucgaucuugcagaagacgcaaaacuacaacuaaguaaagacacuuaugaugaugaccuugauaaccuacucgcacagauaggugaccaauaugccgacuuauuuuuagcagcgaaaaauuuaagugacgcuauccuguuaagcgauauauuacgacuaaacagcgaaauaacaaaagccccacuuucagcaucuaugauaaaaagauacgacgaacaucaucaagauuuaacacuacuaaaagcacuuguacgccaacaauuaccugagaaauauaaagaaaucuucuucgaucaaucgaaaaauggcuaugcuggauauauugauggaggggccucacaagaagaguucuauaaauuuauaaaaccaauacuugagaaaauggacgguaccgaagaacugcuagcuaaauuaaauagagaagaucugcucagaaaacaacguaccuucgacaaugguuccauaccucaccaaauccacuuaggugaauuacacgcgauacucagaagacaggaagacuucuacccauuucucaaagacaaccgagagaaaauagagaaaauacucaccuucagaauacccuacuauguuggaccauuagcaagaggaaauucuagauucgcguggaugacacgaaaaucugaagaaacgauaacaccuuggaacuucgaagaaguuguagauaaaggagcuucagcucaauccuucauagaaagaaugacaaacuucgauaaaaauuugccaaacgaaaaaguucuccccaaacacagcuuacuauacgaauauuucacaguauauaaugaacucaccaaaguaaaauacgucacagaaggaaugcgaaaaccggcauuucucuccggagaacagaagaaagccauuguugacuuauuauuuaaaacgaacagaaaaguaacaguuaaacaacuaaaagaagacuacuuuaagaaaauagaauguuuugauucugucgaaaucuccgguguagaagaccgauuuaaugcaagccuagguacauaucacgauuuacucaaaauaauuaaagauaaagacuuuuuagacaacgaagaaaaugaagacauccuagaagacauaguauugacccucacauuauucgaagacagagaaaugaucgaagaacgauuaaagaccuacgcacauuuauucgaugauaaaguuaugaaacagcugaaacgccgcagauacacaguauggggaagacuaucgcgaaaacucauaaauggaauuagggacaaacaaaguggaaaaaccauccuagauuuccucaagucggauggauuugccaaucgaaacuuuaugcaacucauacaugacgacagccuuaccuucaaagaagauauacaaaaggcacaaguaaguggucaaggagauucguuacaugaacauauagcuaacuuagcugguucgccggcaauaaagaaaggaauacuccaaaccguaaaaguaguagaugaauugguaaaaguaaugggaaggcacaaaccagaaaauauaguaauugaaauggccagagaaaaccaaacaacucaaaaagggcagaaaaauagucgagaaaggaugaaacgaauagaagaaggaauaaaagaacucggcagucaaauucuaaaagaacaucccguagaaaacacccaacuacaaaaugaaaaacuauacuuauauuauuuacaaaauggccgcgacauguauguagaucaagaauuagauauaaaccgacugagcgauuaugacgucgaccacauuguuccacaaucguuuauaaaagacgacucaaucgacaauaaaguacuaacaagaagcgauaaaaacagagguaaauccgacaacguaccuucagaagaaguagugaagaaaaugaaaaauuauuggagacaauuauuaaacgcuaaacuaauaacucaacgaaaauuugacaaucuuacaaaagcggaaagaggcggucucuccgaacuagauaaagcagguuucauuaaaagacaauugguugaaacgcggcaaauaacuaaacacguugcacaaaucuuagacucaaggaugaauacaaaauaugacgaaaacgacaaacucauuagagaaguaaaaguuauuacacuaaaaagcaagcuaguaagcgacuuccgaaaagauuuucaauuuuacaagguuagagaaauuaauaacuaccaccacgcacaugacgcauaucuuaaugcaguagucggaaccgcacuuauaaagaaauacccgaaauuagaauccgaguucguauauggagacuauaaaguguaugacguuagaaaaaugcuagcaaaaucagaacaagaaauuggcaaagcaacggcuaaauacuucuuuuauucaaauauaaugaacuuuuucaaaacagaaauaacucuagcaaauggagaaaucagaaaacguccauugauagaaacaaauggagaaacgggagaaauaguaugggauaaaggucgagauuucgcaaccguuagaaaaguguuaucaaugccacaaguaaauauaguuaagaaaacagaaguacaaacaggaggcuucucuaaagaaucaauacugccaaaaagaaacucggacaaauuaauagcucgcaagaaagauugggaccccaagaaauacggaggauuugacucacccaccguagcuuacuccgugcuaguaguagcaaaaguagaaaaaggcaaaaguaagaaauuaaaaagcgucaaagaacuccuaggaauaacaauaauggaaagauccucauucgagaaaaaccccauugauuuccuugaagccaaaggauacaaagaaguaagaaaagauuuaauaaucaaacuaccaaaauauagcuuauucgaacuagaaaauggacgaaaacgcaugcuggccagcgcaggggagcuccaaaaagggaacgaacuagcacuuccuaguaaauauguaaacuuccucuaccuugcaucucauuaugaaaaacucaaagguaguccagaagacaacgaacaaaaacaauuauuuguugaacagcauaagcacuaucucgacgagauaauagagcaaauaucagaguuuucaaaaagaguaaucuuagcagacgcgaauuuagauaaaguccucagugcauauaauaaacacagagacaaaccaauuagagaacaggcagaaaacauuauccaccucuuuaccuuaacaaacuuaggggcgccaacugcauucaaauacuucgauacaacaaucgaccgcaaaagguauaccagcacuaaagaaguacuugacgcaaccuuuauccaccaaucaauuacaggacuauacgaaacacgaauagauuuaucacaauuaggcggagacuga

SEQ ID NO: 5436 - RNA, 4107 nt, Artificial Sequence
  Cas9 variant
auggacaagaaauauaguauaggacuagacauaggaacaaacucaguaggaugggcgguuaucacagacgauuacaaagucccuucaaagaaauuuaaaguauuaggaaauacugaucgacauucaauuaagaaaaauuuaauaggggcccuauuauuugauagcggagaaacugcugaagccacaaggcuuaaaagaacugcacggagaagguauaccagaagaaagaaucguauuuguuaucuacaagaaauuuucucuaacgaaauggcaaaaguugacgauucauuuuuccaucgauuagaagaaaguuuccuuguagaagaggauaagaaacacgaaagacacccaaucuucgguaauauaguagaugaaguugcuuaccacgaaaaauauccaacaauauaucaccuaagaaagaaauugguggauucuacagauaaagcugaucucaggcuaauauaccuagcuuuagcucacaugauaaaauuuaggggucacuuccuuauugaaggagaccuaaauccugauaauucagauguagauaaacuauuuauacaauuagugcaaacauacaaucaacuauuugaagaaaaccccauaaacgcuucaggggucgaugcuaaagcaauacucagcgcacgacuaaguaaaucacgaagacuagaaaauuuaaucgcccaauuacccggggaaaagaaaaacggacucuucggaaacuuaaucgcucuuucacuaggacuuacaccaaauuucaaaucaaauuucgaccucgcggaagaugcuaaacuccaacucucaaaagacacauaugaugaugaccucgauaauuuauuggcacaaauaggagaucaauacgccgaccucuuuuuagcagcuaaaaaccucuccgaugcaauucuguuaagcgacauacuucgacuuaauucagagaucaccaaagcaccuuuaucugcauccaugauuaaacgauaugacgaacaccaucaagaucuaacauuacugaaagccuuaguaagacaacaacuaccagaaaaauacaaagaaauauuuuucgaccaaagcaaaaauggauacgcaggguacauugauggcggagcgucucaagaggaguucuauaaauucaucaaaccaauauuagagaaaauggacgggacagaagaacuucucgcaaaauugaacagagaagacuuacuacggaaacaacguacauucgauaauggaaguauaccacaccaaauucaucugggagaauugcacgcuauccuucguagacaggaagacuuuuauccauuccuaaaagauaauagggagaaaauagagaaaauauuaacauucaggauaccuuauuaugugggaccauuagcacgaggaaacucacgguucgcauggaugacccguaaaagugaagaaaccauaacaccuuggaacuucgaagaagucgucgauaaaggcgcaagcgcacagagcuucauagaaagaaugacaaauuuugacaaaaaucucccuaacgaaaaaguauugccaaagcacucauuauuauacgaauauuucacuguguauaacgaacuaacaaaaguuaaauacguaacggaaggaaugagaaaaccagcauuccucucaggcgaacaaaagaaagcgauagucgauuugcuuuucaaaacaaauagaaaagucacgguaaaacaacuuaaagaggauuacuuuaagaaaauugagugcuuugacuccguagaaauaaguggugucgaagaucguuuuaacgcgagucuagguacauaccacgaucuccuaaaaauaauaaaagauaaagacuuuuuggauaacgaagagaaugaagauauacucgaagauaucguccuuacauuaacacuguuugaagaccgggaaaugaucgaagaaagacuaaaaacauaugcacauuuauuugacgacaagguaaugaagcaacuaaagagaagaagauacacgggauggggaagauuaaguaggaaacuuauaaaugggauaagagauaaacaaucuggaaaaaccauauuagacuuuuuaaaaucugauggauuugcgaacaggaacuucaugcaacucauacaugaugauucccucaccuucaaagaagauauccaaaaagcacaaguaagcggucaaggcgacagccuacaugaacauauagcaaauuuagcgggaucaccggccauaaagaaaggaauacuccaaacaguaaaagucguugacgagcuaguaaaaguuauggguagacacaaaccagaaaacauagucauagaaauggcacgagaaaaucagacaacacaaaaaggccagaaaaauucuagagaaagaaugaaaagaaucgaagaggggauaaaagaauugggaucucaaauacuuaaggaacauccaguggaaaauacacaauuacaaaacgaaaaauuauacuuauacuaucuacagaacggacgagauauguaugucgaucaagagcuggacauaaaccgucuaucagauuaugauguugaccauauuguaccccaaaguuuuauaaaagaugauagcauugauaacaaaguauuaacuaggagcgacaaaaaucgaggaaaaucgaacaacguacccuccgaagaagucgugaagaaaaugaaaaauuacuggagacaacugcuaaacgcaaaacuaauaacccaaagaaaauucgauaacuugacgaaagcugaaagagguggauuaucugaacuugacaaagccggauuuauaaaaagacaacugguugagaccagacaaauaacaaaacacgucgcacaaauuuuagacucaaggaugaauacuaaauaugacgaaaaugauaaauuaauuagggaaguaaagguuauaacacucaaaaguaaacuggucagugacuucaggaaagauuuccaauuuuacaaaguacgggaaauaaauaauuaucaccaugcccaugacgcuuauuugaacgcaguaguagguacugcauugauaaagaaauaucccaaacucgaaucagaguucgucuauggagauuacaaaguauacgaugugagaaaaaugauagcaaaaucugaacaggaaauaggcaaagcaacagccaaauacuuuuucuauucaaauauuaugaacuucuucaaaacagaaaucacacuagccaacggcgaaauaagaaaacgaccauugauagaaacgaacggcgaaacaggagagauaguuugggacaaagggcgugacuucgcaacgguaagaaagguacuuucaaugccucaaguaaacaucguaaagaaaacagaaguacaaacgggagguuucaguaaagaaucaauccugccaaaaagaaacagugacaaacuaaucgcucgcaagaaagacugggaucccaagaaauauggaggauuugacucaccaacaguggccuauagcguauugguuguagcaaaaguggaaaaaggcaaaaguaagaaacucaaaucuguaaaagaacuacuaggaauaacuauaauggaaaggucuuccuucgagaaaaauccgauagauuuccuggaagcaaaagguuauaaagaaguucguaaagacuuaauagucaaauuaccaaaauauagucuauuugaacuagaaaacggaaggaaaagaauguuagcgucagcaggcgaacuccaaaaaggaaacgaauuagcacucccgagcaaauauguaaauuucuuauauuuagcaucacacuaugaaaaacuuaaaggcagcccagaggacaacgaacaaaaacaacuauuuguugaacaacacaaacacuaucuugaugaaauaauagaacaaauaagcgaguucucaaaacgagucauuuuagcagaugcuaacuuagauaaaguuuuaagugcauauaauaaacacagagauaaaccgauccgggaacaagcagaaaauauaauacauuuauucacucuaaccaaucuaggagcaccagcagcauuuaaauauuuugacacaacuauagaucguaaaagauauacuucaacaaaagaaguacuugaugcgacuuuuauacaucaaucaauaacaggucuauacgaaacgcguauugaccuuucacaauuagguggggauuga

SEQ ID NO: 5437 - RNA, 4107 nt, Artificial Sequence
  Cas9 variant
augucacggcccuauaacauugggcuagacauaggcaccucuaguauaggauggucugugguagacgaccaauccaaauuaguaucuguaagaggaaaauauggguauggagugcggcuauaugaugaaggacaaacagcagcagaacgucggaguuuccgaaccacacgaagacgacucaaaagaagaaaauggagacucggauuauuacgggaaauauucgaaccauacauaacaccaaucgacgacacuuucuuucuaagacaaaaacaaucaaacuuauccccaaaagaccagagaaaacuuuacacgcaaacuucccuauuuaacgaccguacagaccgcgccuucuaugaugauuauccaacaauauaucaucuuagauauagauuaaugacagaaaaacgacaauucgauauucgagaaauauauuuggccaugcaccauauugucaaauacagaggacauuuucuaaaugaagcuccagucucuagcuucaaaucaagugagauuaauuuaguggcucauuuugauagauugaacaccauauucgcagaccucuuuuccgaaaguggcuuccagcuagaaacagauaaauuagcugaaguaaaagccuuauuacuugacaaucaacaaagugcuucuaauagacaaagacaggcuuuaaguuuaaucuauacucccucaacgaacaaagcuguagaaaaacagaacaaagcaauagcaacugaacuauuaaaagcuauacuuggacuaaaagcaaaauuuaauguacuaacaggcauagaagcagaagauguaaaagccuggacacuaacauucaaugcugaaaauuucgacgaagaaaugguaaaacucgaaagcucacuagacgacaaugcacaccaaauuauagaaucccuucaagaacuauacucuggaguucuucucgccgggauagugccagaaaaccaaagucuaagccaggcuaugauaacuaaauaugaugaccaucaaaaacaccuaaaaauguugaaagcgguacgagaagcucucgcaccaggcgaccgacaaagacuaaaacaggcuuacgaucaauacguagacggacaagaaaauacaaaggcuuauucaaaggaagauuuuuauggagacauaacaaaagcucuaaagaauaauccagaucaucccaucguuagugagauaaagaaauuaauagaacuagaucaauucaugccaaagcaaagaacaaaagauaauggcgcaaucccacaucaacuacaccaacaagaacucgaucgaauaauugaaaaccagcaacaauacuacccauggcuagcugagcuaaauccuaacucaaaacggcaaacaguugcaaaauacaaacuagacgaauuaguggcauucagaguacccuacuacguaggcccucuaauuacugcagaacaacaaagacagagcuccgacgccaaauuugccuggcuaauaagaaaagcagaaggacggauaacacccuggaauuucgaugacaaaguugacagacaggcuucugcgaaugaauuuauuaaacguaugacgacaacagacacauaucuccucgcagaagacguauuaccaaaacaaucauugaucuaccaacgcuucgaaguauuaaacgaauuaaauggucugaaaaucgaugaucaacccauuacuacagaacuaaaacaagccauauuuacagaccuauucaugcaaaagauaucagucaccgucaaaaauauccaagauuaucuaguaagugaaaaacgauaugcuucccgucccgcaaucacaggacuuucagaugagaauaaauucaacucaagacucucaacauaccacgacuuaaaaaugauaguaggugacgcugucgaugacguagauaagcaagcagauuuagaaaaaugcaucgaaugguccacaauauucgaagacggaaaaauauacagugccaaauugaacgaaauagauuggcucacugaccaacaaagaguccaauuggcggcaaaacgcuaucgcggaugggggagauuaagcgcaaaacuuuuaacucaaauaguuaaugcaaacggccaaagaaucauggaccuauuaugggauacaacagacaauuucaugagaauaguccauagcgaggacuucgacaaacucauaacugaagcaaaucaaaugauguuagcugaaaacgauguacaagauguaaucaaugaucuauauacuagcccacaaaacaagaaagcccugagacaaauccuauuaguaguuaacgauauucaaaaagcaaugaaaggucaagcccccgaacgcauacuaaucgaguucgcucgcgaagacgaaguuaauagccgauuaucagugcaacggaaaaggcaaguugaacaaguauaccaaaacauuaguaacgaacuuuuaaauaauacagaaaucagaaacgaacugaaagaucuaaguaauucagcauuaucaaauacaagauuguuccucuauuuuaugcaagggggucgcgauauguacacaggcgacucacugaauauugauagacuuucaacauaugacauagaccacauacucccgcaaucauuuauaaaagacaacucgcuagacaacaggguccuaguaucucagaaaaugaaccguucaaaagcggaccaaguacccacagacuucacaucuguagaacugggacagaaaaugcaaauccaaugggaacaaaugcuccgagcuggacuuauaacaaagaagaaauacgauaaucucacgcuuaauccagaucauauuucaaaauacgcaaugaaagguuuuauaaaccgccaauugguagaaacaagacaaguaauuaaacucgcuacgaaccuccuaauggaacaauacggagaagacaauauagaauuaaucacugucaaaucaggcuuaacacaucagaugagaaccgaguucgauuuccccaaaaauagaaaucucaauaaucaccaccaugcguucgaugcauacuuaacagcguucguaggauuauacuuacuaaaacgauauccaaaacuaaaaccauacuucguauacggagaauaucaaaaagcuagucaacaagauaaauggaggaacuuuaauuuucuaaauggcuuaaagaaagaugaacuuguagaugaaaacacagaagcagucauaugggacaaagaaaguggccuagcauaucuaaauaaaauauaucaauucaagaaaauauugguaacacgaggaguccaugaaaauucaggagcacuguucaaucaaacucuuuacgcagcgaaagaugacaaagcaucggggcaaggagguaaacaguuaauccccgcaaaacaagacagaaguacggcuuuauauggaggauauaguggaaaaacagucgcguacaugugcauaguaaggaucaaaaauaagaaaggagaucucuauaaaguaugcgguguagaaacaagcuggcuagcgcaauuaaaacaauuaacagaugaggauagccaaaaagcauucuuagaacagaaaauaucaccucaauuuacgaaaguaaagaaacagaaaggaaauauaauagaagcagucgaagaguucgaaguaauagccccacacauccuaaucaaucaacguuucuuugauaauggacaagaauuaacauuaggaagcgcaacuuauaaacacaaugaacaagaacuaauauuagacaaaacagcgguaaaacuccuaaauggagcgcuuccacuuacucaaucggaagaacucgccgagcaaguuuacgaugaaauccuagaccaaguuaugcauuauuuuccauuauacgacacaaaccaauucagagcaaaacuaagcacuggcaaagcugccuucaugaaauugccguggaaaucacaaugggacggaaauaaaaugguacaaguaggccaacaaguuauauuagauagaauacuaauuggacuacacgcuaacgcagcaaugucagacuuaaaagugcucaaaaugacaacuccauucggaaugauucaacaaucaaccggaauuaccuuaucagccgauacccaaauaauauaccaaaguccuacuggauuauucgagcgaagaguugcccuaagagacuuauga

SEQ ID NO: 5438 - RNA, 4107 nt, Artificial Sequence
  Cas9 variant
auggauaagaaauacucuaucgggcuagacauaggaacaaacuccguaggaugggcaguuauaacugacgauuauaaaguacccagcaagaaauucaaaguacuuggaaauacagacagacacucaauuaagaaaaaucuaauaggagcuuugcuguucgacuccggcgaaaccgccgaagcaacaagauuaaaaagaacagcaagaagaagauacaccagaaggaaaaaucgaaucugcuaccuacaggaaauauucaguaacgaaauggcaaaagucgacgauucauucuuccauagauuagaagaaucauucuuaguugaagaagauaagaaacacgaacggcauccaauauucggaaauauagucgacgaaguugcauaucaugagaaauacccaacaaucuaccacuuaaggaagaaauuaguagauucuaccgacaaagcagacuuacgcuuaauauaucucgcucuagcacauaugauaaaauuuagagggcauuuucuaauugaaggagacuuaaacccagacaauagugacguagauaaacucuuuauacaauuaguacaaacguauaaccaacuuuucgaagaaaacccaaucaacgcaagugguguagaugccaaagcaauauuaucggcucguuuaaguaaaucccgucgauuagaaaauuuaauagcacaguuaccuggugagaagaaaaacggacuuuuuggaaauuuaaucgcacuaagccuaggccuuacgccaaauuucaaauccaauuuugaccuugcagaagaugcuaaacuucaauuaucaaaagacacguaugaugacgacuuagauaaucuuuuagcucaaauaggagaccaauacgcugaucuuuuucuagcagcgaaaaauuuaucagacgcuauuuuauuauccgacauacuacgauuaaacagugaaauaaccaaagccccauuaucagcaucaaugauaaaaagauaugacgaacaccaccaagauuuaacacuguuaaaagcacugguuagacaacaauuaccugaaaaauacaaagaaauauucuucgaccaauccaaaaauggauacgcaggauacauagaugguggagccucccaagaagaauuuuacaaauucaucaaaccaauucucgagaaaauggacggaacagaagaauuacuugcuaaauuaaacagagaagauuuauuacgaaaacagcguacauuugacaauggaaguauaccacaccagauacaccucggagaacuucaugcaauccuaagaagacaagaggauuuuuaucccuuccugaaagacaauagagagaaaauagagaaaauacuuacuuuccgcauaccauacuauguaggaccacuagcccgcggaaauuccagauucgcguggaugacaagaaaaagugaagaaaccauuacaccuuggaauuuugaagaaguaguagacaaaggcgcaucagcacaaucguucauugaaagaaugacaaauuucgauaaaaaucuaccaaaugaaaaaguacuuccaaaacacagcuuacucuaugaauacuucacugucuauaacgaacuaacgaaaguaaaauacguuacagaagggaugagaaaaccagccuucuuaucgggagaacagaagaaagcaaucguagaucuuuuguucaaaaccaauagaaaagucacagugaaacaauuaaaagaagacuacuucaagaaaaucgaaugcuucgauucaguagagauuucagguguugaggacagguuuaacgccagucuagggacguaucacgauuuacuuaaaauaauaaaagacaaagacuuccuagacaaugaagaaaaugaagacauucuugaagauaucguacuaaccuuaacacuguuugaagauagagaaaugauagaggaaagacuaaaaacuuaugcacaccucuucgacgacaaaguaaugaaacaacuaaaaagaagacgauauacuggguggggcagacuauccagaaaacucauaaauggaaucagggacaaacaauccggaaaaacuauacuggauuuccucaaaucggauggauucgcaaauagaaauuucaugcaauuaauacaugaugauagucuaacuuuuaaagaagacauacaaaaagcacaaguaaguggacaaggcgauucauuacacgaacacauagcaaaccuggcuggcagcccagcgaucaagaaaggcauacuucaaaccguaaaaguaguagacgaauugguaaaaguaaugggacgucauaaaccagaaaauaucguaauagaaauggcaagagaaaaucaaacaacccaaaaaggacagaaaaacagccgcgaaagaaugaaaagaauagaagaagguauuaaagaauuagguagccaaaucuuaaaagaacacccggucgaaaauacccaguuacaaaacgaaaaacuguacuuauacuaucugcagaacggccgagacauguauguagaccaagaacuagacauaaacagauuaucugacuaugauguagaccauauagugccacaauccuucaucaaagacgauucaaucgacaauaaaguccuuaccagauccgauaaaaauagagguaaaucugauaacgugccaucagaagaaguagucaagaaaaugaaaaauuauuggagacaauugcuaaacgcgaagcuaauaacacaaagaaaauuugacaaucuaacaaaagcagagcgugguggauuaucugaauuagacaaagcuggauuuauaaaaagacaguuaguagaaacccgacaaauaacaaaacacguagcucaaauauuagacuccaggaugaauacaaaauacgaugaaaacgauaagcuaauuagagaagucaaaguaauaacacuuaaauccaaacugguuucggacuucagaaaagacuuccaauuuuacaagguuagagaaauaaacaauuaccaccaugcccaugaugcauaccucaacgcugucgugggaacagcuuuaaucaagaaauaccccaagcuagaaucagaguucguauauggagacuacaaaguauaugacgucagaaagaugauagcaaaguccgaacaagaaauugguaaagcaacagcuaaauauuucuucuauagcaacauaaugaauuucuucaagacagaaauaacacuagcaaauggggaaauaagaaagcgaccacuuauugaaacaaauggggaaacgggagaaauuguaugggauaaaggacgagauuuugcaacggugcgcaaagucuuaucaaugccucaaguaaacauugucaagaaaacugaaguacaaacaggaggguuuagcaaagaaagcauccucccuaaaagaaacucugacaaauuaauagcaaggaagaaagacugggauccuaagaaauauggcggcuuugacucaccaacagucgcauauaguguccuaguaguagcaaaaguagaaaaaggaaaaagcaagaaacuuaaaucagucaaagaacuccuuggccuaacaauaauggaaagaucaucauuugagaaaaauccuauagauuuccuggaggcgaaaggauauaaagaaguaaagaaagaccucauaauaaaacuaccuaaauauagccucuuugaacuagaaaacggcagaaaaagaauguuagcuucagccggagaauuacaaaaaggaaaugaauuagcacuacccuccaaauacguuaacuucuuauauuuagcaucacauuacgaaaaacuaaaagggagucccgaagauaacgaacaaaaacagcuauuugucgaacaacauaaacacuaccuagaugagauaauagaacaaauaucagaauuuucuaaaagaguaauauuagccgacgcuaacuuagauaaaguacuaucagcauauaacaaacacagagacaaaccaauaagggaacaagcagaaaauauuauccaccuuuucacacuaacaaaucugggagcccccgcagccuuuaaauacuuugauacaacaauagacagaaaaagauauaccaguaccaaagaagucuuagacgcuacauuaauccaucaaucaauuaccggcuuauacgaaacaagaauagaccucagccaacuaggaggcgacuga

SEQ ID NO: 5439 - RNA, 4110 nt, Artificial Sequence
  Cas9 variant
augaaacguauacuggggcuagauuuagguaccaacucaauugguugggcucuaguaaaugaagcagaaacuguaaacgagaaaagcucaauaguaaaacuugggguuagaguaaauccucuuacaguugacgaacagaaaaauuuugaagcagguaaauccauaccgacaaaugcaggaaggacauuaaaacgagguaugaggagaaaccuacaacguuacaaacuuagaagagauuaccuaauacaauguuuaaaggaauauggauggauuaccagugauacucuucuuuaugaauguggaaaucgaacuaccuuugaaacauacagacuacgagccaaagcgguagaugaagaaauagcacuugaagaacuuggcagagucuuacuaaugauaaacaagaaacgcggcuacaaaagcaaccgaaaagcaaaaucaagcgaugagggacaauuaauagacggaauggcaauagcaauggauauguaucacaauggcacaacuccaggcgaguauguuuauuccuuacuaucaaaaggaaagaaauacauaccaguauucuauagaucagaucuccuugacgaguucgaccgaaucugggacuaucaaugugcauacuacccagacauccucacaagucaguucaaagaacugauacguggaaaaaguucacaagucacuagcaaacuuuucaaacaacaauauaaucuauuuacugcagacaacaaagaaaaagauaaaagacuacaggcuuauuguagacgagcugaugcauuaaagaaaagacugccagucgaagagguugcagccgcacugugcgacguaaacagagaugucaaugcaaguaguggauaucucggaacaauaagugacagaucaaagaaauuauuuuucaauaaacaaacagucgggcaauacuuaaugcuagaauuagauaaagauucacauuucagcgugaaaaacgaaguauuuuacaggcaagacuaucucaaugaguuugaagccauaugggaaaaacaagcugaauaccauccugaacucacaccggaucgaaagaaaaucuuacgggauguaguaauuuucuaucaacgacccuuaaaaucccaaaaagacuugguagcauguugugaacuagaacgaagacggauagaagucaugaaagacgggaaaguaagauccguagagauagguccaaaaguaugccccaaaucuaguccacuauuucaagauuucaaaauuuggcacguauuaaauaaucuaaaaguacgugauaaagcgacaggagacgaaagauuccuagaauuagaugaaaaagaaauacuauucagugaacuugccauaaaaucaaaacucucaaaaacggaggcuuugaaauuacuauaucaaaaaccaaaaggacucgaucucaauuacgauucaguugaaggcaauaccacgcaagcagcacuauuugaagcauaccaaacaguaauugcaaugacaggacauggagaauauguguuuagcaaaauguccgcgagugaaguaaugagcgucguggaaggaguauucggaggauuagguuucaacacuucuguauuacgauucgauucucuuuuacagggaaaagaacuagaaaaacaagauagcuaucgccucuggcaucuguuauauucauaugaaggagauaauucgguaacuggaaccgacggccuagucgcaaaaguagcaucucuauuaagaugcgacgaagaauaugcaaaagugguugcaggaguuacuuuccaaccagacuauggaagccuaucagcaaaagcaauucgacgaauacugccacacaugcgagcuggaaacgaauacuccuuagcaugugaauaugcgggguacaaacauagucgaagaucgcuaacaaaagaagaauuagaacaaaaagacuauaaagaccaucuagaacuccuuccaagaaauagucuuagaaaucccguaguggagaaaauacuuaaucaaaugguaaauguugugaaugcaguaguugaugccuacggaaagccugaugaaauacgaaucgagauggcuagagaauuaaagaaaagugcaaaagaaagagaagaaaugacagcagccauaaacaaagcaacuucagaacaugaaagaauuaaagaaauauuaaacaaagaauuuggcauacaacacguaucacauaacgacauaguucgauauaaacuuuauugugaacuaaagaauaacggauauaaaacguuauacucugauacauacauaccgcaagaaaaauuauucuccaaagaaguagauaucgaacacauauugccgcaagcgaggcuauuugacgacucauucaguaauaaaacauuagaauaucgaucugucaacauugaaaagucaaaucaaacagcuugggauuauguagccgcuaaauggggugaagaagguucacuaagauauaaaaagaggguagacgauuuacuggcagcaggagucauaggaaaaucaaaacaugauaaauuacucaugaaacaggaagauauucccaccgauuucaucaauagggacuugcgggauacacaauauauugcuagaaaagcgagagaaauacuagaagaccuaguaccaaugguaguaagcacaacaggagcaguaacagaccgccuaagagaagauuggcaauuaguagaugugaugcaggaguuaaauugggacaaauaugcaaugaaaggcuuaacagaagaauggacugauaaggacggccgcagaauuaguaggauaaaagaguggacgaaaagaaacgaucaccgacaccacgcuauggaugcuuuaaccaucgccuuuaccaaacauucauucauucaauaucuuaauaaucuaaacgcaagguccgauaaguccgguucaaucuaugcuaucgaacaaaaagaacucuaccgugauaaccacggcaaauuaagguuuauaaugccauuugaaggauucaggucagaagcaaaaagacaacuagaaaacauacugguauccauaaaagcgaagaauaaagucgucacacgaaauguuaauaaugcaagaagaggaucaggaaggcaagcaaaaguccaacucacaccgagaggacaacuacauaacgaaaccauauauggcagcauacacagauauguuacaaaauuagaaaaaguuggaggaaacuuugacggagaacaaauagcaaaaguggccaaccuaagguaucgcgaggcccuacaagcucgacaugaagcauuuggcggcgaugcaaagaaagcauuuacaggaaagaacgcauuagacaaaaacccuuuauaucucaaagacacaagaaccgaaguaccauuaaaaguaaagaccgucucgacugaaacccuguauacuaucagaaaagcaguggcaccagaucucaacguagauaaaguaauagacgcaaaaguaagaaaaguacuagaagaaagauuacaagaauauggaggagacccaaagaaggcuuuuguaaacuuagaugaaaauccuaucuacuugaacaaagcaaaagguauaacuauaaaaagaguagcaauaacuggaguaaauaaugcaauagcacuacaugauaagaaagauguuggaggacaugugauguuagacgcuucaggucgcaaacaaccaguagacuuuguuaauacugggaacaaccaucauguggcaauauacagagacgcggaagguagucuacaagaaguaguaguuagcuuuuaugaggcaguagcaagaguaucauuaggucuaccgguaaucgacagagaauaccguaaagaagacggauggcaauucuuauuuacaaugaaacaaaacgaguacuucguguuuccaaauccagaaacuggauucaacccucaagaaguagaccugacggaugaaacaaacuacgcucucauaucgcccaaucuuuuuagaguacaaaaauucacaauaaaagauuauuucuuuagacaucaucuugagacgacagucgaagauaggaaagaauuaaaagauaugacauggaaaagauguggcuuaggaggaauuaucggaauaguaaaagugaggguaaaucauauaggcagaaucguuaguguuggagaauauuga

SEQ ID NO: 5440 - RNA, 4110 nt, Artificial Sequence
  Cas9 variant
auggcuaaaacauacaauauuggccuugauaucggaacaaauagcauagggugggccgucguagaugaucaaaaccaccuaaugagcauaaaaggaaaauauggcuauggaguaagguuauacgacgaagguaaaacggcugaagaaagacgcagcuucaggacaacacggagaagacuaaaacgacgaaaguggagauugucucuauugcgcgaaauauucgaaccacaaauuacaccacuggauaacacuuucuuccuuagacaaaaacaaucaucauuauccucuaaagauaacagaaaauuauaucccgagaugucauuauuuaaugauaggacagauacagauuuuuauacacaguacccaacaauuuaccaccuuaguagagaccucaugacuaaaaacaaacaauuugacauuagagagaucuaccucgcuauguaucacauagucaaauaccgaggccacuuuuuaaaugaaagucccguauccucauuuaaaaguucagaaaucaaacuagcggaaaauuucgagacccuuaaccaaauauucaacgaaagguucaacgaaagcauguuccaacuagcagucaacgacuuugacgaucugaaagcacuucuccugaacgaucaacaauccgcuucgaaucgccagaaaaaggcacuagguaugauauauguuccaaaugaaaacaagagcuuagaaaaacaaaauaaagcuauagcaacagaacuccuaaaagcuauauuaggccucaaagcaaaauucaauguucuuaccggaauagaagucgacgacgcaaaaccauggacacuaucauucaauucugaaucauuugacgaggauauugauaaagcugcaacaaacaucgacgacgacaguagagagauaauugccauacuucagggacuauacuccgguauucuacuagcaggcauaauaccagaaaaccaaucucuaucagaggcgauggucgaaaaauaugaccaacaugcagcacauuugaaacaauugaaaucuauauacccccuguuaagcaucucugacaaaaaggccauacaacaagcauauaauuauuacaucgacggccaagauaacgcaaaagcauacagccgagaagauuucuaugcugcaacaacaaaagcucuaaaaagcuaccaagacaaugaaacaaucgccgaaauacuaaaacuuauagaauuagaacaauucaugccaaaacaaagaacgaaagauaacggugccauaccgcaucaauuacaucagcaagaacuagaaagaauaauagagaaucaacaaaaauacuaccccuggcuugcagaacucaaucccaaugaaucaagaagaaaaauagcgaaauauaaauuagaugaacucguagcuuucagagucccauacuaugucggaccacuaauaaccucugaacaacaacaacaaucuagcaauaaaaaguucgccuggaugauccgaaaagcagagggaaaaauuacaccuuggaacuucgacgaaaaaguggaucgacaagcguccgcuaaugaguucaucaaacgcaugacaacuacagacacuuaucuauuagcugaagauguauuaccaaaacaaucuuuaguauaccagagauuugaaguguuaaaugaacucaauggaauaaaaauagacgacguccccauaacaguagaacaaaaacaacguauauuuaacgaccuauuuaugaugcaagcaaguguaagugugaaaaacauucaagacuaccuaguaagcaaaggcuacuuugcauccagaccagaaauaacaggauuaucggaugaaaauaaaguaauuaguagauuauccacuuaucaugauuuaaaagcuauacuugguggaauaguagaugaagccaacaaacaggcagaucuagagaaauguguugaauggucaacaauauucgaagauggcaaaauauucguugaaaagcuaaacgaaauagaaugguuaacugacgagcagcgaaaaagauuaucaucaaaaagauaccgaggauggggacgauuaaguaauaaacuucuaaaucaaauaguaaaugagaacggacaacguauaauggauuuauuaugggacacuacagacaauuucaugagaauaguacauagugaagaguucgacaaauuaauauccgcagcaaaccaaacauuauuaagcaaaaacgaugugcaggacguaauaaaugauuuguacacauccccacaaaacaagaaagcauuaagacaaauauuguuaguagugagugacauccaaaaagcaaugaaaaaccaagcuccgucgaaaauccuaauagaauuugcaagagaagaugaagcuaauccacgucuaucaguccaaagaaaaagacaaguugaacaaguauaucaaaauaucucaaaagauauauuaagcgacucagacguaaaagccgaacuuaaagaccuaacaaacacagcgcuagcuaacacuagauuauuucuuuacuuuaugcaaggaggccacgacauguauacuggugaaacccuuaacauagauagauuauccgaauaugauauugaucauauauuaccucaagccuucauaaaggauaacucacuagauaaccguguguuaguuagugccaaaaugaaccgaucaaaaagugaucagguaccauuaaacgacuauaccgaagaacgauucggaagcaaaaugcgaguucagugggaacaaaugcuacgcgcaggacuaaucaccaaaagaaaauaugauaacuuaacauuaaacccugacagaauaaguaaauacgcuaugaaaggguucauaaacagacaauuaguagaaacacgacaaguaaucaaacucgucacaaauuuacuaauggaucacuaugaagacgaugaggugcaacuaauaacuguaaaaaguggacuaauacaucaaaugagagaaauguucgacuucccuaaaaacaggaaccuaaauaaccaucaccaugcauucgaugcuuaccuaacugcauuuguaggaauuuaucuguuaaagagauacccaaaauuaacucccuucuuuguuuaugggucauaucagaaaaacaauacaaaugacaaauggagaaacuuuaauuucuugaaugaccuaaagaaagaagaaguaauagacagcgauucucaugaagucauuuggaauaaagcacaaggucuaguagaauuagacaaaauauaucaauucaagaaaauauuaguaacaagagaaguacacgaaaauaccggagcgcuuuauaaccaaacacuauauucagccaaagacgauaaagcauccggacaaggaggaaaacaacuuauaccggcuaaacaagacagacccacagcucuauacggaggauauuccgguaagacaguugcauauaugugcauaguaagaauuaaaucuaagaaagaagacacuuauaaaguauguggaguaaaaaccucaugggucgccgaacuagaacgauugucagacucaaacgagcaauuagcaucauuaaaagcuaaacuuaugccuaaauucacaaagaacaagaagcaaaaaggaaaaacaauucaaguuaccgaagacuucgagauaauaguaccaagaguucuaauaaaccaacgcuuuuaugauaacggucaagaaauaacacuagguagugcgaccuacaaacacaaugaacaagaguuaaugcucaacaagaaagcaguaaaauuauuaaauggccaauuaaguuuaguagaagcagaaacacucgcuccacaaguauacgaugaaauuuugaaacaaguaaugaaauauuucccucuuuacgauacaaaccaauucagaacaaaacuaaaaaugggaaaagaacaauucauaaaauuaccauggaagaauaaaugggauggcaauaaauuaauucauguuggacaacaaacaguacuagauagaauacuaauuggauuacacgccaaugccgcaguaucagaucuuaguacguugaaaguuacgacaccauucggcaaauuacaacaaccaucagguauugcucuuucccuuaauacuaaaaucauuuaccaaucaccaacgggccuauuugaaagaagaguagcgcugcgaggacucuga

SEQ ID NO: 5441 - RNA, 4110 nt, Artificial Sequence
  Cas9 variant
auggauaaacccuauaacauuggacucgacauaggaagccauuccauuggauggaccgucgucgaugauaacuccaagcuaguaagaauuaaaggaaaacucgguuacggcgucagacuuuuugacgaagguaaaacagcagaagaacgaagacaauuuagaaccacccgaagacgucugaaacgccgcaaauggcggcuacguuuacuacgagaaauauucgaaccacauaucgcacccuuagacgaaacauucuuucuucgccaaaaacaauccaaucuagugccaacucaaaagaaauuaccacaacuuucauuauucaaugacagaucagaugcagaguucuaccacaaauauccuaccaucuaucaucuaagaaaugcgcugaugacagaaaaacgacaauucgaccucagagaaaucuacuuagcuauucaucacaucguaaaauaucgaggacacuucuugaaugcagcacccgcugcaucauucaaauccggaaaauucgaucucgaaaacaaguuugaccaacucaaccuauuguucgcaagcgcauacagcgauuuagacuuuacauuacgaaccgauaacguagaucagguaaaagcaauacucuuaaacgaagaucugagugcuagcacccgacagcgacaagcguuacccuuaauuuaucaaaccuccgcagaccagaaagcugcuaagaaacuaacaaaaucacuagcuacugaauuauuaaaagcuauauuaggccuuaaagccaaauucgacguucuaacagggaucgaaaccgacgauaccaaagccuggagacucacauucaaugcagaagauuucgaugacaaguuaaacgaauuaaauguaaccgacaacgaagccgcgacacaaauaauagaaauuuuacgagagcuauauucuagcaucuuauuggcagcuauagugcccgaaaauuauacacuaucacaagcuaugauggcuaaauacaacgcacauaagcaacauuuaucacuccuaaggcaagucaaaacaacccuaccagcaaagaaacaaaaagaacuccaagccgcguacgacgacuacauugaccaacaccuaccauuagauaaauuuuacgcaaaacucacgaaagugcuacccaaagaaaaagacaccgacaauccucaaauaauacaaauccucaaccuaauagaucucgaucaauuuuuaccaaaacaacgaaccaaagauaauggagcgaucccacaucagcuccaccaacaagaacucgaucaaaucauagacaaccaaaaagcauauuaucccugguuagcucaauuaaauccaaacgagaaaagacagaaaauagcaaaauacaaauuagaugaauuaguagcauuucgaguaccguacuacguaggaccucuaauagaagcaaaaacucaacagaaaaccucaggugcaaacuuugcauggaugauuaggaaagaaccaggaacaaccacuccaauaacaccauggaauuucgacgaaaaaguaaaccggcaagccucagcaaaugaauuuauaaaaagaaugacuacaaccgacacauacuuguuaggugaagauguacuaccgaaacacagucuuuuauaccaaagguuugaaguacuaaaugaacugaacgguaucaaaauugaucaaaaacgaguuaccguuagacaaaaacaagccauauuuaacgaucucuuucuaaagcaaccuaauguaacagucaagaaauuacaacaauacuuacaagcaaaaggagaauaugcgucagccccuauaauaacaggauuaucugauccaaagaaauuuaacucucaauuaaguacauaucacgaauacaagaaaauauucggaggccucauagacgacccagauaaacaagcagacuucgaaaaaugcauagaauggaguaccaucuucgaagacucacaaauacugaaagacaaauuaaaagagauuaacugguuaacacccgaacagcgacacaaaguugccaacaaacguuaccagggcugggguagacuuucuaagaaacuacucacccaacuuguugauuacaacggacaaagaauaauagacauucuuuggaauacaacagauaauuuuaugcaaauagugcauucagaagcauuugacaaagcaauuauaaaagaaaaccaggcuuuacuaacacaauauaacccacaagcagucauugacgauuuauacaccuccccacaaaacaagaaagccuugagacaaauauuacuggucguaaacgacauccaaaaagcacuaaaaggacaagccccaagccgaaucuuaauagaguucgccagggaaggccaagaaaauccacggcucaguacucaaagaaaacaacaaguagaaaaugcuuauaaagaagcgagcgacgcacuauuauccagugccgaggugcgacaagaauuaaaaggucucgacaauaaagcacuagcaaauacacgauuauuccuauacuucaugcagggaggcagggauaucuauacugggaaaucauugaauaucgaugacuuaucaaaauaugacauagaccauauauuaccccaggcuuucauuaaagauaacucucuagauaacagaguacucguaucggcuaaaaugaauagaagcaaauccgaccaagucccauuaaacgauuuugccgagauaagauauggaaaacaaaugagacaacaaugggagaaaaugcuaagagcagggcuuauaaccaggaagaaauaccacaaucuaacauuaaauccggaaagcauuaauaaauacacagccaaaggauucaucaacagacaacucgucgaaacaagacaaguaaccaaacuagcaacaaaucuccuaguugaccaauaugcugaagaugacguacaacugauaaccguaaaaucaaaccuuacacaccaaaugagagaagaauuugauuuucccaaaaaccgaaacgucaacaaccaccaccaugccuucgacgccuaccucacagccuucgugggauuauauuuauuaaaaagauauccuaaacuagcacccuauuucguauacggagauuaccaaaaaggagcaucacaaaauuccaaauggcguaacuuuaauuuccuugguaaccuccaccgugagaaaguuguggacaaaaacacuggagaaauaauauggcaacgagacgcaggauuaggagaacuaaacagaauauacaauuuuaagaaaauacugguuacuagagcacucagagucaauagaggcccaauguucaaacaaacaauauauaaagccgaagaagauaagucaaguggucguggaucaaaacaacucauaccuacaaagaaaaauagaccuacagaacuauauggagguuauaccaacaaagaaacagcauauuuaugucuuguaaaagaaccucauaagaaaggagauauauauagaauuugcucaguucuuaacauguggcuaacagaauuagacagaaucgcagacccaauugcaaaagcacaaaaacuaacagagcucuuaacuccccaauuuaccacaacuaaaaagaaacaaggacagaaaauccccgucgucaaaccuuuuaaagucgucauucccaaaauacuaaucaaucaacgauucuucagcagaggccaagaacuaaccguagcgucaccaauguauaugcauaacgaacaagaacucuucuuaaacaagaaaaccauaaaauuacuaaacggacaauuagcgaaaaacgaagcccaugaauuagcaccuaaaauauaccaacaaaucuuagaccaaguaaacgacuacuuuccucuuuacgacauguauaaauucagagacacuuuaaacgcaaguaaagaaaucuuuguuaacuuaccauggcaggaucaacgccaagacaagaaaauuagccaaucaggccaaaaauccauccuaaauaaaauacuuauaggccuccacgcaaaugcagcccgaauaaaauuaacagaauuaaacuucaaaucggauuuugguuuauuaucccaacguagcggcauagcuuuuagcccagacgaccaaaucauauaucaaucccccacuggacuauucgaacggcgaguuacauuaaaagaccucuga

SEQ ID NO: 5442 - RNA, 4110 nt, Artificial Sequence
  Cas9 variant
augaaaguaaacaauuaccacaucggacuugauaucggaacauccaguauugguuggguggcuaugggugaagaugguaagccacuacguguaaaaggaaagacugccauaggcgcuagauuauuucgagaaggaaacccagcugcggacagaaggauguuuaggacaacgcgacgcagacuaaacaggagaaaauggagacucaaauuauuggacgaaauauucgacccauacauaaccccaguagauaguacauuuuuugcuagauuaaaacaauccaacuggucaccaaaagauagcagaaaagcauucaaagacucaacacuuuuucccgaccuaacagauaaacaauaucacuuagacuaccccacaaucuaucaucuucgacacgcuuuaaugacacaggacaagcaauuugacauaaggaugguuuaccucgcacuacaucacauaguuaaguacagagggaacuucuuaaauucaacaccgguugacucuuucaaggcaucaaaaguaaauuuugaugaccaauucaaaaaacuuaaugaacuauacaccgcaauaaauccagaagaauccuuccaaauaaacuuugcaaacucagaaaagauaggacaacaauuucuagauccgucaauacgaaaauuugacaaaaaaaaacaaaucucuaaaauaguaccuguuaccauggaugacaaagcuguagauaaacucaauggaaaaauagcuucagaaauaguaaacgcaauacugggauauaaaucaaaacuagauguugccguccagugcgauccagaggauucaaagccaugggcuguaaaauuugaugaugaagacauagaugcgaaauugcaaaaaauauuaccggaaauggaugaaaaccaacaaucaauuaucggcauaauacaagacuuauauagucaggucacauuaaaucaaauaguaccgaacggaaugagcuuaucagaaucaaugauaaaaaaauauaacgaccaccaugaccaccuaaaacuuuauaaaaaauuaaucggccaaauuucugacaguaaaaaaaaaacagcuuuaaaaaaagcauacgaucaauacgucgguaaugacgggaaaguaauagaacaggaugauuucuauucaagcguaaaaaagaaucuagaugacagcgaacuaucaaaacagauuauggaccuaauagaugccgauaaauuuaugccaaaacaacgaacaucacaaaaugggguaauuccacaucaacuacaccagcgggaauuagaugaaauaauagaacaccaaucuaaauacuauccauggcuagcagaguccaauccaaauaaacaugaucuucaccucgccaaauauaaaauagaagaacuaguagcauuuagaauaccauacuaugucgguccuaugauaaccccagaagaccaaaaaaaaaguggagcagcuguguuuucuuggaugaagagaaaagaaccgggucaaauuaccccuuggaauuucgaccaaaaaguugaucguauggaaucugcaaauaaauucauuaaaagaaugacaacaaaagacacauaucuaauaggagaagacguacuaccagaugaaagccuucuguacgaaaaauucaaagucuuaaaugaacuaaacaugguucgaguaaacggugauucacuuaaaguagcagauaaacaagccauauaucaagaccuuuucgaaaauuauaaacacaucagcguuaaaaaaaugcaaaacuauauuaaagauaaaacaggcuuaccaaauaacccagauaucuccggcuuauccgaccccgaucauuuuaauaacucacuaggaacuuauaacgacuucaaaaaacuuuucggcgauaaaguugaugacccggaucuacaagaugacuuugagaaaaucguugaauggucuaccguauuugaagacaaaaaaauuuuaagagccaaacuaaaugaaauaaguugguuaagcgacaaacaaaaagaugaucuagaaucaucaagauaucaacgcuggggaagauugucuaaaaaauuacuuaccggaauagugaaugaccaaggcgaacgaauaaucgaugaauuauggaauacaaacaaaaauuuuaugcaaauacaaucagaugacgacuucgccaaaagaauucaugaagcuaaugcggaccaaaugaaagcaacagauguggaagacguacuagcugacgccuauacaucaccacaaaauaaaaaagcuauaagacaaguuguaaaagugguagaugauauacaacgugccaugggaggcguagcaccaaaauuuaucucaauagaguucacuagaucggaagaucggaauccaagacgaaccaucucaagagaaaggcaacuggaagauacacuaaaagauacagcaaaaacacuaguaaaaucaaugaaccccgauauucuaagugaacuagauaacgcaucaaaaagcaagaaaggacuaacagauaggcucuacuuauacuuuacccaacuuggacgagauauguauaccggaaaaccaauuaacauugaugaaaucucuaacuaugauauagaucauauauuaccacaagcauuuauaaaagaugacucucuuaguaauagaguuuuaguauccaaagcagucaauaaugguaagucagccaacgugccuuuaaaacucuucgguguaaaaauggcacacuucuggaaacaacuggcagaagccggucugaucaacaagagaaaacuaaaaaaucuccaaaccaaccccgauacaauaucaaaauucgcuaugcauggguuuauaagaagacaacuaguagaaacuucacaagugauaaaauuaguagcuaacauuuuaggagauaaauaucgcaaugacgacaccaaaauuauagaaauuacagcaagaaugaaccaccagaugagagaugaguuugcauuuauaaaaaauagagaaauaaaugauuaccaucacgcauucgaugcauaccucacugccuuucuaggucgauaccuauaccauagauacauaaaacuaagacccuacuucguauacggcgauuucaaaaaauuucgagaagacaaaguaacaaugcgaaauuuuaacuuuuuacaugauuuaacagaugacacacaggcaagaauagcagacaccgaaacuggagaaguaaucugggaccgagaaaccucaauaaaacaacuaagagacguauaucauuacaaauucaugcuaauaucccaggaaguguacaccuugcgaggagcuauguucaaccaaacaauauacccugcagacgaagcuggcagaaaaaaguuaauaccaacaaaagcagauaaagcgguagauguauacggaggguacaguggaucaaacgaugcauacauggcuauaguacgcauacaugauaaaaaaggggacaaauacaagguagucggugucccaaugcgugcauuagacaggcuuaaugcagccaaaaacguauccgaugcaaaguaugaucaaguuuugaaggaugugcuaacaccgcaguucacaaaaaguaaaaagagcagaaagacaggcgaaaucagccaaacgguagaggacuuugaagugguccuugguaaagucauguaccgacaacuaguaauagacggcgacaaaaaauucauguuaggaucuagcacauaccaauacaaugccaaacaauuaguauuaucagaugaaucagucaaaacauuggcaucaaaagggaaacucgacgaagcucaagagucagcagcauacgauaauguauaugacgaaauauuagauaaagucgaccgauacuucgcguuguacgaccaaagaaauuacagaacaaacuuacaugaaggcgaacaaaaauucauaggacuaccguuacaugacaccuucgauggcaguaaaaaaguagcaaacgguaaaagagaaacaaucagcgauauccugaauggacuacaugcuaacgccaccaugacaaaucuaaaagugcucggcaucagcucaccauuuggaauguuucagucacacgguccaauaaaucuaaauccugaaacgaucauauuaugucaaagcccaaccggacuguuugagagacgaauaauacuucgagaccuauga

SEQ ID NO: 5443 - RNA, 4113 nt, Artificial Sequence
  Cas9 variant
augaaaaaaagaaauuacaacauaggccuagacaucgggaccagcucuauaggauggacuaucguggaugauaacgcacaaaucaugagagcaaaagguaaaaaugguuacggaguaagaauauucgcagaaggaaaaacagccgccgaccgucgaggauuuagaacaacaagaagacgacucaaacguaggaaauggaggcucagacuauugcaagaguuuuucgaaccuuauauauuacccauagacgaaaauuucuuuaugcgccaaaaagagucaaaccuugugccccaagauccaaacaaacauuuuaaaggauccauccuuuuuaaugaccgaacagaucaagaauuccacgaacaguacccgacaauauaucaucucagauacgcacucaugacagaacaccgucaauucgacguucgagaaauauacugggcaauucaucacauaguuaaauaccgaggccacuuuuuaaacucaacacuugcaaguaaauuuaaaggaggggaauuacgauuagcggauaaauuugaaucgcuaaauaaacuuuuccugagaguucaggcagaaacaggcuuugaauuaagcgaagauaacguagacaaaauaaaaacgguauuacuagacaacggaaaaucaaggcuagaccgacagagagaaguccucaaaauuguauauuugacaagugaagauaaagauacagaaaaaaaacgcaaagccgucgcgacugaauucauaaaagcaguccuaggacuaaagaccaaacuauucauaguccuagcaaaaaauccaacagcagaaacagauuggaaauucagcuuugacgcagaagacauugaugacaaacuagauaguauaucggaacaauuaacagacgacgaccacgaaaucguagaacugauaucugaaauacauuccauaauuacucuuacagguguaguacccgaggguaugggacuuucugagucuaugauagcuaaauaugaccaacaucaauuagauuuaaaaaaacuuaaaagucuaaugagagaucuagacgugaaacaagcaagaaaacuacaagacgccuaugacgaauauauagauggccuaaaaccaucugaagaagcauuuuauucugccguaucaaguguaauucaaaaaauggaugacccuagagcaaaaaaaauaacagcagaaauagaacuggaagaguucaugccgaaacaaagaaccaaagcuaauggacagauaccacaccagcuacaccaacaagaacuugaucaaaucauagagaaccagaaagaauauuacccuugguuagcagaagaaaauccuaacaaaagagaacauaaugcagcaccacacaagcucgacggucuagucacauuuagagugccauauuaugucggccccuuaaucgaagcaaguguacaacaaaaaaccagcaauagcaauuuugccuggauggaacguaaaguaaaaaaugacaccucccgaaucaccccguggaauuuugaagagaaaguagaucgaaaugcgagcgcagaaaacuucauaaaacgaaugacuaccaaagacaccuaucucuugaacgaagauguauuaccucaacaaucucuauuauaccaacgauacgagguccuuaaugagcuaaauaacguaaggguaaacgacaagaaguuagaaaacaauugcaaacaagacguauacaaagaccuauuuaaaaacaauacaacaguauccaucaaaaaauuuaaagacuaccucgucgccaacugcgaauaugccgauaacccaaaaauagaagguuuagcagacgaauccauauuccuaaguucccuaucuaccgaaaauaaauuuaaagacaucuucggugcacagaucgaugacccaaacuacuuugaagacuuugagcauauuaucgaaugggcaaccauauucgaagauaacaagauucuaagggccaaacuagacgaaaucaguuggcugaaugaaagucagaaaaaagaacuugcaaaguuacggaugagaggaugggguagauuaucacgcaaacucauugcugaaauaacagaugaaaauggcagucguauuauagaccuuuuaugggaacauauggacaacuuuaugguaguuguuaaccaagacguuuucaaagaaaaaaucguagcagaaaacaaacaaguuuuuaaggaauuaaauccacuagauauaauaaacgagcaauucacaucaccacagaacaaaaaagcucuuagacaaauucucuugguuguagcugauauucaaaaagcaaugaauggaguaacaccaagcaacauauucauugaauuugcucgagaagaugaaagaaacccaaggcguuccauacaacgacuaaggcagguugagaauauguacagagauaucucagacacaguccuagcggauccggaaguccgaaacgaauuaagcaacaucaaaaauacagaacuugcuagagacagagucuucuuguauuuucuccaaggaggcagagacguauauacuggcgaaccuuuaaacauagauaagcucuccgaauaugauaucgaccacaucuuaccacaagcguucauuaaagauaacucucucgacaacagaguucuuguaagugcaucgcuuaauaggucuaaaagugauaguguaccguuggaugacuuuacaucagaaauguuugguagaaaaauggaaccacucugggaacaaaugcaaagggcaggacuuaucuccaaaaaaaagcucgcaaauuuaaaauuuaaccccgaaaacauaaacaaauauacuagaaacggauuuauaaacagacaauuaguagaaacccgacaaguaauaaaacuagccgcgaauauuuuaaaagaucacuauggagaagaaaccgaaaucguuaacguuaaggcaggacugacacaucaauuucgcaaagauuuugacuuuccuaaaaacagaaacguuaacaacuaucaucaugcauuugaugcuuaccuaacggcccucguaggaacuuaccugcuuaaaaaauacccaaaauuagaaucauauuuuguauaugguaaauuuaaaaaaggagacggcaucacuaaucucaaaaacuuuaauuuccuccacggauuuaacaaaccaggcaaaauuaucaauaaagaaacgggcgaaauauuauucgacagagacaaacaacucggauacaugaauucaauauaugaccuaagaaaaguaaucguaacccacgaauuaagcacuagacauggcgcaauguaugaucaaacacuauauaaagcgucagaugacaaagacagcgguagaggcggaaaacaacucauuagaaaaaaagauaaccuaccaacagaaauuuauggaggcuauacagguucaacggacgcuuuuaugaguauaauacgcaugaaaaaaaaagauaaauuauacuauaaaguuauaggcguacccacccgaguagcacacgaaguguuacaaucagaugguaaaauuaacauauuuacacugaacaaauuuaucgaacaaaaauuaacaaaagaaaaagugaacaaaaaaacaggagcaauuacaagaauaacagauugguucgaauuggugauagcaaaaguuauguacggucaaguuauagacgacggcggccaaccguuuauguuaggcagcaguacauuaccguacaacguaagagaacuauacuuagcgaaagauuuaguaaaaguuauaaauaaaggaucuacaucuaaguccucauauuuagauguauaugaugagcuaguaaaaucauugaauaaauauuucccaauguacgaucgaaacauguuucggcaaaaaauaacagaugcacgcgacaaauuugaaaaacuacccaaacgcgacaaaguuagcaacggcaaauuacaacaaauaggacaagucacaauaaucgauaggauacucauuggauuacacacaaacgcuggaguaucaaacuuaaaagaucuagguauagcgacaccuuucgguuucaugcaacaaggaaaugguaucagccuaacgagcacagcuaaaaucauuuaucaaucauccacaggauuauucgaaaaaucaaaagcauuagacgauuuaaauccgcucgccuga

SEQ ID NO: 5444 - RNA, 4113 nt, Artificial Sequence
  Cas9 variant
augaauaaacccuauaguauuggacuagauaucgguaccaauagcgucgguuggagcauaauaaccgaugauuacaaaguaccagcuaaaaaaaugagaguuuuaggaaauacagauaaagaauacauuaaaaaaaaccuaauaggagcacucuuauucgaugggggaaacacugcagcagaccggagauuaaaaagaaccgcaagaaggagauacacaaggaggcgaaauaggauucuuuauuugcaagaaaucuucgccgaagagaugaguaaaguagaugauaguuucuuccacagacuagaagauucauuucucgucgaagaggacaagagagguucaaaauaccccauauuugcaacuaugcaagaagagaaauacuaucaugaaaaauuccccacaaucuaucauuuaaggaaagaauuagccgauaaaaaagagaaagcagacuuacgucuaauauaucucgcauuagcacauaucaucaaauuuagaggacauuuccuaauagaagacgauagguuugacguacgaaauacagacauacaaaaacaauaucaagcauuucuugaaauauucgauacaacauucgaaaauaaugaccuccuaagucaaaauguggacguagaagcgaucuuaacugacaagauaaguaaaagcgcaaaaaaagacagaauacucgcaagauauccaaaucaaaaauccaccggcaucuuugccgaauuucuaaaacucauagucggcaaucaagccgacuucaaaaaacacuucaaucuugaagauaagacgccucuacaauucgcaaaagauuccuacgacgaagauuuagagaacuuauuaggacagauaggagaugaauuugcugacuuguuuucggcagccaaaaagcucuacgacucaguauuacuaucaggaauacuuacagucacagaucuaaguacaaaagcaccauuaagugcuagcaugauacagagauaugacgaacaccgagaagaccuaaaacagcuaaaacaauuuguaaaagcgagucuaccagaaaaauaccaagaaauauucgcagacucaucaaaggauggauaugccggauauauagaagguaaaaccaaucaagaagcauucuacaaguaucuuucaaaacuacucaccaaacaagaaggauccgaauacuuacucgaaaaaauaaaaaaugaagauuuucugcgcaaacaaagaacguuugacaacggcuccauuccccaucaaguccacuugacagaauugagggcaaucauucgaagacaaucggaauacuauccauuuuuaaaagaaaaccuagacaggaucgaaaaaaucuuaacauuccgaauuccauauuauguugguccccuagcaagagaaaaaucugacuucgcuuggaugaccagaaaaacagaugacucaauuagaccguggaauuuugaagauuugguagacaaagagaaaucagccgaagccuuuauacaucgcaugacaaacaaugauuuguacuuaccagaggaaaaaguccuucccaaacauucacugauauacgaaaaauucacaguauauaacgaguuaacaaaaguaagauuccuagccgaaggcuucaaagacuuccaauucuuaaauagaaaacaaaaagaaacaauauuuaauucacucuucaaagagaaacgaaaagugacagaaaaagauauaauaagcuuucuaaauaaaguugacggauaugaaggcaucgcuaucaaagguauagaaaaacaauuuaaugccucauuaagcacauaccacgauuuaaagaaaauucuaggaaaagauuucuuagacaauacugauaaugaacuaauauuagaagauauaguacaaacccugacauuauuugaagaccgcgaaaugauacgcaaacguuuagauauauauaaagacuuuuucacugaaucccaauuaaaaaaacuauacagaaggcauuacaccgguuggggaagacugucagcaaaacucauaaauggaauccgaaacaaagaaaaucaaaaaaccauacucgauuaccugauagaugacggaucagcaaacaggaacuucaugcaacuuauaaaagacgccggccuaucuuucaaaccuauaaucgacaaggcuagaacaggaagucacucagauaacuuaaaggaaguaguaggagaacuagcaggaucacccgcaauaaagaaaggcauauuacaguccuugaaaauaguugacgaacuuguaaaaguuaugggauaugaacccgaacaaauugugguggaaauggcacgggaaaaccaaacaaccgcuaaaggacuaaguagacuuagacaacguuuaacaacccuaagagaaagucuagcgaaucuuaaaucaaauauccuagaggaaaaaaaaccuaaguacguaaaagaucaaguugaaaaccaucacuuaucggacgaccgacucuuuuuauacuaucuacagaacggcaaagauauguacaccgaugacgagcuugacauugacaaucugucacaauacgacaucgaucucauaauuccacaagcauuuaucaaagacgacucaauugacaaccgaguccugguguccucagcgaaaaacagaggaaaaagcgaugacguacccucaguagaaauaguaaaagacuguaaaguauuuuggaagaagcuccuagaugcuaaguugaugagucaaagaaaauacgacaaucucacuaaagcagaacguggaggccuuacauccgacgacaaagcacgauuuauacaaagacaauugguggaaacacgacagauaacuaaacauguagcuaggauacuagacgaacgauuuaacaaugaacucgauaguaaggguagacgaauacgaaaagucaaaauaguaacacuaaaaucaaaccuaguaaguaauuucagaaaagaauucggcuucuacaaaauucgugagguaaauaacuaccaccacgcucaugaugccuaccuaaacgccguuguugcaaaagcaauacuaacaaaauacccccaacuggaaccugaauuuguuuacggcgauuacccuaaauauaauagcuacaagacaagaaaaagcgccacagaaaaacuguucuucuauagcaacauaaugaauuucuuuaaaaccaaggucacccuagcagauggaaccguuguaguaaaagacgacaucgagguaaauaacgauacaggugaaauaguaugggacaaaaaaaaacacuucgcuacuguaaggaaaguauuaaguuauccccaaguaaacauaguaaaaaaaacagaaauacaaacaggaggcuucagcaaagaaagcauauuagcacaugguaacucagauaaauuaauaccacgaaaaaccaaagacauauaccuagacccaaaaaaguauggaggcuuugauuccccaauaguggcauauaguguuuuagucguugcugauauuaaaaaagguaaagcccaaaaauuaaaaacaguaacagaacuacuagggaucacaaucauggaacgaucaagauucgaaaaaaaccccucugccuuccucgaaaguaaaggcuaccuaaauauaagagaugacaaacucaugauacuuccgaaauauucacuguucgaauuagaaaauggucggagaagacucuuagccucugcagaugaauuacaaaaaggaaaugaauuagcucucccaacacaauuuaugaaauucuuauacuuagcuagucgcuacaaugaauuaaaaggaaaaccugaagaaauagaacaaaaacaagaauuuguaguacaacauguaucuuauuucgaugacauucuacagaucauaaacgacuuuuccaauagggugauauuagccgacgccaacuuggagaaaauuaauaaacuauaccaagacaauaaagagaacauaccugucgaugaacucgcaaacaacauuauaaaucuauucacauuuacaagccuaggagcacccgcagccuucaaauucuucgauaaaauaguagaccguaaacgauacacaucaacaaaagaaguacuaaacuccacucugauacaccaauccauuacaggacuauaugaaacgaggauagacuuagguaaacuaggcgaagacuga

SEQ ID NO: 5445 - RNA, 4113 nt, Artificial Sequence
  Cas9 variant
augacuaagaaaaauuacucaauuggacucgacaucgguacaaacaguguuggcugggcagucaucacagaugacuacaaaguuccugcaaagaaaaugaaaguacuaggaaauacagauaagaaauauauaaagaaaaauuuauuaggagccuuacuguuugauucaggagaaacugcugaagcaacaagacuaaaaagaacagcaagaagaagauacaccagaaggaaaaacagacuaagauaucuacaagaaauauucgcagaagaaaugacaaaagucgacgaaucauucuucuacagauuagacgaaaguuucuuaaccaccgaugaaaaagacuucgaaagacaccccauuuuuggaaauaaagcagaggaagacgcguaccaucaaaaauuucccacaauauaccauuuaaggaauuacuuagcggacuccagcgaaaaagcagaucuaagauuaguauaucucgcacuagcacacaugaucaaauacagaggacauuucuuaaucgaagguaaacuaaacgccgaaaauacagauguacaaaaacuauuuacagauuuuguggguguauacgaccgaaccuuugacgacucacauuuaagugaaaucacaguagauguugcuucuacgcucacagagaaaauaucaaaaaguagacgacuagaaaaccucaucaaauauuacccaacugaaaagaaaaauacuuuauuuggaaaucuaaucgcacuggcauuaggauuacagccaaauuucaaaaugaauuuuaaacucucagaagacgcuaaacuacaauuuucgaaagacacuuacgaagaagaucuagaagaacuucucgguaaaaucggagaugauuaugcggaucuauuuacaucagcuaagaaucuuuaugaugcaauacuuuugagugggauucugacaguagaugacaacaguacuaaagcuccauuaagcgcaucuaugaucaaaagauacguagaacaucacgaagaccuagaaaaauuaaaagaauuuauaaaagcgaauaaaucugaacuauaccacgauauauuuaaagacaaaaauaagaauggauacgcaggauauauagaaaacggaguuaagcaagaugaauuuuacaaauacuuaaagaauacauugagcaaaauagauggaucggacuauuucuuagauaaaauagaacgagaagacuuucuaaggaaacaacggacuuuugacaauggaucaauaccucaucaaauucauuuacaggaaaugcaugcgaucuuaagacgacaaggagauuauuaucccuuccuuaaagaaaaacaagaccgaauagaaaagauauuaaccuuuaggauacccuacuauguaggaccauuagucagaaaagauagcagauucgcuugggcagaauauagauccgacgaaaagauaacucccuggaauuucgacaaagucauagauaaagagaaaagugcagaaaaauuuauaacaaggaugacacuaaacgaccuauaccugcccgaagagaaaguauugccaaaacacucucacguauaugaaacuuacgccgucuauaaugaguuaacaaaaauaaaauaugugaaugaacaagggaaagagaguuucuucgacucaaauaugaaacaggaaauauucgaccauguguucaaagaaaaccgaaaaguuaccaaagaaaaauuacuuaacuaucuaaacaaagaguucccagaauauagaaucaaagaccuuaucggcuuagauaaagaaaauaaaucauucaacgcaagucucggaaccuaucacgaccuaaagaaaauauuagauaaggcuuuccuugaugacaaaguuaacgaagaagucauugaagacauuauaaaaacauuaaccuuauuugaagauaaagacaugauacacgaaagacuacaaaaauauucugacauauucacggccaaucaacuaaagaaauuagaaagacgucacuacaccggcugggggagacucagcuacaaacucauuaacggaauacgaaacaaagaaaauaauaaaaccauauuagacuaucuaaucgacgauggcagcgcaaaccguaauuuuaugcaacucaucaaugaugacacccuaccauuuaaacaaaucauacaaaaaucucaaguaguaggagacguagaugacauugaagccguaguacacgaccuuccaggaagcccugcaauuaagaaaggaauacuacaaucaguaaaaaucguagacgagcuaguuaaaguaaugggggauaaccccgacaauauaguaauagaaauggcuagagaaaaucaaacuacaaacagaggcagaucacaaagucaacaaagacuaaagaaacuacaaagcaguuuaaaagaauuagguagcaacauauugaacgaagaaaaacccaguuacaucgaagacaaaguagaaaacagucaucugcaaaacgaccaguuguuucuauacuauauacaaaauggaaaagauauguacacgggagaugaacuagacauugaccaccuguccgacuacgauauagaucacauaauuccacaagcauucauaaaagaugauaguauagauaaccgaguccucacaucauccgcgaaaaacagaggaaaaucagaugacguuccuucauuagauauaguaagagcaagaaaggcagaauggguucgccuauauaaaagcggauuaauaucaaaacguaaauucgacaaccuuacgaaggcagagagaggagguuuaacugaagccgacaaggccggauuuauuaaaagacaauuaguagagacaagacaaauaacgaagcauguagcacaaauucuagaugcacgauuuaacacugaacacgacgaaaacgauaaagucauaagggauguaaaagucauaacacuuaaaucuaauuuaguaagccaauuucgaaaagacuuugaguucuauaaaguaagagagauaaacgauuaucaccacgcacacgaugcauauuuaaacgcaguugucgggacagcguuacugaaaaaguacccaaaacuagcaucagaguucguuuauggagaauacaaaaaguaugacauacguaaguuuauaaccaauucuuccgacaaagcaaccgcaaaauacuucuuuuacuccaaccuaaugaacuucuucaaaaccaaagucaaauacgcagacggaacaguauucgaaagaccgauuauugaaacaaaugccgauggagaaaucgcauggaacaaacaaauagauuucgaaaaaguucgcaaaguacucaguuacccucaagugaauauagugaaaaagguagaaacacaaacaggcggauucucaaaagaaucaauuuuacccaagggugauucagacaaacuaauaccaagaaaaacaaagaaaguuuacugggauacaaagaaauauggaggauucgauagccccacuguugcuuauucaguauuuguaguugcggauguagaaaaagggaaagcaaagaaauuaaaaacuguaaaagagcuaguagggauaucaauaauggaacguucauucuuugaagaaaauccgguagaauuuuuagaaaauaaaggcuaucacaauaucagagaagauaaacuuauaaaauuaccuaaauacucgcuauuugaguucgaagguggacgacgacgacuguuagccuccgcaagugaacuacaaaaagguaaugaaaugguacuaccaggcuaucuugucgaacuauuauaucacgcacacagagcagacaauuucaacagcacagaauaccuaaacuacgugucagaacacaagaaagaauuugaaaaaguacuaagcuguguagaagauuucgcaaaccuauacgucgacguugagaaaaaccuaagcaaaauucgugcaguugcagauagcauggauaauuucucaauugaagaaauuuccaacagcuucauuaaccuccucaccuuaaccgcucuaggagccccugccgacuucaacuucuuaggugagaaaauaccaagaaaacgauauacaucuacuaaagaaugccugaccgcaacauuaauccaucaaucaauuacagggcuauacgaaacaaggaucgaccuaucaaaacuuggagaagaauga

SEQ ID NO: 5446 - RNA, 4113 nt, Artificial Sequence
  Cas9 variant
augaaaaacgcaaauaaaguaacagguaaguacuauuuaggauucgauauagggacaaacucaguaggaugggcuguuaccgaugagaauuacaaucuauguaaauucaaaaaaaaaagcauguggggaauaagauuauuugaagaugcaaaaacagcugaagaaaggagaggacaacgagcauccagaagaagauuacaacgcagaaaacaacguauagauuuacuucaagaaauuuuugcugaagaaauaaauaaaguagacgagacguucuuuauacgacuaaaugaaucuagauuacacuuagaugauaaaaccguaucagaaaaacacccacuauuuauaggcucagaauacagcgaaaaggaauacuauagagaguacccaacaauauuccaucuaagaaaagagcuaauggagaguuccgaaccgcacgauauaagacuuguauacuuagcaauccaucacauacuaaaaaauagaggucacuuuuugauugauggagaguugaguaaggccaauaguuucgaugcagcuuuuuaucaaaugaaggagguacuaugcaaugaauuagauuuagaaauagacggcgaaaacacaaccgaggucgagcgaacuuuacgagauagaaauauaaguaaaucugauaaaguuaaauuauuagccgcuuuauuagcgaugaaucaaaacgaaacagaaucaaaagaaacgaaaaaaaaaauagaaaauauauguaaauuauuagccggaaacaaaggagauauaucaaaaauauuugggcaaacaccagaagggguugagaaaacauccuuuucauucggagaagcagauuaugaugaaucgauaagaccaaaccuagaagaguccauccccgaccaauguuucguaauagauagcauaaaagcucuguacgacuggaacguauuagcugauauacuaaauggucaaacguacuuaaguugcgcuaaaguuaaucaauacgaaacacacaaaaauaauuuaaaagaauuaaagcuacuaguaaaccgcuacugcucaagagaagaauacaaaagguuuuuuaaaagcgcaguagagaaagcaaauuauaguaacuauauaggaucugcuaaacagggaaacaaaauaauagauguaaaaaggugugcagaagaagauuuuuauaaagaacuuaaaauacuauuaucaaagauagaaccggaagaagcugauagagaauuauaugaaagaauaaaacgagaggccgaagaagguuccuuacuuccacugcaaaggaauaaagauaauagugugguaccaaaccaaaugcacaaagcagaacuagcccuaauacuugaaaacgcgggaucuuauuuaggauuccugaacgaaaaagacgaagauggauuaagcccagcagaaaaaauaauugaauuauuuagcuucagaauaccauacuacguagguccacuuucagacagacacaaagaccggggaaguaacgccuggauagugagaaaggcagaaggacguauccucccguggaacuuugacgaaaaaguagauagagaaaaaaguaaugaagcuuucaucgaaagaaugaccaacaaaugcacauaucuauuaggcaaagauguaguugcaaaaaauucacuaauauauagucacuucaugguauugaaugaacuaaacaauuuaaguguauguggaaacaaaauauccgugcaaguaaagcaagacauauaccgcgagcucuuccaacgucacacaaaaguaucaaaaaagaugcuauugcaauauugucgcgaaaaaaugaugaacaaagauuuagaggaagaagaucuuucuggguuugacggagauuucaaagcuaaauuaucaagcuaccuagacuuugaaaaaaaaguauuuggagcaaaaauggaggaagacaggauacggaaaauaacagaagauauuauaagauggaaaacgauuuacggugacgauggaaagaugcuacaagcaguuguagagaaggaauacccaggggaacuggacagugaccaacucaaagcaguaaaacaauuucguuacagcggauggggaaauuuuucagaagaauuuuuaaacgguaucguaggaacugaaaaaccgacaggacagauguuuacaaucauugaagcauuauggcagacuaauuguaacuuaaugcaauuacuaaguaaaaacuucaccuuuauggaggaaauagaaaaacauaaccgagaacuagcaggccaaauaaccgacauaucuuaugacaaauuagugaaggaccuauacauaagcccagcuaauaaacgagcaguauggcaaacagugcgaauagcggaagaaguuaaaaaaauaaugggcugugaaccugcaaaaauauuuguagagauggcaagaggaggggaaaaagaaaaaaaacguacgauaucuagaaaaaaaaaauuguuagaauuauacgcagccuguaaaaaagaugcacgagacuggaaccgagaaauagaagacagagacgaaagagaauuuaauucagacaaacuauaccuuuauuauacacagauggggagauguauguauucaggugaaagaaucgauuugcaugaacuaaugagugcgaauucaaagugggauauagaucauauauacccacaaucaaaaguaaaagaugauucucuggacaacagaguuuuaagccuuaagaaaauuaauaaugaaaaaggaaauaaaccauuaucuagagauauucaacagucacagcaaaagugguggacagagcuauuacaacuagaauucauuacgaaaaaaaaauaugaucgacuaaugcaccgaggugagcuaagcgaagaagaauuauccggauuuauaaaucgccaacugguugaaacacgucaaucaacaaaggcugcagcagaauuauuaggaagaauguauaauaacagcaaaguugucuacgugaaagcuccacuaguaucacaguuccgaaaggaugaccuaaauauacugaagucacgauuagcuaacgacuaccaccaugcaaaagaugcauaucuaaauauagcugucggcaaugucuauaaugaaaaauucacagacaauccacuaagauggauagaaaaacacgcuggagaaaacuacuccauaaacaggguguucgacuaugacauaguagcaggcgauggugccccgguaugggcagcaccacuaagagacgagaaaaauaaacugaggaagaaugagguaggcgaaaaauacgguggaacaauagacguaaucagaaaaaccguaaaaaggaaugauguacuauacacagagcauacauauuguggaaagggagagcuauuuaaugcaacgauugcgaaaaaagauggaggggccgaaaucccacugaaagcaggacuacaaacugguaaauacggaggguacaaaaguccgaacacgagcuauuuugcagcuauugaauucgacggaaagaaaggcgaaagaguuaaaaauauaauggaaguaccuguauacauagcgaacauucuguuacacgacauagaugcauauauaagauacugcgaaacaguaaaagguuuaaaaaacguaaaaauauuacggccauguaucaaaaagaacgcgcugauaagcguagauggcuacccaaugaggauacguggagcgaacgaaaaaaauauacuacuuaaaaauaacuuacaaccaauauuuggacgucacgaggaaacugugagaaggauagaaaaauauguagaaaaaaaccaagaauuugaagucgacgaaaaauuugauggauuaaaugaagcaaauuugacagauuuguacgacgacauaacagaaaaauuaugugggcccuauguggagcguccuaguaaccaaggggaguaucucauggaaaauagggaaaaauuccucaauauuucacuaaaagaaaaagccaagcuucuugcacaaaugauaaagcuagucagaugugauacagaaacaaaagcagaucugagaucaauaggugcuucuaagaaugccggaguaaucaguguaaauaagaacacauuagggggaaaaagacucauauuaauaaaucaaagcguaacaggauuguucgaaaacagaauugaacuguga

SEQ ID NO: 5447 - RNA, 4113 nt, Artificial Sequence
  Cas9 variant
augaacaaaccauacaguauaggauuagauaucggaaccaacaguguaggaugguccaucauaaccgacgacuacaaaguaccagcuaagaaaaugagaguacuaggaaauaccgauaaagaauauauaaagaaaaacuuaauuggcgcacucuuauuugacggaggaaacacagcagcagacagacgucuuaaaagaacagcccguagaagauacacaagaagacgcaauaggauucuauaucugcaagagauuuucgcugaagaaaugagcaaaguagacgacucauuuuuccaccgacuugaagacucauuccuaguagaagaagacaaacgaggcucuaaauauccaaucuuugcaaccaugcaagaagaaaaauauuaucacgagaaauuuccaacaauauaucaucuuagaaaagaacucgcugacaagaaagaaaaagcagaucuacgacugauuuacuuagccuuagcucacauaauuaaauucagaggacauuuccuaauagaagaugacagauucgauguaagaaacaccgauauacaaaaacaauaccaagcauuucucgaaauauuugacacaacguucgaaaauaaugaucuauuaucgcaaaauguagauguugaagccauucugacggauaaaauaucuaaaagcgcaaagaaagaccgaauacuagcaagauauccaaaccaaaaaucuacuggaauauucgcagaauuucuaaaauuaauaguggggaaccaagcagauuuuaagaaacacuuuaaucuugaggacaaaacaccacuacaauuugcuaaagacuccuacgaugaagaccuugaaaauuuauuaggccaaauaggugacgaauuugcagaucuauuuucggcagccaagaaacuauaugacucaguucuccuaucuggaauacuaacaguuacagacuuaucuacuaaagcaccauuaucugcaaguaugauacaaagguaugaugaacacagagaagaucugaaacaauuaaaacaauuuguaaaggcuucccucccggaaaaauaccaagaaaucuucgcagauucuucuaaagauggauacgcagguuauaucgaaggcaaaacaaaucaagaggcuuucuacaaauaucuaucgaaauuacuaacaaaacaagagggaagugaauacuuacuagagaaaauuaaaaacgaagacuuuuuacgaaaacaaaggacauuugauaaugguagcauaccacaccaaguacacuuaacggaacuacgagcaauaauaagaagacaaucagaauacuauccauuccuaaaagaaaaucuagauagaauugagaaaaucuuaacauucagaauaccguacuacguaggaccauuagcaagagaaaaaucagauuucgcauggaugacgcgaaaaacagaugacagcauaagacccuggaauuucgaagauuugguagacaaagagaaaagcgccgaagccuuuauucacagaaugacaaauaacgaccuauaccucccagaagaaaaaguacuaccaaaacacagccuaauauaugaaaaauucacaguauacaaugaacugacaaaaguacgauucuuagccgaagguuuuaaagauuuucaauuuuuaaaccgaaaacaaaaagagacgauuuucaauaguuuauucaaagagaaaaggaaagucacagaaaaagauauaaucucauuucuaaacaaaguagacggauacgaaggaaucgccaucaaaggaauugaaaaacaauucaaugccucauuaucaacauaccaugaccuuaagaaaauacuaggcaaagauuucuuagacaauacugauaacgaacucauacuagaagacauaguacaaaccuuaacccuuuuugaagacagggaaaugauacgaaaacgcuuagauaucuacaaagacuuuuucacugaaagucaacucaagaaacuauaccgucgucauuacacuggcugggggcgucuaucagcuaaacuaauaaauggaauaagaaacaaagaaaaucaaaagaccauacuagauuaucuaauagaugacggaucagcuaaccggaacuucaugcaacuaauaaaagaugcuggccuaucauuuaaaccaaucaucgauaaagcuagaaccggcagccacucugauaaccuaaaagaaguuguuggggaacuugcaggaaguccagcuauaaagaaaggaauauuacagagcuuaaaaauaguagaugaguuaguaaaaguuauggguuacgagccagaacaaauaguaguugaaauggccagggaaaaucaaacgacagccaaaggacuaucucgaucgaggcaaagacucacgacauugcgagaaagucuugcaaacuuaaaaagcaacaucuuagaggaaaagaaaccgaaauacguaaaagaccaaguagaaaaucaucacuuaucagaugaccgccucuucuuauacuaccuacaaaaugguaaagacauguauacagaugacgaauuagacauugacaaccuaucucaauacgacauugaccauauaaucccacaagcauucaucaaagaugauaguaucgauaaucgaguccugguaucaagugccaaaaaucgcgggaaaucagacgacguacccagcgucgaaauugucaaagauuguaaggucuucuggaagaaacuacucgaugcaaaacuuaugagucaaagaaaauaugacaaccucaccaaagcagagagaggcgggcucaccucagacgacaaagcaagguuuauacaaaggcaacugguagaaaccagacaaauaaccaaacacguugcuagaauauuagacgaacgauuuaauaaugaacuagauagcaaagguaggaggauucguaaaguaaaaaucguaacacugaaaagcaacuuaguaaguaauuuuagaaaagaauuugguuuuuauaaaauaagagaaguuaauaacuaucaucaugcacacgaugccuauuugaaugcuguaguggcuaaagcaauauuaaccaaguauccacaacucgaaccagaauuuguuuacggcgauuaccccaaauauaauagcuacaaaacuaggaaaagcgcaacugaaaaacuauucuucuauucaaacauaaugaauuucuuuaaaacaaaaguaacccuagcagacggcacagucguaguaaaggaugacauugagguaaacaacgauacuggagaaauagucugggauaaaaagaaacauuucgccacuguacgaaaaguacucaguuacccacaaguaaacauaguaaagaaaacggagauacagaccggaggauuuaguaaagaaaguauauuagcccauggcaauucugacaaacuuauccccagaaaaacaaaagacauauacuuagacccuaagaaauaugguggauucgacagcccaaucguagcauacucagugcuuguaguagccgacauuaagaaaggaaaagcacaaaaacuaaaaacagucacagaacuccuaggaauaaccauuauggaacgaaguagauuugagaaaaauccaucagcauuuuuagaaagcaaaggauacuuaaacauacgcgacgacaaacugaugauauugccgaaauacucccuauuugaacucgaaaacggcagaagaagacucuuagcaagugccggagaacuacaaaaagguaacgaacuagcuuuaccaacccaauuuaugaaauuucuauaucuagcuaguagauacaacgaguuaaaaggcaaaccagaagaaauagagcaaaaacaggaguucgucguucaacauguaucauauuucgacgacauuuuacaaauaauaaacgauuucucaaauagaguaauacuugccgacgcaaaccucgagaaaauaaauaaacuauaccaagauaauaaagaaaacauaccuguggacgaacuugccaauaacauaauaaauuuauucacuuuuacgucauuaggcgcuccagcggcuuucaaauucuucgauaaaauugucgaccgaaaaagauacacaagcacuaaagaaguacuaaacaguacuuugauacaucaaucuauaacaggacuuuacgaaacaaggauagaccuagguaaguuaggugaagacuga

SEQ ID NO: 5448 - RNA, 4113 nt, Artificial Sequence
  Cas9 variant
augacaaaaauaaaagacgauuauauuguugguuuagauaucgguacugauucauguggauggguagcaaugaacucaaauaacgauauauuaaaauuacaaggcaaaacagcuauugguucuagacuauuugaaggagguaaaucggcugcagaaagacgacuauuuagaacuacccacagaagaaucaaaaggagaagauggcgguuaaaauuacuggaagaauuuuucgacccuuacauggcagaaguagauccuuacuucuuugcgcgacuaaaagaaagcgggcugaguccauuagauaaaagaaaaaccgucucuucaauaguauucccuacaagugcagaagacaagaaauuuuacgacgacuaccccacuauauaccaucuucgauacaaauuaaugacagaagacgaaaaauucgaucuaagagaagucuauuuagcgauacaccauauaauaaaauaucgcgguaauuuucucuacaauacaucagucaaagauuuuaaagcaaguaaaaucgacguuaaaucaucuaucgaaaaacuaaaugaacuauaugaaaauuugggauuagaccuuaacguagaauuuaauauauccaacaccgcagaaauagaaaaaguacugaaagauaaacaaauauucaaacgagacaaagucaagaaaauagcagaacuauuugcuauuaaaacagacaacaaagaacaauccaaaagaauaaaagacaucucgaaacagguagcuaaugcuguuuugggauacaaaacaagauuugacaccauagcacuuaaagaaauuucgaaagacgaacuaagugacuggaauuuuaaauuaucggauauagacgcugauagcaaauuugaagcauuaaugggaaaucuagacgaaaaugaacaagcgaucuuacuaaccauaaaagaacuauuuaacgaaguaacuuuaaauggaauaguugaagacggaaacacgcuaucagaaucaaugauaaauaaauauaacgaccaccgagaugaucuuaaacuccuaaaagaaguuauagaaaaccauauugauaggaagaaagcgaaagaacuugcacuggccuaugaccuuuauguuaacaauagacacgggagacuuuuacaagccaaaaagaaacucggaaaaauaaaaccacguagcaaagaagacuucuacaaaguaguaaacaaaaaccuagaugauagccgagcgucuaaagaaaucaaaaagaaaauagaauuagauuccuuuaugccaaaacaaagaaccaacgcuaacggaguaauaccauaccaauuacaacaacuagaacucgacaaaauuauagaaaaucaaagcaaauacuacccauuccugaaagaaaucaacccuguaucuucacaucuuaaagaagccccguauaaauuagaugaacuuauaagauucagaguuccuuacuacguaggaccauuaauuagcccuaacgaaucaacuaaagacauacaaacuaagaaaaaucaaaacuuugcauggaugauaagaaaagaagaaggaagaauaacucccuggaacuucgaucaaaaaguugaccgaauagaaagugcuaauaaauucauaaaaagaaugacgacaaaagacacauacuuauuuggagaagacguauuacccgcaaacucauuacuauaccaaaaauucacaguauuaaaugaacuaaacaacauacgaauaaauggcaaaagaauaucaguagacuugaaacaagaaauauacgaaaaucuauucaagaaacauacaacuguaacagugaagaaauuagaaaacuauuuaaaagagaaucacaacuuaguaaaaguagaaaucaaaggauuagcagacgagaagaaauucaauagcggucuuacaacauauaauagauuuaaaaaccuaaauaucuuugauaaucaaauugacgaccucaaauaucgaaacgacuuugagaaaauaaucgaauggaguacaauuuuugaggauaaaucuauauauaaagaaaaauuaagaagcauagauuggcuuaaugaaaaacaaauuaacgcguuaucuaauauccgacuacaaggguggggacgacuaagcaagaaacuucuagcacaacuacaugaccacaacggccaaacaauaauagaacaauuaugggacagccaaaauaacuucaugcaaauagucacgcaagcggacuucaaagacgcaauugccaaagcaaaccaaaauuugcucguagccacgucaguggaagacauacuaaauaacgcuuacacaucaccagccaacaagaaagcaaucaggcaggucauaaaaguagucgacgacauaguaaaagcagcuucgggcaaagucccgaaacaaauagcaauagaauuuacuagagacgcggaugagaacccgaaaagaucccaaacaagagguucaaaacuacaaaaagucuacaaagaucucagcacagaauuagcaucuaaaacuauagcagaagaacuaaaugaagcaauaaaagauaagaaacucguacaagauaaauauuaccucuacuucaugcaauuaggaagagacgcuuauacaggagagccaauaaauauagacgaaauacaaaaauaugacauagaucacauacugccucaaucuuucauaaaagacgaugcgcuagacaauagaguauuaguaagccgagcugucaauaacgggaaaucagauaauguacccgugaaacuauuuggaaaugagauggcugcaaauuuaggaaugacaauacgaaaaaugugggaagaauggaaaaacauuggacuuauuagcaaaacgaaauacaacaauuugcuaacagauccagaucacauaaauaaauacaaaagugcaggauuuauuagacgccaacuuguagaaaccucacagauuauuaaacugguauccaccauucuacaaucuagauaucccaacacugaaauuauuacuguuaaagccaaauacaaucacuaccuaagagaaaaauucgacuuguauaaaucccgcgaaguaaacgacuaccaucaugcaauagacgcuuaccuuagcgcaaucugcggaaaucuauuguaccagaacuacccuaaucuacgaccauuuuucguuuauggucaauacaagaaauuuuccagcgaccccgacaaagaaaaagaaauauuuaacaaaacaagaaaauuuucauucaucagccaaauucugaaaaacaaaagugagaacucaaaagaaauugccgaaaaacuaaaaagagcguaccaauucaaauacaugcucguaucacgagaaaccgaaacaaaagaccaagaaauguuuaaaaugacaguauuuccgagggaaacgccugguaaucuaauacccaagaagaaaggaauggcaccagaaaucuauggcgguuacacuaaaaauucagaugccuauaugguaaucgugaaaauagacaagaagaaagaaacagaauaccgcauccucggaauaccuacaagagagcuaguaaaccucaagaaagcagaaaaagaagaccauuaugaaucauauuuaaaggaaaucuuagcaccuaggauucuguacaauaaaaauggaaaacgagauaaaaagauaacaucauucgaaauaguaaaaucaaaaaucccauacaagcaaguuauacaagacggugacaagaaauuuaugcugggaucaucaacuuacgucuacaaugcuaaacaauuaacacuuucaaccgaaucaaugaaagcaauaacaaauaauuuugauaaagauagugaugaaaacgacgcacuaauuaaagcauacgacgagaucuuagauaagguagacaaauaccucccauuauucgauauuaacgcauuccgcaaaaagcuacacagcggcagagaaaaauuugucgaacuuucacuggaggacaagaaagacauaauacuaaaaguauugauaggacuacacgacaauccugcuacauccgacuuaaaaacauuaggauucucgagcacugaauuaggcaaaaugcagaaaaauucaggcauuguacuaucagguaaugcgaaauugauauaucaaaguccaacuggucuauuuaaaaagaguguuaaaauaagugauuuauga

SEQ ID NO: 5449 - RNA, 4113 nt, Artificial Sequence
  Cas9 variant
augacaaaaauaaaagacgacuacaucguaggacuagacauaggcacagauucaugcggauggguugcaaugaacucagauaacgacauacuaaaacuacaaggaaaaacagccauagggagccaucuauucgaagccgggaaaucggcugcggacagaagacuauuccgaacaacacacagacgaauaaaaaggagaagguggagacucaaacuauuagaggaauuuuucgaccccuacauggcaaaaguagaucccuauuucuucgcuaggcugaaagaaucaggacuuucaccgcuggauaaacgcaaaaauguauuuucgauaguauuucccacagcagcagaagacaagaaauucuaugacgacuauccaacaauauaccacuuaagauacaaacuuaugacagaagaugaaaaauucgaucuacgagaaguauaccuagccauacaucauauaauaaaauacagaggcaacuuucuauauaacacaucuguuaaagacuuuaaagcuagcaaaauugauguaaaaucaucaauugaaaaacucaacgaauuguacgagaaucuaggacuagacuuaaacguagaguucaauaucucaaacacagcugaaaucgaaaaaguauuaaaagacaaacaaaucuuuaaaagagauaaagugaaaaagauagcggaacuauuugcaauaaaaacagacaacaaagaacaaaguaaaagaauaaaggacauaagcaaacagguagccaacgcuguauuaggauauaaaaccagauucgacacuauagcccuaaaggaaguaucaaaggacgaacucucagauuggaacuuuaaacuaucugacauagacgcagacuccaaauucgaagcccuaaugggaaauuuagacgaaaacgaacaagcgauauuacuaaccauaaaagaguuauucaacgcaguaacucucaauggcauagucgaagacgguaacacucuaucagaaaguaugauaaauaaauauaacgaucacagagaugaccucaaacugcuaaaggaaguaauagagaaccacauagacagaaagaaagccgucaaacucgcacucgcauacgaccuauacgucaauaaucgucauggacaacucauucaagccaaaaagaaacuuggaaaaauuaaaccuggcuccaaagaagacuucuacaaaguuguuaauaaaaaucuagacgauagucaagccucaaaagagauaaagaagaaaauagaguuagacagcuucaugccaaaacaacggacaaaugccaacggaguuauaccauaccaacuacaccaacuagaacuagacaaaauaauagaaaaucaaucaaaauauuacccauuccuaaaagagauuaacccagucagcucucaucuaaaagaagcaccuuauaaauuagaugaacuaauacguuuuagagucccuuauuauguaggcccguuaaucucaccaaaugaaaguacaaaagauauccaaaccaagaaaaaccaaaacuuugcauggaugauaagaaaagaagaaggccgaaucacuccauggaauuucgaucagaaaguugaccgaauagaaucagcaaauaaauucauuaaaagaaugacgacaaaagauaccuacuuauucggagagaauguucuacccgcaaacucucuccuguaucaaaaauuuacuguacuaaacgagcuaaauaacauaagaauaaauggcaaaagaauuagcguugaccuaaaacaagagauauaugaaaaccuauucaaaaagcauaccacaguaaccguuaagaaauuggaaaacuaccuuaaacaaaaucauaaucucguaaaagucgaaauaaaaggccucgccgacgaaaagaaauucaacuccggccucacaaccuauaauagauucaaaaauuuaaauaucuucgauaaccaaauagacgauuuaaaauaucgaaaagauuuugagaaaaucauagaauggaguacuauauuugaagauaaaucaauuuacaaagaaaagcuacguagcauugacugguuaaacgagaaacaaauaaaugcacuaaguaacauccgccuucagggauggggaagauuauccaagaaacucuuagcacaacuacaugaucacaacggacagacaauaauagaacaacuaugggacucacaaaauaacuuuaugcaaauagucacccaggcagauuuuaaagacgcaauugcaaaagcgaaucaaaaccuauuggucgcaacuuccguagaggauauccugaaugaugcauauacgaguccugccaacaagaaagcaauacgacaaguuauaaaaguaguagacgauaucguuaaagcggcauccgguaaaguacccaaacagauagcgauagaguucacucgugacgcugacgacaacccgaaacgaucacaaacaagagguaguaaacuccaaaaagucuauaaagaucucucaacagaacuagcaucaaaagcaauugccgaagaacucaacgaagcuauuaaagacaagaaacugguacaagacaaauauuaucuauacuuuaugcaacuaggacgugaugcguauacuggcgaaccgaucaacauagaugaaauucagaaauaugauauugaccauauccuaccccaaucauucauaaaagacgaugccuuagauaauagaguccucguaucaaaagcaguaaacaaugacaaaucugauaacguaccaguaaaacucuucggaaaugaaauggcaggaaaucucggaauaacaauuagaaaaaugugggaggaauggaaaaauaucggacuaauaucaaaaaccaaauauaauaaucuacuaacagacccagaccacaucaacaaauaugaaagcgcagguuuuauuagacgacaacugguagaaacuagccagaucauaaaacucguaagcacaauauuacaaucaagauacccuaacaccgaaaucaucacaguaaaagcaaaauacaaccauuaccuaagggaaaaauucgaucucuacaagaguagagaagucaaugacuaccaucacgcaauagacgcauacuuaucagcaauauguggcaaccuccuauaucaaaauuacccuaaucugagaccauucuuuguauauggccaauauaagaaauucucaucugacccugacaaagaaaaagagauuuuuaacaaaacccgaaaauucaguuuuauaucgcaaauacuuaaaaauaaaucagaaaacagcaaagaaauagcagaaaaauuaaaaagagcauaccaauucaaauauaugcuaguaucuagagaaaccgagacaaaagaucaagaaauguucaaaaugacaguauuucccagagaaacgcccggcaaucuaauuccgaaaaagaaaggaauggccacagaaauuuauggaggauacaccaaaaauuccgacgccuacauggugauaguaaaaauagacaaaaagaaagaaacagaguacagaauacuaggaauaccaacccgcgagcuuguaaaucugaagaaagcagaaaaagaagaucauuaugaauccuacuuaaaagaaauauuagcaccacguauauuauacaauaaaaacggaaaaagggauaagaaaauaacaaguuucgaaauaguuaaauccaaaauuccguauaaacaagucauacaagauggagacaagaaauucaugcuuggaucgaguaccuacgucuacaacgccaaacaacugacauuaucaacagaaucaaugaaagccauaacaaauaauuucgauaaagauuccgaugagaaugaugcacuaauaaaagccuacgaugaaauacucgacaagguggauaaauaucuaccacuuuucgauauaaacgccuuccgaaagaaacuucacucaggaagagaaaaauucguagaacucucccuagaagacaagaaagacauaauacuaaaaguacucauaggauuacaugacaaucccgcaaccuccgacuuaaaaacauuaggcuucucaucgacagaacuugggaaaaugcagaaaaacucaggaauaguauugagugguaaugccaaacucauauaccaaucuccaacaggauuauucaagaaaagcguaaaaauuuccgaucuauga

SEQ ID NO: 5450 - RNA, 4113 nt, Artificial Sequence
  Cas9 variant
augaauaaaccauacucaauugggcuugauauaggcacuaacucugucggaugguccauuauaacagaugacuacaaaguccccgccaagaaaaugagaguauuaggaaacaccgacaaagaauacauaaagaaaaaccuuauaggagcacuacuauucgacggcggaaacaccgcggcagacagaagauuaaaaagaacggcaagaagaagauauacacgacgccgcaacagaauauuguacuuacaagaaauauucgcagaagaaaugucuaaaguugaugauagcuucuuucacagacuugaagacucauuccuaguugaagaagacaaaagaggcagcaaauauccuauauucgcgacuaugcaagaagaaaaauacuaccaugagaaauuuccaaccaucuaccaucuaaggaaagaacuagcugacaagaaagaaaaagcagaucuaaggcuaauauauuuggcucuagcccacauaauaaaauucagaggucauuuccuuauagaagaugaccgauuugauguucgaaacacugacauacaaaaacaauaucaagcauuuuuagaaauauucgacacaacauuugaaaauaaugaccuccugagucaaaacguugauguagaagcaauacuaacagacaaaaucucgaaaucagccaagaaagauagaauauuagcgagauauccuaaucaaaaaucaacagguauuuucgcagaauuucucaaacuaauugucggaaaucaagcugauuucaagaaacauuuuaaccuagaagauaaaaccccucugcaauucgccaaagauucauaugaugaagaucuugaaaaccuacuuggucaaauaggcgacgaauuugcagaccuauuuucugcggcgaagaaauuauacgacuccguacuacuuuccggcauauuaacggucaccgaucuaagcacuaaagccccucucuccgcaucaaugauucaacgauacgaugaacauagagaagauuuaaaacaacuaaaacaauucguaaaagcaagccuaccagaaaaauaccaagaaauauuugccgacucaaguaaagauggauaugcaggauauauagaaggcaaaaccaaucaagaagcauuuuauaaauaucucaguaaauuauuaacaaaacaagaagguucagaauaucuauuagagaaaaucaaaaacgaagacuuucuacgaaaacaaagaacguucgauaauggcucaauaccucaucaaguacaucugaccgaacuccgagcaaucauccgccgacaaucugaauacuaccccuuuuuaaaagaaaaccucgauagaaucgagaaaauucugacauuuagaauaccuuauuacguuggaccacuagccagagaaaaaucagauuucgcauggaugaccagaaaaacagaugauagcauaagaccguggaauuuugaagaccuagucgauaaagaaaaaucagcagaagccuucauacaucgaaugacuaacaacgaccuuuaucuaccagaagaaaaaguauugccaaaacacagucuuauauacgaaaaauuuacagucuacaaugaacucacaaaaguacgcuuuuuagcagaaggauucaaagauuuccaauuuuuaaacagaaaacaaaaagaaaccauauucaacucacuauucaaagagaaaagaaaaguuacagaaaaagauauaauuucauucuugaauaaagucgacgguuaugaaggaaucgcaauuaaaggcauagaaaaacaauucaaugcgucucucucuacauaccaugaccuaaagaaaauauuaggaaaagauuuccuagacaauacagauaaugaacugauuuuagaggacauuguacaaacacuaacacucuuugaagaccgugaaaugaucaggaaacgauuagacaucuacaaagacuucuuuacagaaucacaauuaaagaaauuguacagaagacauuacacaggcuggggcagacucucugcaaaacuaauuaauggcaucagaaacaaagagaaccagaaaacgauacuagacuaccuaauugacgacggauccgcaaacaggaacuuuaugcaauuaauaaaagacgcaggccuauccuuuaaaccaauaauagauaaagcuaggacaggaucacacuccgauaaucucaaagaaguaguuggcgaauuagcaggcucaccagcaaucaagaaaggcauacuacaaucacuaaaaauuguagaugagcucguuaaaguuaugggcuacgaaccggaacaaaucguuguagaaauggcucgagaaaaccagaccacagcaaaaggacucucacgaucucgacagcgacuaaccacccuaagagaaaguuuggcaaaccuaaaaucaaauauacucgaagagaagaaaccaaaauacguaaaagaucaaguagaaaaccaccaccuaucagacgauagauuauucuuauauuaccuacaaaacggcaaagacauguacaccgaugacgaacucgauauagauaaucuuucccaauaugacauugaccauaucauuccacaagcauuuauuaaagaugauucaauagacaacagagugcuagugucaagugccaaaaaucgaggcaaaucagacgacgucccuagcguagaaaucguaaaagacugcaaaguauuuuggaagaaacuacuagacgcuaaauugaugagccaacguaaauaugacaaucuuaccaaagcagaaagaggaggacucacuuccgaugauaaagcgcgauuuauccaaaggcagcuaguugaaacccgacaaauaacaaaacacguggcucguauacucgacgaaagauuuaacaaugaacuugauaguaaaggaagaagaauacgaaaaguaaaaaucguuacucuaaaaucaaaucucguaucuaauuuuaggaaagaguucggguucuacaaaauacgugaagucaacaacuaccaccacgcacaugacgcuuaccuaaaugcaguagucgcaaaagccaucuuaacaaaauacccccaguuagaaccugaauuugucuauggugauuacccuaaauauaacuccuacaaaacccguaaaucugcgacagaaaaacuauucuuuuacagcaacauaaugaacuuuuucaaaacaaaaguuacacuugcugacgggaccguagucgucaaggacgauaucgaagucaauaaugauacaggagaaaucguuugggacaagaagaaacacuucgcaacaguuagaaaaguauuaucuuauccacaagugaacauaguuaagaaaacugaaauucaaacaggaggguuuuccaaggaaucaauacuagcucauggcaacuccgauaaacuaauuccacguaaaacaaaggauauuuaccucgacccuaagaaauauggaggguucgacagucccaaaguugcauacucagugcucguaguugcugacaucaagaaagguaaagcccaaaaacucaaaaccguaaccgaguuacuuggcauaacaaucauggaaagaagucgauucgaaaagaacccaagugcauuucuugaaucaaaagguuaucuuaacauacgugacgacaaauuaaugauacuaccaaaauauucacuauuugaacucgaaaauggacgucguagacuccuagcaagugcaggagaacuacaaaaaggaaaugaauuagcacuaccuacacaguuuaugaaauucuuauaucuagccucacgauauaaugaacuaaaagguaaacccgaagaaauagaacaaaaacaagaauuugucguucagcauguaagcuauuucgacgauauucuccaaauuauuaacgacuuuuccaauaggguaauauuagcugacgcuaacuuagagaaaauuaauaaauuguaccaagauaauaaggaaaacauaccgguggacgaauuggcuaacaauauaaucaaucucuucacuuuuacaucacuuggugcuccugcagcauuuaaauucuuugauaaaauaguagauagaaaacgauauacuuccacuaaagaaguauuaaacagcacacugauacauaaaagcauaacagguuuauaugaaacaagaauagaucuaggcaaacuaggagaagauuga

SEQ ID NO: 5451 - RNA, 4113 nt, Artificial Sequence
  Cas9 variant
augaauaaacccuauucaaucggcuuagauauuggaacgaacaguguaggcuggaguauaauaaccgacgauuacaaaguacccgccaaaaaaaugagaguacucgggaauacagauaaagaauacaucaagaaaaacuuaauuggugcauuauuauuugacggagguaacaccgccgcagacagaagauuaaaacgaacagcccgaagaagauacacacgaagaagaaauagaauauuauauuuacaagaaauauuugcagaagaaaugucaaaagucgacgacucauucuuccauaggcucgaagauucauucuuaguagaagaagacaaacguggaucaaaauacccaauauucgcuacacuucaagaagaaaaggauuaccacgaaaaauucucaaccauauaccaccuuagaaaagaacuggccgauaaaaaagaaaaagcugaucuuaggcuaaucuauauagccuuagcacacauaauaaaauuuagaggacauuuucucauagaggaugacucauuugauguaagaaacacggacauaucaaaacaguaucaagacuuucuggaaauuuucaacaccacguuugaaaacaaugacuuacuuagccaaaacguugauguagaagccauacugacagacaaaauaagcaaguccgccaaaaaagauagaauacuagcccaauauccuaaucaaaaaagcacugguaucuuugcugaauuccuaaaacuaauaguagguaaccaagcugacuuuaaaaaauauuuuaaccuagaagacaaaacaccacuucaauucgccaaagacucauacgaugaagaccuagaaaaccuucugggucaaaucggcgaugaauucgcagacuuauucagcgcagcaaaaaaauuguaugauagcguacuccuuagugguaucuuaacaguaauagacuuauccaccaaagcccccuuaagugcuucuaugauccaacguuacgaugagcaccgagaagacuuaaaacaacuaaaacaauucguuaaagccagcuuacccgaaaaauaccaagaaaucuuugcagauucaaguaaagaugguuacgccggauacauagaaggcaaaaccaaucaagaagccuuuuacaaauacuuaucaaaacuacuuaccaagcaagaagauagcgaaaauuuccuagaaaaaauuaaaaacgaagauuuucuacgcaaacaaagaacauucgacaacggcagcaucccccaucaaguacaccuaaccgaacuaaaagcuauaaucagaagacaauccgaauauuauccuuuuuuaaaagagaaucaagauagaauagaaaaaauauuaacauuucguauaccguacuauauaggaccacuagcaagagaaaaaagcgacuuugcauggaugacgagaaaaacagacgacucaauuaggccguggaauuuugaagaucuagucgacaaagaaaaaucagcggaagcauuuauucaccgcaugacaaauaaugacuuuuauuuaccugaagaaaaggugcucccaaaacacagccuaauuuaugaaaaauucacaguauauaacgaacuuacaaaaguacgauacaaaaaugaacaaggugaaacuuauuuuuucgacucaaauauuaaacaagaaauauucgacgguguauucaaggaacaccguaaaguauccaaaaaaaaauuacuagauuucuuggcuaaagaguaugaagaauucagaauugucgacgucauaggccuagacaaggaaaauaaagcauucaaugcaagccuaggaacguaccacgaccuagaaaaaauucuggauaaagacuuccuagauaauccagauaaugaaucaauacuagaagacauaguccaaacgcuaacacucuuugaagaucgagaaaugauuaaaaaaagauuagaaaauuauaaagacuuauucacagaaagucaacugaaaaaacuauauagaagacacuauaccgguuggggacgacuaucugcaaaauuaaucaauggaauacgagauaaagagucucagaaaacaauacuagauuaccuaauagacgauggccgaaguaacagaaauuucaugcaauugauuaacgaugacggucuaucauuuaaauccaucauaagcaaagcccaagccgggucucacagcgauaacuuaaaggaagucguaggagaauuagcaggaucacccgcaauuaaaaaaggaauauuacaaucccucaaaauaguagacgaacuaguaaaaguaaugggauacgaacccgaacaaauuguaguagaaauggcaagagaaaaccagacaacgaaccaggggcgaagaaacucacgccaacgauacaaauuacuagaugacggcguuaaaaaucuagcauccgacuuaaacggaaacauauugaaagaauacccaacugauaaccaagcauugcaaaacgaaagacuuuuuuuauauuaccuacaaaacggccgagauauguacaccggagaagcucuagauauagauaaccugagucaauaugauauagaccacaucaucccccaagccuucaucaaagaugauagcauagauaauagagucuuaguaucaagugcaaaaaaucgugguaaaucagaugacguaccaagccuggaaauaguuaaggacuguaaaguuuuuuggaaaaaauuacuagaugcaaaauuaaugagccaaagaaaauaugacaaucucacaaaagcagaaaggggaggcuuaacgucagacgauaaagccagauucauucaaaggcaacuagucgagacaagacagauaacaaaacauguagcucggauucuugaugaacgcuuuaacaacgaauuagacucaaaaggacgucgaauacgaaagguaaaaauagugacucuaaaaucaaaccucguaagcaauuucagaaaagaauucgguuucuauaaaauaagagaagugaauaauuaccaucaugcucaugacgcauaucuuaacgccgucgucgcgaaagcaauauuaacaaaauauccucaacucgaaccagaauucgucuauggagauuauccuaaauacaauucauauaaaacucgcaaaucagcaacugaaaagcuuuucuucuacucuaauaucaugaacuuuuuuaaaacaaaaguaaccuuggcagauggaaccguaguaguaaaagaugauauugaaguuaauaacgauacuggagaaauagugugggauaaaaaaaaacauuuugcaacagugagaaaaguacuauccuauccacaaaauaauaucguaaaaaaaacagaaauacagacaggaggauucuccaaagaaagcauucuagcacaugguaacagcgauaaacucauuccccgaaaaaccaaagacaucuaccuggacccaaaaaaauacgguggauuugacuccccaauaguagccuauagcguucuuguaguugcagacauuaaaaaaggaaaggcacaaaaauuaaagacaguuaccgaacuacuuggcauuaccauuauggagagaaguagauucgaaaagaauccaagcgcauucuuagaaagcaaaggauaucugaacaucagagcagauaaauuaauaauucuaccaaaauauucucucuuugaauuagaaaauggacguagaagacugcuggccuccgcaggggaacuccaaaaggggaacgaacuggccuuacccacucaauuuaugaaauuccuuuaucuagcguccagguauaacgagagcaaaggaaaacccgaggaaauagaaaaaaaacaagaauucgucaaucaacacgucagcuauuucgaugacauacugcaauuaaucaaugauuucagcaaacgugugauacuagccgacgcuaacuuagaaaaaauuaacaaacuauaucaagauaacaaagaaaauauaucagucgaugaauuagcaaauaacauuauuaaccuauucaccuucaccaguuuaggagcgccagcagcauuuaaauuuuuugacaaaaucguagaccgaaaaagauauacaucaacgaaagaggugcuuaauucaacauugauacaucaaagcauuacagggcuauacgaaacacgcauagaucuugguaaacuuggagaagacuga

SEQ ID NO: 5452 - RNA, 4113 nt, Artificial Sequence
  Cas9 variant
augaauaaaccauacucaauugguuuagauauaggaacaaauucaguaggauggucaauuauaacagaugauuauaaagugccagcaaagaaaaugagagugcuagguaacacugauaaagaauacauuaagaaaaaucuaauuggagcccuccuguuugacggagguaacacagccgcugacaggagacuaaaaagaacugcacggcgacgauauacaaggcgaagaaauagaauauuauaccuacaagaaauauucgcagaagaaaugucaaaagucgaugacucauucuuucaucgucuugaagauucauuucuaguagaagaagacaaacgaggcucuaaauauccgauauuugcaacuuuacaagaagagaaagacuaccacgaaaaauuuucaacaauuuaucaccuaagaaaagaacuagcugauaagaaagaaaaagccgacuuaagacuaauauacauugcccuagcccacauaaucaaauuccgaggacacuuucucauagaagacgacucauuugauguuagaaauacagacauauccaaacaauaucaagacuuucuagaaauauucaacacuaccuucgaaaauaaugaccuccuaucacaaaacguugacguagaagcaauauugacagacaaaaucucgaaaagcgccaagaaagauagaauacuugcacaauauccaaaccagaaaucaacuggaauauucgcagaauuucuaaaacuaauugucggaaaccaagcagauuuuaagaaauauuuuaacuuagaagacaaaacaccccuacaauuugcuaaagacucauaugacgaagacuuagaaaaccucuuaggucaaauaggagacgaauuugcagaucuauucucagcagccaagaaacuuuaugacucaguacugcuaucgggaauacucacgguaauagaucuaucaaccaaagcgccucuaucagcauccaugauacagagauacgacgaacaccgagaagacuuaaaacaacucaaacaauuugucaaagcaucauuaccagaaaaauaucaagaaauauucgccgauaguucuaaagauggauaugcaggauauauagaaggaaaaacaaaccaagaagcguucuauaaauaccuaagcaaauuacuaacgaaacaggaagacagcgaaaacuuucuagagaaaaucaaaaacgaagauuucuuaagaaaacaaaggaccuucgauaacgguaguaucccccaccaaguacacuuaacggaauugaaagcaauaaucagaagacagucugaguacuaccccuuccuuaaagaaaaccaagaucgaauagagaaaauauugaccuuuaggauuccauacuacauagggccauuagcccgagaaaaauccgauuuugcauggaugacccgcaaaacagacgauucaauaaggccauggaacuucgaagacuuagucgacaaagaaaaauccgcggaggcuuucauucaccgaaugaccaacaacgacuucuaucuaccagaagaaaaaguacuaccgaaacauucccugauauacgaaaaauucacagucuacaacgaacuaacaaaaguaagguauaaaaacgaacaaggugaaacauauuucuucgacucaaacauaaaacaagaaaucuuugacggagucuucaaagaacaccgaaaaguaaguaaaaagaaauuacuagacuuccuugcaaaagaauacgaagaauuucggauaguggauguaauaggcuuagacaaagaaaauaaagcauucaacgcaucacuaggaacauaccacgaccuggagaaaauucuagacaaagacuuccucgauaauccagauaacgaaucaauacuugaagacaucguacaaacacucaccuuguucgaagauagagaaaugauuaagaaaagacuugaaaauuacaaagacuuauuuacugaaagccaauuaaagaaacuauacagacgacauuacacaggauggggacgacuaagcgcaaaacuaauaaauggcauccgugauaaagagucccagaaaacaauacuagauuaccuaauagacgauggacgcaguaaucggaauuuuaugcaacuaauaaacgaugauggucucaguuucaaaucaaucauuucgaaagcacaggcaggaagucauagugauaaccugaaagaaguaguuggagaauuagccggaaguccagcaaucaagaaaggcauacuucaaucgcuaaaaauaguagaugagcuaguaaaagugaugggauacgaacccgaacaaauaguaguagaaauggcacgagaaaaccaaaccaccaaucaagggagacgaaacucucgacaacgauacaaauuauuagaugacggagugaaaaaccuagcgagugaucuaaauggcaauauacuaaaagaauacccuacugacaaucaagcacuacaaaacgaaagacucuucuuauacuaccuucagaauggacgagauauguauaccggagaagcgcuagacauagacaacuuaucacaguacgacauugaucacaucauaccccaagcauuuauaaaagaugacucuauagacaaucgaguguuaguauccagugcuaaaaacagaggaaaauccgaugauguuccuagucuagaaauagucaaagacuguaaaguuuucuggaaaaaguuacuagacgcaaaacuuaugucacaacgcaaauaugauaacuuaacuaaagccgaaagaggugggcucacaucugaugacaaagcucgauuuauacaaaggcagcuaguagaaacgaggcaaauaacaaaacacguagcacgaaucuuagacgaaagguucaacaacgaacucgacaguaaaggucgacguauaagaaaagucaaaauaguaacccuaaaauccaaucuagucuccaacuuuagaaaagaguuuggcuucuauaaaauaagggaaguaaacaauuaucaucaugcacaugacgcuuaccuaaacgcaguaguagcaaaagcaauacuaacaaaauauccccaauuagagcccgaguucguauacggagauuauccaaaguacaacucuuacaaaacaagaaagagcgcuacugaaaaacuauucuuuuauagcaauaucaugaacuucuuuaaaaccaaagucacccuagcagacggcaccgucguaguaaaagaugacauagagguuaauaaugauacgggagaaauuguaugggacaagaagaaacacuucgcuaccguuagaaaaguguuaagcuacccgcagaacaacauagucaagaaaacagaaauacaaacaggaggauucuccaaagaaucaauucuagcccauggcaacucggacaaacuuauuccaagaaaaaccaaagauauauaucuagaccccaagaaauauggcggauuugauucaccaauuguagcauacucaguucuaguggucgcggauauuaaaaaggguaaagcccaaaaguuaaaaacagucacagaauuauuaggaaucacuaucauggaaagaagcagguuugagaaaaaccccagugcauuuuuagaauccaaaggauauuuaaauauaagagacgacaaacuaaugauacuaccaaaauauucacuauuugaacuagaaaauggacgcagaagacuacuagcuagcgccggagaacuacagaaagguaaugaauuagcauuacccacccaauuuaugaaauuccuuuacuuagcaaguagauacaacgaaagcaaaggcaaacccgaagaaauagagaagaaacaagaauuuguaaaccaacauguaaguuacuuugaugauauacuucaacuuauaaacgauuuuaguaaacggguuauauuagcagaugcaaaucuagagaaaauaaauaaacuauaucaagauaauaaagaaaacaucucaguggacgaguuagcgaacaauauaauaaauuuauuuacauucacaucacuaggagcuccagcagcauucaaguucuuugauaaaauagucgauagaaaaagauacacuagcacaaaagaaguacuuaauucuacucuaauacaucaaucaaucaccggauuauaugagacccgcauagaucucggaaaacucggggaagacuga

SEQ ID NO: 5453 - RNA, 4113 nt, Artificial Sequence
  Cas9 variant
augaacaaaccuuacucaaucggacuagauauagggacaaacucagugggaugguccauaauuaccgacgacuauaaaguuccagcgaaaaaaaugcgaguacucgguaauacagauaaagaauacaucaaaaaaaaucuaaucggagcuuuauuauucgauggaggaaacaccgcggccgauagacgucugaaaagaacagccaggcggcgauacacgagacgccguaauagaauauuauaccuacaagagauauuugcagaagaaauguccaaaguugaugacuccuuuuuccauagacucgaagauucauucuuaguugaagaagauaaacgaggcucaaaauaucccauauuugcuacgaugcaagaagagaaauauuaucaugaaaaauucccaaccauauaccaccuaaggaaagaauuggcugacaaaaaagagaaagcugaccugcgucucauauaccuagcacuugcacacauaaucaaauuccgaggucacuucuuaaucgaggacgauagauuugaugucagaaacacugauauucagaaacaauaccaagcguucuuagaaauauucgacacaacauucgaaaacaaugauuuacuuagucaaaacguugacguagaagcaauauuaacagacaaaaucucgaaaucugcaaaaaaagaucgaauuuuagcaagauaccccaaccaaaaaaguaccggaauauuugcagaauuuuuaaaacuaauaguaggaaaccaggcagacuuuaagaaacauuucaaccuugaagacaaaacaccccuacaauucgcaaaagacucauaugaugaagauuuagaaaaccuuuuaggacagauaggagacgaauuugccgauuuauuuagugcugcaaaaaagcucuacgauagugucuuacucagcggcauccuaacagucaccgaccuauccacaaaagcaccgcuaucugcaucuaugauacaaagauaugaugaacaucgggaagauuugaaacaacuaaaacaauucgucaaagcgucucuuccagaaaaguaccaagaaauuuuugcggauucuagcaaggacggauaugcugguuacaucgaaggaaaaacaaaccaagaagccuucuacaaauacuuaucaaaacuuuugacaaaacaagaggguucagaauacuuauuagaaaaaauaaaaaaugaagauuuccuacgaaaacagagaacauuugacaaugguucaauuccccaccaaguccaccuaacagaauuaagggcaaucauccgacgacaaucugaauauuacccacuacuaaaagagaaccuagaucgaauagaaaaaauacuaacauuucgaaucccauacuacgucgggccacuagcaagagaaaaaucagacuucgcauggaugacacguaaaaccgaugacuccauacgaccauggaauuucgaagauuuaguugacaaagagaaaagugcagaagcauucauacaccgaaugacaaacaacgaucucuaucuucccgaagaaaaaguauuaccaaaacacucacuaauauacgaaaaguuuaccguauacaacgaacuaacaaaagucagguuuuuagccgaaggcuuuaaagauuuucaguuucuaaauaggaaacaaaaagaaaccauauucaauucauuauuuaaagaaaaacgaaaaguaaccgaaaaagauauaauaagcuuucuuaauaaaguugacgguuaugagggaauagccauuaaaggcaucgaaaaacaguuuaacgcaagccuuagcacuuaccacgaccuaaaaaaaaucuuaggcaaagacuuucuagauaacacagauaaugaauuaauacucgaagauauaguccagacauuaacgcuauucgaggaccgagaaaugauucguaaacgacuggacauuuacaaagauuucuuuacugaaucacaacucaaaaaacuuuaccgccgacauuauacaggcugggguagacuaucugcaaagcugauaaauggcauuagaaacaaggaaaaccagaaaacaauucuagacuacuuaauagacgacggcuccgcaaauagaaacuuuaugcaacuaauuaaagaugcgggacuaucauucaaacccauuaucgacaaagcucgcacgggaucacacucugacaauuuaaaggaaguaguuggagaauuagcagguuccccagcaauuaagaaaggcauccuacaaucauuaaaaauaguugaugaacuaguaaaagucaugggauacgaaccugaacaaauaguaguagagauggcaagagaaaaucaaacuacggcaaaaggauuaucaagaucaagacaaagauuaacgacacuuagagaaagcuuagccaaccugaaaucaaauauccuagaagaaaaaaaacccaaauauguuaaagaccaaguagaaaaucaccaccuaucagacgaucgucucuuucuauacuaucuacaaaauggcaaagacauguacacagaugaugagcuagacauagauaaucucucccaauaugauauagaccauauuaucccacaagcauucaucaaagacgauuccaucgauaaccgcguacucguauccucagccaaaaauagagguaaaucagaugacguccccucuguagaaauagugaaagauuguaaaguauuuuggaaaaaguuacuugaugcgaaacuaaugagccaacgcaaauacgauaaccuuacaaaggcugaaagaggaggucucacauccgacgacaaagcaagauucauccaacgacaacuaguagaaacaaggcaaauuacuaaacacguggcuagaauacuugacgaaagauuuaauaaugaauuagacucuaaaggaagaagaauacguaaagugaaaaucguaacacuaaaaagcaauuuaguaagcaacuuucgcaaggaauucggauucuacaaaauacgcgaaguaaauaauuaucaucaugcucaugacgccuaccuuaaugcaguuguagcaaaagcaauucuaacaaaauauccacaauuagagccagaauucguauauggagauuacccaaaauacaacucauauaaaacuagaaagagcgcaacagagaaauuauuuuuuuacagcaauauaaugaacuucuucaagacaaaaguaacauuagcagauggaacaguuguuguaaaagaugacauugagguaaacaacgauacaggcgaaauugucugggacaaaaagaagcacuucgcgacaguaagaaaagucuuaucauacccacaagugaauauaguuaaaaagacggaaauccaaacagguggcuuuaguaaagaguccauauuagcacauggcaauagugacaaacuaaucccgagaaaaacaaaagacauuuacuuagaucccaaaaaauauggagguuuugacagcccaauaguagcauauucuguucugguuguugcagacauaaaaaagggcaaagcacaaaaauuaaaaacaguaacagaacuacuaggcauaaccauaauggaaagaucgagauuugaaaaaaacccuagcgcauuccucgaaucaaaaggauaccuugauauacgagacgacaaacuaaugauauuaccaaaauacagccuuuucgaacucgaaaacgguagaagaagguuauuagcuuccgcuggggaacuacaaaaaggaaaugaacuagcucuaccaacacaauuuaugaaauucuuauaccucgcaagcagauacaaugaacuaaaaggaaaaccugaagaaauagaacaaaaacaagaguucgucgugcaacacgugucuuauuucgaugacauacuucaaaucauuaacgacuuuucaaacaggguaauccuggcugaugccaaucuugaaaaaaucaauaaauuguaucaagauaacaaagaaaacaucccuguggaugaacucgcaaacaauauaauaaacuuauuuacauucacaucauuaggugcaccagcugcauucaaauuuuuugacaaaauaguggacagaaaacguuacacaaguacaaaagagguacuuaacaguacucucauacaccaaagcauaaccgggcuauaugaaacucgaauagacuuagguaaauuaggagaagauuga

SEQ ID NO: 5454 - RNA, 4113 nt, Artificial Sequence
  Cas9 variant
augaagaaaccauauuccaucggacucgacauaggaacuaacucagucgguugggcaguuguaaccgacgacuauaaagucccugcuaaaaagaugagaguauuuggugauacagaucgaucucacauuaagaaaaaccuccuaggaacucuacuauuugaugacggaaacacggcagaaucaagacgauuaaaacgaacugccagaagaagauacacuagaagaagaaacagaauuuuauaccuacaagaaauauuuaccgaauccaugaacgaaauagaugagagcuucuuccaccgacuggacgauucauuuuuaguaccagaagauaaacguggaagcaaauaucccauauuugcuacauuacaagaagaaaaagaauaucauaaacaauuucccaccauauaccaccuaagaaaacaacuugcagacuccaaagaaaaaucugacguccgacucaucuaccucgcuuuagcacacaugaucaaauacagaggucauuucuuguaugaagaaacuuucgacaucaaaaacaacgacauacaaaagauauuuaacgaguucauaaauaucuacgacaauacauucgaagguagcagucuuaguggacaaaacgcucaaguagaagcgauauuuacagauaaaauaagcaaaagugcgaagcgcgaacgaguccuaaaacuuuucccagaugaaaaauccaccggccuguuuucagaauuucuaaaguuaaucguuggaaaucaagccgacuucaagaaacacuuugaccuagaagaaaaagccccacuucaauucucaaaagacacauaugacgaagaauuggagaaucugcucggucaaauaggagacgacuuugcagaccucuucuuaauagcuaagaaauuauaugacgcuauacuacucucgggcauuuuaacgguuacugacccuaguacaaaagcaccccuuuccgccagcaugauugaaagauacgaaaaccaccaaaaagaccucgccgcccuaaaacaauucauuaaaaauaaccuacccgaaaaauauguggaaguauucagugaucaguccaaagacggauaugcaggauauaucgaugggaaaaccacucaggaagcauucuauaaauauauuaaaaaccugcuaucaaaauuugagggagcagacuauuuucuugauaaaauugagcgagaagauuuccucagaaaacaacgaacuuuugauaacggcucaaucccucaccaaauucacuuacaagaaaugaaugcuaucuuacgaagacaaggggaacacuauccuuucuuaaaagaaaaccgagaaaagauagagaaaauccuaacguucagaauacccuauuacguaggaccacucgcaagggauaauagagauuuuucaugguuaacgagaaacucugacgaacccauuagacccuggaauuucgaagaaguagucgauaaagcuagaucagcagaagacuuuauacaucgaaugacaaacuacgaccuuuauuugccagaagaaaaaguccuaccaaaacauucauuacuauacgaaacuuucgcagucuacaaugaacuuacaaaagucaaauucaucgcugaagguuuaagagauuaccaauuucuagauucuggacagaagaaacaaaucguuaaccaacucuuuaaagagaaaagaaaaguuacagaaaaagacauaauacacuaucuacacaacgucgacgguuacgacggaauagaauuaaaaggaauagaaaaacaauucaacgcaaacuuauccaccuaucacgaccucuuaaaaaucacaaaagacaaagaguucauggaugaccccaaaaaugaagaaaucuuagaaaacauuguccauacccuaaccaucuucgaagaccgagaaaugaucaaacaaagacucgcucaauacgacacauuguucgacgaaaaaguaauuaaagcacuaacacgucgacacuacaccggauggggaaaauuaucagcaaaacuaauaaacgggauaagagacaaacaaucugguaaaacgauacuagacuaccuaauugacgacgauaaaauaaacagaaauuucaugcaacuaauaaaugaugacgguuuaaguuuuaaagaaaucauucaaaaagcacaaguagucggaaaaacagacgacguaaaacaagugguacaagaacucccaggcucaccagccauaaagaaagguauccuacaauccauaaaaauaguagaugaauugguaaaaguaaugggauacgcauuagaaucuauaguuaucgaaauggcaagagaaaaucaaacaacagcacguggaaagaaaaacucucaacaacgauacaaaagaaucgaagaugcauugaaaaauuuagccccagguuuagacucaaacauuuuaaaagaaaauccaacagacaacauacaauugaaaaaugacagauuauucuuauacuaucuacaaaacgggaaagauauguauacaggaaaaccacuagacauaaaucaguuaucaaguuaugacauugaccauauaauuccucaagccuucauuaaagacgauucaauagacaauaggguucugacaucgaguaaagacaaucgugggaaaucagacaacguaccaagccuagaaguaguacaaaaacgaaaggcuuuuuggcaacaacugcucgacucaaaauuaauaucugaacgcaaauucaacaacuuaacuaaagcagaacgaggaggccuugaugaaagagacaaaguuggauucaucagacgucaguuaguugaaacacaacagauuaccaaaaauguugcgcaaauacuagacgcacguuuuaacacagaaguaaaagagaaaaaccaaaagauacgcacaguaaaaaucauaacgcuuaaaaguaaucucgucucaaauuucagaaaagaauuuggacuauauaaaguacgagaaauuaauaacuaucaccaugcucaugacgcauaucuaaacgcuguaguagcuaaagcaauacuaaagaaauauccgaaauuagaaccagaauuugucuacggagacuaucagaaauaugaccuuaaaaaguauaucaguagauucaaaccauccaaagaaauagaaaaagcaacagaaaaauacuuuuucuauagcaacuuacuaaacuuuuucaaagaagaaguacuauacgcagauggaaccauccguaaacgcgaaaauauagaauauucaaaggacacaggggaaauugcaugggauaaagaaaaagacuuugcgacaauuaaaaagguacuaagcuauccgcaaguaaacauaguaaagaaaagagaaguccaaaccggcggauuuuccaaagaaucaauccugccaaaaggcaacucugacaaauugauuccacgcaaaacaaaagauauuuuaugggacacaacaaaauaugggggauuugauucgccugugauagcuuacucaaucuuacucauagcagauaucgaaaaagguaaagcaaagaaacuuaaaacagugaaaacucucguaggcauaaccauaauggaaaaagccgccuucgaagaaaauccaauaacauucuuagaaaacaagggcuaccacaaugucagaaaagaaaacauacuaugcuuaccaaaauauagccuuuuugaacuagaaaacggacgaagaagacuacuagcgagcgcuaaagaacuucaaaagggcaaugaaauaguacuaccuguaugucuaacaacauuauuguaucauuccaaaaaccuacacaaacucgacgaacccgaacaccuagaauacauacaaaaacaucgcaacgaguucaaagauuuacuuaacuuagucuccgaauuuagccagaaguacauauuagccgaagcaaaccuagagaaaauuaaagaucucuacgccgauaaugaacaagcugacauagaaauucuagcaaacagcuucauaaaccuuuuaacuuuuaccgcauuaggagcacccgcagcuuucaaauuuuucggaaaagacguagauagaaaacgauauacuacagucucagaaauccugaaugcaacguuaauacaccaaucgaucacuggauuauaugaaacgagaauagaccuuucgaaauuaggcgaagaauga

SEQ ID NO: 5455 - RNA, 4113 nt, Artificial Sequence
  Cas9 variant
augaagaaaccauacucaauuggacucgacauagggacaaauuccguaggaugggcaguuauaacagacgauuauaaagugcccgccaagaaaaugaaagugcuaggaaacacagauaaaaauuauauuaagaaaaaucuacucggagcacuuuuauucgauagcgguaauacagcagaagaucgcagacuaaaaagaacagcgagaagacgcuauacgaggagaagaaaucgauuauuauacuuacaagauaucuuuuccgaugaaaugaacaaaguggaugaaucauuuuuccacagacuagaagacaguuuccuaguauccgaagauaaaagaggagaccaucauccaauuuuuggaaacguugucgacgaaguuaaauaccaugaacaauucccaacaauuuaccaucuacgaaaauauuuagcagauacaccugaaaaagcagauuuaaggcuaguuuaccuagcgcucgcacauaugauaaaauuccgaggacauuuucuaauagacgacccgaaacuagaugucaaaaacacagacagccaagaacuguuuucacaauuuuuaacagcauaugacguaacucaagaagauagucauuuagcagacguuaaaauaaacauuucagacauaauaacagagaaaaugaauaaaucuagaaaaguagaagcacuacucuuucacuucccaagccagaagaaaaauuccuuuuucggaaaucuaguaucccuaguuuucggacuauuaccaaacuuuaaaacaaauuucaaccucgcagaagacgcaaaauuacaacucucuaaagauucauaugacgaagaucucgaaaaccuacucggccagauaggagaugaauauacugacgucuucguugcagcaagaaaacuauacgacucuauccuuuuaucagguauccucacaguaaaugaucuuagcacaaaagccauacuuuccgcaucuaugguuagaagauaugaagaacauaacaaagaccuagcaaaacucaaagcauucguaaaagcaaacuuuacucacgacguauuuaaagaaguauuuucugaugcaucuaaaaacggauacgcuggauauauagaaggaaaaaccucacaagaagauuucuacaaauacgucaaaaaccuaauaggcaaaguagauggaagugccgacuucaucgagaaaauagauagagaagauuuccuuagaaaacaacgaacauuugacaauggaucaauuccacaucaaguacaccuagcugaaaugaaagcaauacucaggcgacaaggcgaauauuaucccuucuuaaaagaacacgccgagaaaauacaacaaauucuaacuuucaggauuccuuauuacguuggcccauuagauagacacggucauucugacuuugccugggcuuccuucaauucggaagaaaaagugacaccauggaacuuugaagaaauuauagacaaaaacaaaucagcacaagccuucauagaacgaaugaccaaucaagaccuauaccuuccuaacgaaaaaguucuuccaaaacacaguccacuguaugaaaaauacacaguuuauaacgaauuaacgaaaauaaaauacgucacugaaacaggcaccgcaaaauucuuugacgcuaaccuaaaacaagaaauauuugacggccuauuuaagaaagaaagaaaaguaacgaaaagaaaacuauugacauuccuagagaaaaauuucgacgaauuucgaaucguugauauucaaggucuagauaaagaaacugaaacauuuaaugcauccuacggaauauaccaagaucuauuaaaaauaauaaaagacaaagcauuuauggaugacucugagaaugcugacaucuuagaagacaucguacuaacauuaacucuauucgaagauagagaaaugauaaaacaacgcuuggccaaauacgcugaucuauucgauaaaaagguaauugacaaucuggcaagacggagauacaccggauggggaagauugucagcuaaacuccucaacggcauacgcgacaaaagauccagaaaaaccauaauggacuaucucguagaugacggacgaucaaauagaaauuuaaugcaacucauaacagaugacaaucuaacauuuaaagacgaaauagccaaagcucaauauagugacaauagcgaugacuuacaucaaguaguucaggauuuagcaggcucacccgcaaucaagaaagguauucuccaaagcguaaaaauuguagaugaacuggugaaaguaaugggcuacgaaccagaacaaauaguaguagagauggcgagagaaaaccaaacgaccgcaaaaggcaggcgaaacagccaacaacgauauaaaagacuugaagaagcaaucaaaaauuuagauagagaucuaaacuauaaaauccucaaagaacacccaaccgauaaucaggcuuuacaaaaugaccgauuauucuuauacuauuuacaaaacggacgggauauguauacaggagagucccuugauaucaaucguuugucggauuacgauauagaccacaucauaccacaggcuuucaucaaagacaacuccauagacaaccgaguccuaguaucaagcgccaaaaacagagggaaaucugaugauguuccaucugaagauguuguaaauagaaugcguccauuuuggaauaaacuacucaauuguggacuuaucucacaaagaaaauacagcaaucuaaccaagaaagaacucacaccaaaugacaaagcgggcuucauuaaaagacaacucguagaaacacggcagaucacuaaacauguggccaggauucucgacgaacauuuuaacaaggaauuugacgaagauaagaaacgcauccgcaaaguaaaagucguaacauuaaaaucgaauuuaguuucaaacuuccgaaaagaguucgaacuauacaagguacgagaaauaaacgacuaccaccacgcacacgacgcguaccucaaugcaguaguagcuaaagcccuacuuaugaaauauccaaaguuagagccugaguucguauauggagaauacccuaaauacaacucauacagagaaagaaaaacugcaacucaaagaauguucuucuauucaaauauuaugaauauguucaaaaguaaagugaaacuugccgacgaaagaauaauugagcgaccaaugauagaaguaaacgacgaaacaggagagauugcaugggauaagacaaaacauauagcaacaguaaagaaaguacuuucuuauccucaaauaaauauagucaagaaagucgaggaacaaacaggaggguuaacaaaugaaacgauauacccccgaggcagcuucgauaaacuccuaaaccgaaagaacacacuagaagcaagcaaauacggcggauucggaagucccacaguagcauacuguguccuaguaguggccgacuccaaaaacgagaacggcaaagucaagaaacucaaauuaggaucagaacuacuagggaucacaauauuagagaaaaaugacuuugaaaauaauagccuagauuuccuuucacguaaaggauaccaaggaguccaagagaagaaaauaauaaaacuaccuaaauacucucuuuucgaguuccaagacgguucucgacgaaugcuaaguagcgucauggcaaaugacaauaaacgaggugaccuucagaaagcuaacgaaaugauacuaccagcuuaucuaguaaaacuacucuaucaugccaaacauauaaacaguguaggugaaccagcucacaaaaacuacauaaacgaacacugcuccgaauuucaggauuuguugaauuacauccgacaauuugcugacaaauucguagacguagacaaaaacuuauccaaaauaagaucucugagcaaauccauggccgaauacucuguaucugagauuugcagcucauucguaaaucuucuuacguuaacggcauuaggugcaccggccgacuucaaguuuuucggaacuacaauaccaagaaagagauauggcaguccucaaucaauccucagugcaacccuaauacaccaaucaauuacaggauuauacgaaaccagaauagaucuauccaaauuaggagaggacuga

SEQ ID NO: 5456 - RNA, 4113 nt, Artificial Sequence
  Cas9 variant
augaacaaaccauacaguauuggucucgacaucggcacuaacucaguaggauggaguaucauaacagaugacuacaaaguuccagccaagaaaaugagaguauuaggcaauacagacaaagaauauauaaagaaaaaucuuaucggagcccuacuauuugacggaggcaauacagcagcagacagacgacuuaaacgaacugcaaggcgaagauauacaagacgaaggaauagaauauuauaccuacaagaaauuuuugccgaggaaaugucgaaaguugacgacagcuucuuucacagauuagaagacucauuucuaguagaagaagacaaaagaggaucgaaauacccaaucuuugcaacaaugcaagaggaaaaauacuaucacgaaaaauucccaacuauauaucaucuucguaaagaauuagcggauaagaaagaaaaagccgacuuacgccuaauauaccuugcgcuugcccacauaauaaaauuucgaggccacuuccuaaucgaggaugacagauucgacguacggaauaccgacauucaaaaacaauaucaagcauucuuagaaauauucgauaccacauuugaaaacaaugaccuauuaagucaaaauguagauguagaggcaauacuaacagauaaaaucagcaaaucagcgaagaaagaucguauacuagccagauauccuaaccagaaaucaaccggaauauucgccgaguuccugaaacuaauaguuggaaaccaagcagacuucaagaaacacuucaacuuagaagacaaaacaccccuucaauuugcaaaagauagcuaugaugaagauuuagaaaaccuccuuggucaaauaggagacgaauuugcugaccucuucucggcugcaaagaaauuauacgauucgguauuacuaucaggcauacuaaccguaacggacuuaaguacaaaagcaccgcuaucggccucaaugauacaaagguacgaugaacacagagaagaccuuaaacaauugaaacaauuuguaaaagcgucauuaccagaaaaauaccaagaaauauuugcugacucaaguaaagacggauacgcuggauacaucgaaggaaaaaccaaccaagaagccuuuuauaaauaccuaucaaaacuauuaacaaaacaagagggaagcgaauaccucuuagagaaaaucaaaaaugaagacuuuuuaaggaaacaaagaacauucgauaacggaucgauuccacaccagguacaucuuacugaacuaagagcuauaauuagacgucaaucagaauauuacccguuuuugaaagaaaaccucgauaggauagagaaaauauuaacauuccggauaccuuauuauguugguccucuagcacgagaaaaaucagacuuugccuggaugacacgaaaaaccgaugacucuauacgaccuuggaacuuugaagaccugguagacaaagaaaaaucggcugaagcauucauacacagaaugacaaacaaugacuuauaucucccagaagaaaaaguacucccuaaacauucacuuaucuaugaaaaauucacuguguauaacgaacucacaaaagugcgauuucuugcagaaggauuuaaagacuuccaauuuuuaaaccgcaaacaaaaagaaacgauauuuaauucauuauucaaagaaaaacggaaggucaccgaaaaagacauaauuucuuuucuaaacaaagucgauggauacgaggggauagccauuaagggcauagaaaagcaguucaacgcuucacucucgacauaccaugaccuaaagaaaauacugggaaaagacuuucuagacaacacagauaaugaacucauacuagaggacaucguacaaacccuaacccuauuugaagaccgcgaaaugaucagaaagagauuagacauauacaaagauuucuuuacagaaucacaacugaagaaacuuuacagaaggcacuacaccgguuggggaagauuauccgccaaauuaauaaacgggauucgaaacaaagaaaaccagaaaacuauucucgauuacuuaauagaugacggaucggcaaaccgaaacuucaugcaauuaauuaaagacgcaggauuauccuuuaaaccgauaauagauaaagcaagaacuggaucacacucagacaaucuuaaagaaguaguaggugaauuggcuggauccccugcaaucaaaaagggaauacuucagucacucaaaauaguugaugaacucgucaaaguuaugggauacgaaccugaacaaauaguuguagaaauggcccgagagaaucagacuacagcgaaagguuuaucucgccuuagacaacgacuuacaacccuucgagaaucuuuagcaaaccugaaaagcaauauacuagaagagaagaagccaaaauacguaaaagaucaaguagaaaaccaucaucuaagcgacgacagacucuuucuauacuaccuacaaaacggcaaagauauguacacagaugaugaauuagacaucgauaacuugagccaauacgauauagaccauauuauaccacaagcauucauaaaagaugacucaaucgauaacagggucuuagucagcucagccaaaaacagaggcaaaucagacgacguuccauccguagaaaucgucaaagacuguaaaguguuuuggaagaaacuccuagaugcaaaauuaaugagucaacgcaaauaugacaauuuaacaaaagcagaacguggcggcuuaacgucagacgauaaagcccgauucauccagagacaauugguugaaacuaggcaaaucacuaaacaugucgcacgaauauuagaugaaagguuuaacaacgaauuagacucaaagggcagacgaauaaggaaaguaaaaauagucaccuuaaagagcaacuuaguuaguaauuucagaaaagaguucggauucuauaagauuagagaaguaaacaacuaccaccaugcgcaugacgcuuacuugaacgcugucguugcaaaagcgauucuuacuaaauacccacagcucgaacccgaauuuguauacggcgauuacccaaaauacaacucauacaaaacacgaaaaagugccacagaaaaacuauucuuuuacucgaauauuaugaauuucuuuaaaacuaaaguaacauuagcagacggaacuguuguaguaaaagaugauauugaaguuaacaacgacacaggagagauaguaugggauaagaagaaacacuuugccaccguucgaaaaguauuaucauacccacagguaaacauuguaaagaaaacugaaauacaaacagggggcuuuagcaaagagucaauacuagcacacggaaauucggauaaauuaauccccaggaaaacuaaagauaucuaccucgaccccaagaaauaugguggauuugauucaccaauugucgcauauucaguauuaguugucgccgauaucaaaaaggguaaggcccaaaaacuaaaaacuguaacagaauugcuuggaauaacaauaauggaacgaaguagauucgagaaaaacccaucagcuuuccuagaaucuaaaggauaucucaauauuagggacgauaaacuaaugauuuuaccuaaauauagccucuucgaauuagagaacggaagaagaagacuauuagcauccgcagacgagcuacaaaaaggcaacgaacuagcccuaccuacccaauuuaugaaauuccuguauuuagcaaguagauacaaugaauuaaaaggaaaaccggaagaaauagaacaaaaacaagaguuuguaguacaacacgucuccuauuucgacgauauacuacaaauaauuaacgacuucaguaaucgugucauacuagcagaugccaacuuagagaaaauuaacaaguuauaccaagauaacaaagaaaauauccccguugaugaacuagcaaacaacauaauaaaccuuuucacauuuacaagucuaggagcccccgcagcauuuaaauucuuugacaaaauaguugacagaaaacguuauacaucaacaaaagaaguauuaaacagcacucugauccaccaaucaauuacaggccuuuacgaaaccagaauagaucugggaaaacuaggagaagacuga

SEQ ID NO: 5457 - RNA, 4113 nt, Artificial Sequence
  Cas9 variant
auggaaaaaaacaaggaauaugucauaggguuagacauaggcaccggaucaguuggauggagcgcaauaucuacagauaacuaccaacuaaucagacaaaaaggaaaaaauuuaauuggcguacgauuauuuaauucagcugaaacagcggaagaaaggcggggauauagaacgacgcguagaagacuaaguagaaggagauggaggaugagccuuuuaaacgauauauuuagaccagaacuuaacgaaauagacgagaauuuuuuagcaagacuaaaauauuccuggguaagcccccuugaccaaaaaaauccacagcuaaacgaacaaggaaccaaugcaucacucuauggagauauagaggcggaucaagcguuucaucgggcauacccaaccauuuaccaccuacgaaaaacacucauggaagacaaucaaaaacacgaccuaagagaaguauauuuagcgauacaucauauuguuaaauaccgaggacacuuccugacucccgauuuugacgcuaauagucaaacgauagauaucaaaggauuauuuaaacagcuuggagacgugucagggucgauagaauuacaagcagaucaaaccucuacaguaauagcugccuuucaauccauauuguuagacuucaccaagacaccaaccgaaucaggcagacuagcaggccaacucuucucagaccagaauaaggauaaacaggccaaaaagcaagucgaagaguuguucaaacuauuaagaggagggaaaggauccuuagcggacauguuccuccuuacagaccuagauaaagugguuaaaaaucaacuuaaauucgcauucgaugaugcaguagaugagaaucuuaacuuaauaucuaaucucauaaacgaagaacaauacgagcuuuuacucaacauacagaaacucagaggcacaaucauacuuaaacaaauauuaggagacgacgaaacaguaucagaugcaaaaguccgcaguuaugaggaacacgcucaucaacuaaaagaacuaaaggcccaaguacuaacuaaagauaauaaagaaaaauucgaagaagcauaccaauuaauacaaaaaggcgaugcaagcaggaucgauggucucaaaaaguuaaaaacaaucauaaaccaagaacacgaagcucuaagacuagauaaauacgaagcagauaaauuacuaaaauugaucgaacuagaccaacuauuaccuguacagagaucgaaacgcaacggcgaaaucccacaccaacuacacgaauuugaauuaaaaaaaauaauagaaaaacaggguagauauuacccguuccuuagagaaacauuugaacgcgacggacaagaguucaacaaaauaggccaacuuguuaacuuuagaauaccuuacuacguaggaccguuaguagacccaaggcucgcugguauccagucgggggaucaaacaaaucacuggaugacacaaaaaaaagcaggaaaaauuacaccauggaacuacacugagcucaucgauauugauaaaagcgcagcagaauucauaaaaagaaugacagguacagauacguaucuaguaggagaaccaucauuacauaaagcaagucucauauaccaagacuacaauguacuacaagaauuaaacaaccucagauacgacggcaaaccacuuccaguagacgcaaagcaagaaaucuacucaaaccuacaagucagcuuaaaaaaugcaaccaaaaauaaaauaaauucauuccucaucuccgaaggauaucuacaagacggugaagaacuuacaggauuugccggcaaagaauuaaaaaauaaacuaagcaguuuccacuacuucaaaaacauauucggaccugaacgaaugaacacauuagguaccgacaacuuggaaaaaaucacagagcuacaaaccguauuugaagacagacauaugcuaaaaagacaacuucagaaacuagguuuccuagacgacgacgaaugugaaaaauuagcaggaaaacauuucacuggcuggggcaaucucagcaaaaaauuacuaaauacaccggcgaucauagacccagaaauaaacgagaauaaaauaaguuuaaucgaugcauuauauaaaggacaaagaaaccucaguuuuuacguaaauaacauggacgacaaauaucaauuuagggacuggauagagucagaaaaccaaagccaacaaguagaaauaucccuggaugaaaaaauuaaaaauuuggcaggaaguccagcuaucaaaagagggaucacacaaagcauggcaguuauacaagauauaauuagggcaaauaacggaauaucaccaaaaagaauuuaccuagaauucgcgagggaaucacaaaauaguuaucaacccaauucuagaauuaaacaaauagaaaaaauauacgaucaaaacaaaaaagaacuaaugaaagucuacccugacguauuuaaggacguucaagggguauuaaauaaugucgacgaaaauaacuccuuaucagaaaaagcauuccuguacuucaugcaacuuggaaaagauauguauacaggugaagcauuggacuucgauaaauuauauacauaugacaucgaccauaucaucccacaagcaaugacuaaagacaacagcugggacaauaaaguauuagucacagccauaaaaaaccgagagaaaucaaaccaaguacucgauaacgcaauacaagcaaaaaugcacaauuucuggcuucaacuaaaaaagguuaacuuacucucacagaggaaauaugacacauuaaugaaaacaaauuucagcaagggagaugaaaaaaaauucauugcccgaucacuaguggaaacuagacaaauaauaaaaaacguugcagaacuaauaaaaucggaauuugaccacguagaagcaauuccaauuagacaagaacuuacaucagacaugagacaauuaauggauuacaaaaaaaaucgacuuguaaacgauuaucaucacgcgcacgacgcauugcuaauugcaacuguaggcgaauuuaugcaaaaacgagguuucaugcaaggaaugaaccccucacaaaauguuuaccacggauacacacaauaugucaaaaaauggcucuccauggcaaaaaaggccagaucagcggaaaaacccgaaagaauuuuuccacuacaauuuguuguagggucaaugagaauggcaguuagagauggacaaguggacaaaguaacacaccccgcuacaggggaaauaugcuggacagcugacaacgaagcuuaucucaggaaaguacuagguuauaaaaauauuuuaguaacacgcaagguaaaaaacgcaggaaaacuguaucaacgaguaaccguaaagccaaaaggaucaggagaagcaccaguaaaccaccaaaaaucagacaucaacauuuacggaggagugacaagcgaacaagccgcugaacuaguacuaauacgaauaaaagcaaagaauaaugccaaaaauaugguaaucaaaauaccuacagcgaucgccaaccaaguugcgaacaaaacgacaacuuacgaugcauacgugagaucacuuaauauaccuaacuacgccggcauaauuuuggaucaaauucccuugggacaacuaguauuugaugagaggacuucauuuuacuuagcaagugcagaaauuaaacauaacgcccgacaacuauggguuaaccaacauauaaauaacguacuuacgaaaaaaaauauaaacgacgaagaaagagauaauauacuaaaccugcuaaccaacgaaaaaaaucucgaaagauuuaaacuucuagaacccgaccuaaaaagagugaaagcugcgaaacaacaaugggcaucgugugacgaucaagaacaaaugcagauucuaagaauuauuauaaacaaaaugcacgaugacgcauccccucaaauaccagguaaaauagauccauuuaaaaauuaucuggauaaacaagguaaaggauggcgagaccuuaggacgaaaaaaggcaugaaauuaucagauaaugcggaauuuguuuaccaauccccaacuggacuauaucaucgcaaaauaucaauaaaugaauuacuaaaacaaaaacaacuagaauga

SEQ ID NO: 5458 - RNA, 4113 nt, Artificial Sequence
  Cas9 variant
augaacaaaccguacaguauaggucuugauauuggaacaaauagcgucgguuggucaauaauuacagacgacuauaaaguaccagccaagaaaaugagaguacuagguaacacggauaaagaauacaucaagaaaaauuuaauuggugcauuguuauuugacggcggcaacacugcagcagacagaagauuaaaacgaacagcaagacgucgauacacuagaagaagaaaccguauccuguaucuacaagaaauauucgcagaagaaaugucaaaaguggacgacagcuuuuuccaccgccuagaagauaguuuucuaguugaagaagauaaaaggggaucuaaauacccuauauucgcaacgaugcaagaggaaaaguauuaucaugaaaaauuucccacaauauaccaucucagaaaagaacuagcugauaagaaagaaaaagcagaucuaagacuaauauaucuagcacuagcacacauuauaaaauuuagaggacacuuucuaaucgaagaugaucguuuugacguacgaaacacagauauccaaaaacaauaccaagccuucuuagaaauauucgauaccacuuucgaaaacaacgaccucuugucgcaaaauguagacguagaagcaauauuaacagacaaaauauccaaaucggccaagaaagaccguauucuugcuagauauccaaaccaaaaauccacuggaauauuugcagaguucuugaaauuaauagugggaaaucaagcagauuuuaagaaacauuuuaaccuagaagacaaaaccccacuccaauuugcaaaagacucauaugacgaagauuuagaaaaucuacuuggccaaaucggagacgaauuugcagaucuauucucagcagccaagaaacuauacgauucaguacuguuaucaggaauuuuaacaguaacggaucuuagcacaaaagcuccacuaagugcaucuaugauacaacgauacgacgaacaccgugaagaccucaaacaacuaaaacaauuuguuaaagccucgcuaccagaaaaauaucaagaaauuuuugcagacuccagcaaagacgguuaugcaggcuauauagaaggaaaaaccaaucaagaagcguuuuacaaauacuuaucuaaauuauugaccaaacaagaagguagugaauacuuguuagaaaagauuaaaaaugaagacuuucuucgcaaacaacgcacauucgauaauggauccauaccacaccaaguacaccuaacagaacuacgugcaauaauccgcagacagagcgaauacuaucccuucuuaaaagaaaaucucgaucgcaucgagaaaauuuuaacauucagaauaccauacuacguagguccacuagcaagagagaaaagugacuucgcauggaugacuagaaaaacagacgacuccauaagaccauggaacuucgaagaccuagucgacaaagagaaaagcgcagaagccuuuauacaccguaugacgaauaacgauuuauacuuaccagaagaaaaaguacuccccaaacauucacuaauauaugaaaaauucacaguauacaacgaacugacuaaagugagauuuuuagcagaaggauuuaaagauuuccaauuccucaaccgaaaacaaaaagaaacaaucuuuaauagucuauucaaagaaaaacgaaaaguaacagaaaaagauaucauuagcuucuuaaacaaaguagacggcuaugaaggcauagcaauaaaaggaauugaaaaacaauucaacgcaucacuauccacauaccaugaccucaagaaaauacugggaaaagauuuccuugauaauacagacaacgaauuaauauuagaagacaucguucaaacuuugacgcuauucgaagacagagaaaugaucagaaaaagacuagauauauauaaagacuuuuucacagaaagucagcucaagaaauuauacagaagacacuauacgggauggggucgacuaucagcuaaacuaaucaacggaauacgaaauaaagaaaaccaaaagacaauacuugauuauuuaauugaugacgguagugcaaaucguaauuuuaugcaacucaucaaagaugcuggucuaucguuuaaaccuauaauugauaaagcaaggaccggaucccacuuggacaacuuaaaagaaguaguaggagaacuagcaggaucaccagcaaucaagaaaggaauccuacagucccuaaaaaucguagaugagcuagucaaagucauggguuacgaaccggagcaaauuguggucgagauggcacgugaaaaucaaacaacagcaaaaggacuaucaagauccagacagagacuuacgacacuaagagaauccuuggccaaucuaaaaucaaacauauuagaagagaagaaaccaaaauauguaaaagaccaaguugaaaaucaccaccuauccgaugacagguuauuccucuauuaucuacaaaaugguaaagacauguacacagaugaugaacuagauauagacaaccuuagccaauaugauauugaccacauuauaccucaagcauucauaaaagacgauucgauagauaaucgaguacugguaucuucagccaaaaacagagguaaaucagaugauguaccuaguuuagagauaguaaaagauuguaaaguauucuggaagaaacuucuagacgcaaaacuuaugucccaaagaaaauaugauaaucuaacaaaagcagaaagaggaggacugacgagugacgacaaagcaagauuuauucaacgacaacucgucgaaacacgccaaauaacuaaacauguggcaagaauccuggacgaaagauuuaacaacgaacucgauagcaaaggaagacgaauuagaaaagucaaaaucgugacacucaaaucaaaccucguuaguaauuucagaaaagaguucggcuucuacaaaauccgagaagugaacaacuaucaccaugcucaugacgcauaucuaaaugcugucguugccaaagcgaucuuaacaaaauacccacaauuagagccugaguucgucuacggagacuaucccaaauauaacucauacaaaacuagaaaaucugcaacggaaaaacuauuuuucuacuccaacauaaugaacuuuuucaaaacuaaaguaacccuagccgacgguacugucguggugaaagacgacauagaaguuaauaaugacacuggugaaauaguaugggacaaaaagaaacauuuugcaacagucagaaaaguguuaaguuacccucaagucaacaucgucaagaaaacagaaguucagaccgguggcuuuucuaaagagucgauauuagcccacggcaauagcgauaaacuaaucccaagaaaaacuaaagacauauaccuagaccccaagaaauacggaggauucgauucaccaauaguagcauauaguguacuuguuguugcugauaucaagaaagggaaagcacaaaaacugaaaaccguaacugaacugcuaggaaucacuauaauggaaagaucaagauuugagaaaaauccuagugcauuuuuagaaucaaaggguuaucucaacauaagaacagauaaauuaauaauacugcccaaguacagccuuuucgagcuugaaaacggacguagacgccuacuugcuucagcaggagaacugcaaaaaggcaacgaacucgcacuaccuacucaauauaugaaauuucuauacuuagcaagucgcuauaacgaacuuaaaggaaagcccgaagaaauugaacaaaaacaagaguucgucguucagcauguaagcuauuucgacgacaucuuacaaauaaucaacgacuuuucaaaucgcguaauauuggcagacgcaaaucuagagaaaauaaauaaacucuaucaggacaacaaagaaaacauaccuguugacgaacuagcaaacaauauuauaaacuuauucacguucacaucuuuaggggcaccagcagcauucaaguuuuucgauaaaauaguagacagaaaaagauauaccucuacaaaagaggucuuaaauagcaccuuaauccaccaaucaauaacgggacuauaugaaacacgcauagacuuaggcaaacuaggcgaaggauga

SEQ ID NO: 5459 - RNA, 4113 nt, Artificial Sequence
  Cas9 variant
augaacaaaccauacucgauaggccucgacauaggcacaaauagcguggguuggucaauaauaacagacgacuauaaaguaccugcuaagaaaaugagaguacucggaaauacugauaaagaauacaucaagaaaaauuuaauaggagcacuucuauuugauggagguaauaccgcggccgauagaagauugaaaagaacugcccguaggagauacacuagaagaagaaacaggauacuauauuuacaagaaauauuugcugaagaaaugucaaaaguagacgacuccuucuuucaucggcucgaagauucuuucuuaguggaagaagacaaaaggggcucuaaauauccaauuuuugcaacucuucaagaggaaaaagauuaccaugaaaaauuuagcacaaucuaucaucuaaggaaagaauuagcagacaagaaagaaaaagcagaucuuagacuaauauauauagcauuagcacauauaauuaaauuuagaggccacuuucuaauugaagaugacucauucgacguucguaauacagacauauccaaacaauaucaagacuuucuagaaaucuucaauacgacguucgaaaauaacgaucuacuuucacaaaacguagauguugaagcuaucuuaacugauaaaauuucgaaaagcgcgaagaaagauaggauccuugcacaauauccaaaucagaaaagcacaggcauauucgccgaguucuuaaaacuaaucguugguaaucaagcagauuucaagaaauacuucaaucuagaagauaaaacaccccuccaauucgcaaaagacaguuaugacgaagacuuagaaaaccuacuuggccaaauaggagaugaauuugcagaucuauuuucugcagccaaaaagcuauaugacagcguauuauuaucaggaauauuaacaguuauagauuuaucaacaaaagcuccccuaagugcaaguaugauccaacgauaugaugaacauagagaagaccuaaaacaacuaaaacaauuuguuaaagcaagccuaccugaaaaauaccaagaaauauuugcagacaguucuaaagacggauaugcuggauacauagaaggcaaaacaaaucaagaggcguucuauaaauaucuguccaaacuacucacaaaacaagaagacagugagaauuucuuagagaaaauuaaaaacgaagauuuccuacggaaacaacgaacauuugacaacggaaguauaccacaccaaguucaucuuacggaacuaaaagcuaucauaagaagacaauccgaauauuacccauuuuuaaaagaaaaucaagauagaauugagaaaauacuaacguucaggauucccuauuacauagguccacuggcaagagagaaaucagauuuugcauggaugacaagaaaaacugaugauagcauacgaccguggaauuucgaagaucuuguagacaaagagaaaagcgcugaagcauuuauacauagaaugacgaauaacgauuucuaccucccagaagaaaaagugcuccccaaacauucccuuaucuaugaaaaauuuacaguauauaacgaacucacgaaaguaagauauaaaaacgaacaaggcgaaacauacuuuuucgauucaaauaucaaacaagaaaucuucgauggagucuuuaaagaacauaggaaaguuagcaaaaagaaauuauuagacuucuuggcaaaagaauacgaagaauuuagaaucguagacguaauuggacucgauaaagaaaauaaagccuuuaaugcaagccuagguacauaucaugacuuggagaaaauuuuagauaaagacuuccuagauaacccagauaaugaaucaauauuagaagauauaguacaaacccuaacccuauuugaagaccgugaaaugaucaagaaaagacuugaaaacuacaaagaccuguuuacagaaucacaacuuaagaaacuuuacagaaggcacuacacaggaugggguagacuauccgcuaaacuaauaaauggaauuagagauaaagaaucccaaaagaccauauuagauuaucucauagacgacgguagaucgaauaggaauuucaugcaauugaucaaugacgauggauuaaguuucaaaagcauaauaucaaaagcccaagcagggucacauucggacaaccuuaaagaaguagucggagaacuagccgggucacccgcaauaaagaaaggaauacugcaauccuuaaaaaucguagacgagcuaguuaaaguaaugggauaugaacccgaacaaauuguagucgaaauggcacgagagaaccaaacaacaaaucaagguagaagaaacagcagacaacguuauaaauugcuugacgauggagucaaaaaccuagcauccgaccuaaacggaaauauccuaaaagaauacccaacagauaaucaagcguuacaaaaugaaagacuauuuuuauacuacuugcaaaacgggagagacauguauacaggggaagcgcuagacaucgacgauuuaucacaauaugauaucgaucacauaaucccccaggcuuuuauaaaagacgacucuauagauaacagaguucuaguaucaucagccaaaaaucggggcaaaucggacgauguuccaucccuagaaauuguuaaagacuguaaaguauucuggaagaaacuccuagacgcaaaacugaugagucaaagaaaauacgauaacuuaaccaaagcagaacgaggaggacuaaccucagaugacaaagcaagauucauucaaagacaacuuguagaaacgagacagauaacaaaacaugucgccaggauacuagacgaaagauuuaacaacgaauuagauucgaaaggaagaagaauaagaaaaguuaaaaucgucacacuaaaaaguaauuuaguuucaaauuucagaaaggaauuugguuuuuauaaaauccgagaaguuaacaauuaucaucaugcccacgacgcauaccuaaacgccgugguagcaaaagcaauauuaacaaaauacccccaauuagaaccggaauuugucuauggagacuauccaaaauacaauucauacaaaacuagaaaaagcgcaacugaaaaauuauucuuuuauaguaacauuaugaacuucuuuaaaaccaaaguaacccuagcagauggaacaguagucgucaaagacgauauagaaguaaacaaugauaccggagaaaucguaugggacaagaagaaacauuuugcaacaguacgaaaaguucuauccuauccucaaaacaauauagucaaaaagacagaaauacaaacaggaggcuuuucuaaagaaucaauucuagcacacgguaacucagauaaacuaaucccccguaaaacaaaagauauauaccuagauccuaagaaauacggcggcuucgauagucccauugucgcauacucaguacugguaguagcagauaucaagaaaggaaaagcacaaaaauuaaaaacuguuacagaacuauuaggaaucacuauaauggaaagaaguagauucgagaaaaauccaucagcauucuuggaaaguaaaggcuauuugaacauaagagcagacaaguugaucauauuacccaaguacuccuuauucgagcuagagaauggucgcaggcgauuacuagcgagcgcuggcgaacuacaaaagggcaaugagcuugcacuaccaacucaauucaugaaauuucuauaccucgcaagccguuauaacgagucaaaaggaaaaccggaagaaauagagaagaaacaagaauuuguaaaucaacauguuuccuacuucgaugacauacuacagcucauaaacgacuuuucuaaacgugucauacuagcagaugcaaaucuagaaaagauaaacaaacuauaccaagauaauaaagaaaacauaucgguagacgaacuagcaaacaacauaauuaaucuguucacauucacaucacuaggagcgccugcagcuuucaaauuuuucgacaaaauaguagacagaaagagauacacaucaacaaaagaaguauuaaacucaacgcuaauucaucaaucaauaacagguuuauacgaaacacgcauagacuuaggaaaacuaggagaagauuga

SEQ ID NO: 5460 - RNA, 4113 nt, Artificial Sequence
  Cas9 variant
augaacaaaccguauucuauaggauuagacauaggaacaaauaguguugguugguccauaauuacagacgauuacaaaguaccagcgaagaaaaugagaguacucgguaacacggacaaagaauacauuaagaaaaaccuuauaggagcauuauuauucgauggaggcaauacagcugcagaccgacgacuaaaaaggaccgcaaggcgaagauacaccagaagaagaaaccgcauauuauacuuacaagaaauuuuugccgaagaaaugagcaaaguagacgauucauucuuccauaggcuugaagauagcuucuuaguagaagaagacaaaaggggaaguaaauaucccaucuucgccacauuacaagaagaaaaagauuaccacgaaaaauuuagcacaaucuaccaccuaagaaaagaauuagcagacaagaaagaaagagcugaucuacgauuaauauacaucgcucuagcgcauauaauaaaauuuagaggacauuucuuaaucgaagacgacaguuuugauguaagaaauacugauauaaguaaacaauaucaagacuuuuuagaaaucuucaacacuacuuuugaaaauaaugaucugcucagccaaaacguagauguagaagcaauacuaaccgauaaaaucucaaaaucugccaagaaagaucgcauauuagcccaauacccaaaccagaaaucuaccggaaucuuugcugaauuuuuaaaauuaauaguagguaaucaagcugacuucaagaaauauuucaauuuagaagacaaaacuccacuucaguucgcuaaagauucauaugaugaagaucuagaaaaccuauuaggucagauuggagaugaguucgcagaccucuucucugcggccaagaaacuauacgacagcguauuauuaucaggaauauuaacaguaauagaucuaagcaccaaagcacccuuaucugcaucaaugauacaacgauaugaugaacacagagaagaccuaaaacaauuaaaacaauuuguaaaagccucacuaccugaaaaauaccaagaaauauuugccgauucaagcaaagacggcuaugcaggauauauugaagggaaaacaaaccaagaggcuuucuacaaauacuuaucuaaauuauuaaccaaacaggaagacucugaaaacuucuuagagaaaaucaaaaacgaagauuucuuacgaaaacagaggacauuugauaacggaagcauuccccaccaaguacauuuaaccgaauuaaaagcaauuauuagacgccagucagaauacuaucccuucuuaaaagaaaaccaagaucgaaucgagaaaauuuuaaccuuuagaauccccuauuacauaggaccucuagcacgugagaaaagugacuuugccuggaugacaagaaaaacagacgacaguauacguccauggaacuuugaagaccugguagacaaagagaaaagugcagaagcguucauucaucgaaugacuaauaacgauuuuuaccuacccgaagaaaaaguacuuccaaaacauagucuaauuuaugaaaaauucacaguguacaacgaacuaacaaaaguccgauacaaaaaugaacaaggagaaacauauuucuuugauagcaauauaaaacaagaaauauuugacggaguguuuaaagaacauagaaaagugagcaaaaagaaacuccuugauuucuuagccaaagaauaugaagaauuuaggauaguagacguuauuggacuggauaaagaaaacaaagcauuuaacgccagucucgggacauaucaugacuuagagaaaauacuagauaaagacuuucuagauaauccagacaacgaaucaauauuagaagauauuguccaaacauuaacacuauuugaagacagagaaaugaucaagaaacguuuagaaaauuacaaagaucuguucacagaaucacaacuaaagaaacuuuacaggcgacauuauaccggauggggcagacucucugcgaaacuaauuaauggaauaagagacaaagaaucucagaaaacgauacuugacuacuuaauagaugacggaagaucaaaccggaacuucaugcaauuaauaaacgaugacggucuauccuuuaaaaguauaauaucgaaagcacaagcuggaucccacagugauaacuuaaaagaaguaguaggggaacuggcgggaucgccagcgaucaagaaagggauauuacaaaguuuaaaaauaguggacgaacuggucaaagugaugggauaugaaccagaacaaauaguaguagaaauggcccgcgaaaaucaaacaacuaaucaaggaagacgaaacucgagacaaagauauaaauuacucgacgacggggucaaaaauuuagcgagcgaucuaaauggaaacauauuaaaagaauaccccacagacaaucaagcacuacaaaacgaacgucucuuucuguauuaccuccaaaauggaagagauauguacacaggagaagcucuagacauagaugaucuuucgcaauaugacauagaccauauuauaccacaagcauucauuaaagaugacagcauagauaauagaguauuaguaucaagugcuaaaaaucgggguaaaagcgacgacguccccucucuagaaauaguaaaagacugcaaaguauuuuggaaaaagcuauuagaugcaaaacuaaugucacaacgaaaauaugacaaucugacaaaagcagaaagaggagggcucaccucagacgacaaagcaagauucauacaaagacaauuaguugaaacuagacaaauaacaaaacacguugccagaauauuggacgaaagguuuaauaaugaauuagacuccaaagggagaagaaucagaaaaguaaaaauaguaacacuaaaauccaacuuagucaguaacuucagaaaagaauuuggauuuuacaaaauccgagaaguaaauaauuaccaccaugcccacgacgcuuaccuaaaugcgguuguagcaaaagcaauuuuaacuaaauacccacaacuugaacccgaauuuguauauggagacuauccaaaauacaauaguuauaaaacacggaaaagugcaacagaaaaacucuucuucuacagcaacaucaugaauuucuucaaaacgaaaguaacgcucgcugacggaacaguugucguaaaagaugauauagaaguaaauaaugacacuggugaaauaguaugggauaaaaagaaacacuuugcuacaguacgcaaaguacugucauauccacaaaacaauauugugaagaaaacagagauucaaaccggaggauuuucuaaagagaguauuuuagcucauggcaacuccgauaaacuaauuccaagaaaaacaaaagacauauaucucgauccaaagaaauacggcggguucgacaguccuauuguagcuuauuccguauuaguaguugcagacauuaagaaaggaaaagcacaaaaauugaaaaccguaacagaauuacuaggaauaacaauaauggaaaggucgcgcuuugagaaaaacccaucagccuuuuuagaaucgaaaggauaucucaacauccgcgcugacaaauuaauaauacuuccaaaauacucacuauucgaguuagaaaaugguagacgacgcuuacucgcaucagccggugaacuccaaaaaggaaacgaauuggcgcugccuacacaguucaugaaauuuuuguacuuagcaucccgauacaaugagagcaaagguaaaccagaagaaauugagaagaaacaagaguucgugaaccaacaugucucauacuuugacgauauacuccaauuaauaaacgacuuuucuaaacgugucauauuagcagacgcaaauuuagagaaaauaaacaaauuauaucaagauaauaaagaaaauauaucagucgaugaacuagcaaauaacauaaucaaccuauucacauucacaagucuuggcgcuccagcagcauucaaauuuuucgacaaaaucguggauagaaaaagauacacaagcacgaaagaaguucuuaauaguacauuaauccaccagucaauuacuggauuauaugaaacuagaauagaucuaggaaaauuaggcgaagacuga

SEQ ID NO: 5461 - RNA, 4113 nt, Artificial Sequence
  Cas9 variant
augaacaaaccuuacaguauagguuuagauauaggaacuaacagcgugggauggucaauaauaaccgacgacuauaaaguaccagcuaaaaaaaugcggguauuagggaauacagauaaagaauacauaaaaaaaaaccuaauaggagcuuuguuauucgacggcggaaauacagcuucagaccgaaggcuuaaaagaacagccagacgacgauauacccguaggcggaauagaauauuauacuuacaagaaauauucgcugaagaaaugucaaaaguugacgacucauucuuccaccgacuagaagacagcuuccuaguagaagacgacaaaagaggauccaaauauccaaucuucgcuacaaugcaagaggaaaaagacuaucaugaaaaauuccccacaauauaucacuugcgcaaagaacuagcagauaagaaagagaaagcagaccuucgucuguuuuauuuagcauuagcucauauuaucaaguuuagaggacacuuuuuaauagaagacgacuccuuugaugugagaaauacagacauccaacgucaguaucaagccuucuuggaaauauucgauacuacguucgaaaauaaccaucuauuaucacaaaacauagauguugaaggaauccuaacagacaaaauaagcaaauccgcaaaaaaagaucggauccucgcacaauacccaaaccaaaaauccacuggcauuuucgccgaauuucuaaaauuaaucguggguaaccaggcagauuucaaaaaacacuucaauuuagaagacaaaaccccacuacaauucgccaaagacucauacgaugaagaccucgaaaaccucuuaggacaaaucggcgacgaauuugcugaccuguuuucaguugcaaaaaaacuauacgauaguguauugcuuucugguauauuaacaguaacagaccuauccacaaaagcacccuuaagugcaucgaugauacagagauaugacgagcauagagaagaucuaaaacaauuaaaacaauuuguuaaagcuuccuuacccgaaaaauaccaagaaaucuuuaccgacucgaguaaagacggauaugcaggcuacauagaaggaaaaacuaaccaaggagccuucuauaaauaucuaucaaaauuauuaacaaaacaagaaggaucugaauacuucuuagaaaaaauuaaaaaugaagacuuucuucgaaagcaaagaacauucgauaauggauccaucccacaccaaguucauuuaaccgaguugaaagccauaauaagaagacaaucagaauacuacccauuccuaaaagaaaaccuagaccgcauugaaaagauauuaacguucagaaucccauacuacguagggccauuagcgcgagaaaaaagcgauuucgcauggaugacacguaaaaccgaugacucaauacgaccauggaauuuugaagaauuggucgauaaggaagcaagcgcagaagcauucauacaccgaaugacaaauaaugaucuauacuuaccagaagaaaaaguauuaccaaaacauagcuuaauauacgaaaaauucacaguauauaaugaacucacaaaagucagauauaaaaaugaacaaggggagacauacuuuuucgacaguaacaucaaacaagaaauauucgacggaguauucaaagaacacagaaaaguguccaaaaaaaaacuacuugauuuccuagcaaaagaauaugaagaauucagaauaguagacguaauaggccuagacaaagaaaacaaagcuuuuaaugccucucuaggcacauaccaugaucuuaaaaaaaucuuagauaaggacuuuuuagauaauccagacaacgagagcauacuagaggauauuguccaaacccucacguuauuugaagauagagaaaugauaaaaaaaagacucgaaaacuauaaagaccuguucaccgaaucacaauuaaaaaaauuauaccgaaggcauuacacugguuggggacgacucucagcaaaauuaauaaauggaauaagagacaaggaaagccaaaaaacuauauuagacuaucuaauagaugaugguaaaagcaacagaaauuucaugcaauuaauacacgacgacgggcuaagcuucaaaagcauuauuagcaaagcacaagccggaagucacuccgacaaccuuaaagagguaguaggcgaauuagccggcuccccggccauaaaaaaaggaauauuacagucauuaaaaaucgucgacgaacuaguaaagguuaugggauaugaaccugaacaaaucguuguagaaauggcuagagaaaaucaaacaacuaaucagggacgacgaaauucaagacaaagguauaaacuacuagaugacggagucaaaaaccuugcuagcgauuugaacggaaacauauuaaaggaauaccccacggacaaccaggcccuacagaaugaacgacucuuccuauacuaccuucaaaacggcagagauauguacacaggaaaggcauuagacaucgacaaccuuagccaguacgacauagaucacauuauaccgcaagcuuucauaaaagaugacucaauagauaacagaguccuugugucgucagcaaaaaacaggggaaaauccgacgauguaccuagucucgaaaucguaaaagacuguaaagucuuuuggaagaaacuucuagacgcuaaacuuaugagccaaagaaaauaugacaaucucacuaaagcagaaaggggaggccuaacaucagaugauaaagcaagauucauccaacgacaacuaguugaaacccgacaaauuaccaaacaugucgcucgaauucuugaugaaagauucaauaacgaauuagauucuaaaggucgucggauaaggaaaguaaagauaguaacacugaaaaguaacuuaguaucgaauuucagaaaagaauucggauucuauaaaauuagagaaguaaauaacuaccaucacgcacacgacgcauaccuaaacgcgguugucgcaaaagcaauacucacaaaauacccgcaacuagaaccagaguucguauacggagacuacccgaaauacaacaguuacaagacaaggaagucagcaacagaaaaauuauuuuuuuacuccaauauaaugaacuuuuucaaaacaaaaguuacuuuggcagauggaacaguaguaguuaaagacgacaucgaagucaauaaugacacaggagaaaucguaugggacaaaaaaaaacacuucgcaacuguucgcaaaguauuauccuauccccaaguaaauauuguaaaaaaaacagaaauacaaaccggagguuucagcaaggaaucaauacuagcucaugguaauuccgacaagcuuauaccacgcaaaacgaaggauauauaccuagacccgaagaaauauggaggcuuugacagcccaauuguagccuauucaguacuaguaguggcagauauaaaaaaaggaaaagcacaaaaacuaaaaacaguaaccgaauuauuaggcauaacaauaauggaaaggagccgcuuugagaaaaauccuucagcauuucuugaaucaaaaggauaucuuaacauuagagaugacaaacucaugauccuaccaaaauacucacuuuuugaacuagaaaacggaagacggagauuacuagcaagugcuggugaauuacaaaaaggaaacgaacuagcccuaccaacacaauucaugaaauuucuauaucuugcgucucgauauaaugaacuuaaagguaaaccagaagaaauugaacaaaaacaagaguucguuguccaacaugucucuuacuuugaugacauccuacaaauaauuaacgacuucucaaacaggguaauccucgcugaugccaaucuagaaaaaauaaauaaauuguaccaggacaauaaagaaaauauaaguguugacgaauuagcaaacaauauaauuaaucucuucaccuucacaucucuuggugccccggcagcauuuaaauucuucgacaaaauaguagauagaaaaagauacacaucaacuaaagaaguacuuaacucaacacugauacaccaauccauaacagguuuauaugagaccagaauagacuuaggaaaacuaggcgaagacuga

SEQ ID NO: 5462 - RNA, 4113 nt, Artificial Sequence
  Cas9 variant
augaacaaacccuauagcaucggauuagacauagggacaaauuccguaggauggucaauaauaacagaugacuacaaaguuccagcuaagaaaaugcgugugcuuggaaauacagacaaagaauauauaaagaaaaaucuuauuggagcacuuuuauucgacggaggaaacacagcagcagauagaagacuuaaacguacagccagaagaagguauacaagaagaagaaauagaauauuauacuuacaggaaauauucgcugaagaaaugagcaaaguagaugacucauuuuuccaucgacucgaagacaguuucuuggucgaagaagacaaacgaggaaguaaauauccaauuuucgcaacaaugcaagaggaaaaauacuaccaugaaaaauuccccacuaucuaucaucuaagaaaagagcucgcugacaagaaagaaaaagcggacuugcgccuaauauaucuagcacuagcgcauaucauaaaauucagaggacauuucuugaucgaagacgacagauucgaugucagaaacaccgacauucaaaaacaauaccaagcauuucuugaaaucuucgacacuacauuugaaaauaacgaccuauuaucacaaaacguagacguagaagcuauacuaacagacaaaaucagcaaaagcgcaaagaaagaccgaauauuagcaagauacccaaaccagaaaagcacaggcauauuugcugaguuccucaaacucaucgucggcaaucaagccgacuuuaagaaacauuucaaucuagaagauaaaacucccuuacaauucgccaaagauucauacgaugaagaucuagaaaauuuacuaggucaaauuggagaugaauuugcagauuuauucagugcggcuaagaaacuauacgauucaguuuuacuuucaggcauucuaaccguaaccgacuuaaguacaaaagcuccccuaucagcuaguaugauacaacauuacgaugaacauagagaagauuugaaacaguuaaaacaauucguaaaagcauccuugcccgaaaaauaccaagaaauauuugcagauucaucuaaagauggauaugcuggcuacaucgaagguaaaacaaaccaagaagcauucuacaaauaccugucuaaacuacuuaccaaacaggaaggcucugaauaccuccuugagaaaaucaaaaaugaagauuuccuaaggaaacaaaggacuuucgauaacgguucuauaccccaucaaguacaucuuacagaacuacgagccauaauacguagacaaagcgaauauuacccauuuuuaaaagaaaacuuagauagaaucgagaaaauacuuacauuccgaauacccuauuacgugggaccacuagcuagagaaaaaucagauuuugcauggaugacaagaaaaacagaugauucaauuagaccauggaacuucgaagaucucguagacaaagaaaaaucggccgaagcauucauccacagaaugacaaacaaugaucuguacuuacccgaagaaaaaguauuaccgaaacauagccuaauauacgaaaaauuuacaguuuauaaugaauuaacaaaaguacgauuucuagccgaaggauuuaaagauuuucaauuucuuaauaggaaacagaaagaaacuauauucaauucccuuuucaaagagaaaagaaaaguaacugaaaaagacauaaucucauuccuuaauaaagucgacggauaugaaggaaucgccaucaaaggcauugaaaaacaauuuaaugccucgcuaucuacauaucaugaucucaagaaaauacucgggaaagauuucuuagacaauacugacaacgaauuaauauuagaagacauaguacaaacgcuaacuuuguuugaagacagagaaaugauaagaaagagacuugacauauauaaggauuucuuuacggaaucccaacugaagaaauuauaucgccgacacuacaccggcugggguagauuaucugcaaaauuaauaaaugguauucguaauaaagaaaaccagaaaacuaucuuagauuauuuaaucgacgacgguucagccaacagaaauuuuaugcaacuaauuaaagacgcaggccuuucguuuaaaccuauaauagauaaagcaagaacaggcucacauagcgacaaucugaaagaagucguaggugaauuagcgggcuccccagcaauaaagaaagggauacuucaaucauuaaaaaucguugacgaauuaguaaaagucauggguuacgaaccagaacaaauugucguagaaauggcaagggaaaaucaaacuacugcuaaagggcuaaguagaucaaggcaacgcuuaacaacucuaagagaaagucuagccaauuuaaaaagcaauauacuagaagaaaagaaaccuaaauacguaaaagaucaagucgaaaaccaccaccuuucagaugauagacuauuccuauacuacuuacaaaaugguaaagacauguacaccgacgacgaauuagacauagauaaccucucacaauaugauauagaucauauaauaccacaagcguucauuaaagaugauucaauagauaauaggguauuaguaucgucggcuaaaaaucguggaaaaagugaugaugucccaagugucgaaaucguuaaagauugcaaaguauucuggaagaaacuguuagaugcaaaauuaaugucacaaagaaaauacgauaaccucaccaaagcagaaagagggggauuaaccuccgacgacaaagccagauucauacaacgacaacucguugaaacacgacaaaucaccaaacaugucgcuagaauacuagaugaacgauuuaauaaugaacucgacucaaaggguagaaggauaagaaagguaaaaauagucaccuuaaaaucuaaucucguaucaaacuuccgaaaagaguucggauuuuacaaaauucgagaagucaauaauuaccaccaugcacaugaugcauacuuaaaugcagucgucgccaaagccaucuuaaccaaguacccucaacuggaaccagaauuugucuacggagacuaucccaaauacaauaguuauaaaacccgaaaaagugcgaccgaaaaauuauucuuuuacucaaacaucaugaacuucuuuaaaacaaaggucacucuagcggacgguacagucguggucaaagacgacaucgaagucaacaaugacaccggagaaauagugugggauaaaaagaaacauuuugcaacuguacguaaaguguuaaguuacccacaagucaacauuguaaagaaaacagaaauacaaaccggggguuucaguaaagaaucaaucuuagcgcauggaaauuccgauaaacugauaccacgcaaaacuaaagauauauaccuugauccaaagaaauacggaggcuucgacaguccaauaguggcguauaguguauuaguaguagcagauauaaagaaaggaaaagcucaaaaacuuaaaacaguaacugaacuacuagguauaacaauaauggaacguucacgauucgagaaaaauccaucagcauuccucgaaagcaaaggcuaccuaaacauucgugaugauaaacuuaugauccuaccaaaauauagcuuauuugaacuagaaaacggccgacgcagacuacucgcauccgcgggugagcuucaaaaagguaacgaacuagcauuaccaacccaauuuaugaaauucuuauaccuagcaucuagauacaacgaacuuaaaggcaaacccgaagaaaucgaacaaaaacaagaauuuguaguucaacaugucaguuauuucgaugauauauuacaaauaauaaacgacuuuagcaauagaguaaucuuagcagaugcgaaccucgagaaaauaaacaaacuauaccaggacaauaaagaaaacauuccaguagacgaacuagcgaauaacauaauuaaccucuucacuuuuacuucucuuggugcuccagcagcguuuaaauucuucgacaaaauaguagauaggaaaagguacacaaguacaaaagaaguauuaaacagcacacuuauccaucaaagcaucacagggcuuuaugaaacacgaauagacuuaggaaaacuaggagaggacuga

SEQ ID NO: 5463 - RNA, 4116 nt, Artificial Sequence
  Cas9 variant
augaaaguaaauaauuaucauauaggauuagauauuggcacaucauccaucgguuggguagcaauaggagaagacggaaagccacuccgcaucaaaggaaaaacugcuauaggagcacgccuauuccaagaagguaauccugccgcagaucguagaauguucaggaccacacgacguagguuaagcagaagaaaauggcgucuaaaauuacuagaagagauauucgauccuuauauaacaccagucgacagcaccuuuuuugcuagacugaaacagagcaaccuaaguccaaaagauuccaggaaagaauucaaaggcagcaugcucuuuccagaccucacagacaugcaauaccacaaagacuauccgacaauuuaucaucuacgacacgcauuaaugacucaagacgaaaaauucgauaucagaaugguauacuuagccauacaucauauaguuaaauacagaggcaauuuuuuaaauucuacuccaguggacucuuuuaaggcaucaaaagucaacuucguagaccaauuuaaaaaauuaaacgaguuauacacagcgaucaacccagaagaaaguuuccagauaaaucucgcaaacagcgaagauauuggacaccaauuucucgacccaagcauacgaaaauucgacaaaaaaaaacaaauuccaaaaauaguaccgguaucgguagaugacaaagccacugacaagauaaauggaaagauugcgagcgaaauaauaaacgcaauacucggguacaaaucaaaacuggauguaguaguucaauguacaccgguagauucaaaaucaugggccuugaaauucgacgaagaagacauugacgcgaaacuacaaaaaauacucccagagauggaugaaaaucagcaaucaauaauagcaauauuacaaaacuuauacagccaaguaacguuaaaccaaauaguaccaaauggcaugagccuaucagaaaguaugauagaaaaauauaacgaucaccacgaucauuuaaaacuguauaaaaaaauaauagaucaacuagccgacccaaaaaaaaaagcagccuugaaaaaagccuacagucaauauguaggugaugauggaaaaguaaucgaacaagcugacuuuuggagcagcguuaaaaaaaaucuagaugacucugauuuaucgaaacagaucauggauuugauugacgcagaaaaauucaugccaaaacaaagaacaagccaaaauggcguaauaccacaucaacuacaccaacgcgaauuagacgaaauuauagaacaccaaagcaaguauuacccgugguuagcagaaauaaauccaaacaaacaugaccuacauuuagcaaaauacaaaauagaagaauuaguagccuuccgagugccuuacuauguagguccaaugauaacuccggaugaucaagcaaaaucugcggaaacuguuuucuccuggauggaaagaaaagggaaagaagccggacaaauuacaccauggaacuuugaugaaaagguagacagaaaugcaucagcgaauagauuuauuaaaagaaugacaacaaaagauacuuaucucauaggugaagauguacuaccagacgaaagcuuguuauaugaaaaauuuaaagucuuaaacgaacugaauaugguccguguaaauggaaaacugcuuaaaguugcggacaaacaagcaauauuucaggauuuauucgaaaacuauaaacauauaucgguaaaaaagcuacaaaacuauauaaaaucaaaaaccggucuaccaagugaucccgaaauaucaggacucucagaucccgaauacuuuaacaacucuuugggaacauacaaugauuucaaaaaacuuuucggaaauaaaguagaugaacccgaccuccaggacgacuuugaaaaaauugucgaauggucaacuguguucgaagacaaacgaauucuucgagaaaaauuaaacgaaauuaccuggcuuagugaccaacaaaaagauguauuagaaaguucaagauaccaaggguggggacgauugagcaaaaaacuucucaccggaaucguaaacgaccaaggagaaagaauaauagacgaacuauggaacacgaacaaaaauuucaugcaaauacaaagugauaacgacuuugcaaaacguauacaugaagcaaacgccgaucaaaugaaagccguagacguagaagauguccuagcagacgcauauacaagcccacaaaauaaaaaagccauaagacagguaguuaaagugguagacgauauacaaaaagcaaugggcggaguagcccccaaauacauaucuauagaauuuacccguuccgaagaucggaaccccagacguacaauaaguagacaaagacaacuagaaaacacgcucaaagauacggcuaaaucucuagcaaaaucaauaaauccugaacuauugagugaacuugauaacgcugcuaaauccaaaaaagguuuaacggaccgacuauauuuauacuuuacacaauuagguaaagauauuuacacaggaaaaccaauaaacaucgaugaaauaagcacauacgacauagaucacauacuuccccaagcguucguaaaagacgacuccuuaaauaacagaguacuaguuaguaaagcaauaaauaacgguaaaucugauaauguacccguucaacuuuuuggugcaaaaaugggacauuucuggaaacaacuagccgaagccggguuaauauccaaaagaaaacuaaaaaaucuacaaacugacccagacaccaucucaaaauaugccaugcacggauucauuaggagacaacuuguugaaacaagccaaguaauaaaacucguugcaaacauacuaggagacaaauaccguaaugacaacacuaaaauuauagaaauaacugcgagaaugaaucaucaaaugcgugaugaauucggguuuauuaaaaacagggaaauaaacgacuaccaccacgcauuugacgccuaucuaacggcauuuuuggggagauaccuauaucacagauauaucaaacuacgaccauauuucgucuacggagauuuuaaaaaauuuaaagaagacaaaguuacaaugcgaaauuuuaauuuucuacacgaccuaacugaugacacgcaagaaaaaauagccgacgccgaaacgggagaaguaauaugggacagagaaaauagcauccaacaacuaaaggauguauaccauuauaaauuuaugcuaaucagucaugaggucuauacccuccguggggccauguucaaucaaacaguuuacccagcuucagacgcagguaaaagaaaacuaauucccauuaaagcugauagaccuauaaacguauacgggggauauuccggcuccgcugaugcuuacauggcaauaguuaggauacacaauaaaaaaggggauaaauauagaguaguaggugucccaaugcgagccagagacaggcuagacgcugccaaaaaaguuucagaugcugacugcgacagagcauugaaggauguacuuacgccacaacuaacaaaaacaaaaaaauccagaaaaacgggagaaaucacgcaggucguugaagauuuugagauagucuugggaaaagucauguauaggcaauuaaugauugacggugacaaaaaauucaugcuuggaucaucaacguaccaauacaacgccaaacaacuuguauugucagaucaaucggucaaaacacuagcuucaaaaggaagacuagauccgcuccaagaaucaauggauuauaacaauguuuacacagaaauauuagauaaaguuaaccaauauuucucucuauacgacaugaacaaguuuagacauaaacuaaacuugggauucucgaaauucauuucguuucccaaucauaacguauuugacgguaacacaaaagcaucaucaggaaaaagagaaauccuagaagaaguauuaaauggacuccacgcaaacccaaccuucggaaaucuuaaagacauagguaucaccacaccauucggucaauuacaacaacccaacgguauccuucuuagcgaugaagcaaaaauacguuaccaaucaccaacaggucuauuugagcguacuguauccuuaaaagaucuauga

SEQ ID NO: 5464 - RNA, 4116 nt, Artificial Sequence
  Cas9 variant
auggacaaaaaguacaguauaggccuagauauaggaacaaauaguguaggaugggccguaauaacagacgacuauaaagugccaucaaagaaauucaaaguucuaggcaauaccgauagacauucuauaaagaaaaaccuaauaggcgcuuuacucuucgauucgggagaaaccgcggaagcgacacgacuaaaaagaacagcccgcaggcgcuauacuagaaggaaaaaccgaauccgauaucuacaagaaauuuucucaucugaaaugagcaaagucgacgacucauucuuucacagauuagaagaaucauuuuuaguagaagaagauaagaaacaugaaagacauccuauauuuggaaacauuguagacgaagucgccuaucaugaaaaauacccaacaauauaucaucuccguaagaaauuagccgauucaacagauaaagcagaccuacgacuaauauaucuugcuuuagcacauaugauaaaauucagaggacauuuccuaauugagggcgaccugaaccccgauaacagcgauauggauaaauuauucauccaacuuguucaaacauacaaucaacuguucgaagaaaauccaauaaacgcaucuagaguugacgcaaaagccauccuuucagcaagauuaucgaaaagucgacgacuugaaaaucuuaucgcucaacuacccggagagaaaagaaauggauuauuugggaaucuaauagcacuauccuuaggucuaacaccaaacuuuaaaaguaacuucgauuuagcugaagacgcaaaauuacaacuuucaaaagauacauaugaugacgaccuggacaaccuauuagcucagaucggugaucaauaugcagaucuauuucuugcugcuaaaaaccuguccgacgcaauuuuacuaagugacauacuaagaguaaacucugaaauaacaaaagcuccccuuuccgccucuaugaucaaaagauacgacgaacaccaucaagaccuaacacuacucaaagcauuaguaagacaacaacucccggaaaaauauaaagagaucuucuuugaccaaucuaaaaacgguuaugcugguuauauugacgguggagcgucacaagaagaguucuacaaauucauaaaaccaauauuagagaaaauggauggaacugaagaauuauuagcuaaacucaaucgugaagaccuacuuagaaagcagagaacauucgacaacgggucaauaccacaucaaauacaucuaggcgaauuacaugccauacuaagacggcaggaagauuuuuauccauuccuaaaagacaacagagagaaaauagaaaagauuuuaacauucagaauacccuauuauguaggaccacucgcaagaggcaacucgagauucgcauggaugacacguaaaagugaagaaaccaucacaccauggaacuuugaagaaguaguagacaaaggagccagugcccagucuuucauugaaaggaugacaaauuucgacaaaaaccuaccaaacgaaaaaguacuaccuaaacauucgcuauuauaugaauauuuuaccguauacaacgaauuaacuaaaguaaaauaugugacagaagguaugcguaaaccagaauuuuuaucggguaagcaaaaagaagcgauuguagaccuccuauuuaaaacaaauagaaaaguaacaguaaaacaacuuaaagaagauuacuuuaagaaaauagaaugcuucgacaguguagaaauauccggaguagaagaccguuuuaacgcaagucuagguacauaccaugacuuauuaaaaauuauaaaagacaaagacuuucuugacaaugaagaaaaugaagacauccuugaagauaucguauuaacgcuuacgcuauuugaagauaaagaaaugauagaagaacgccuaaagaaauaugcaaauuuauucgacgacaaagugaugaaacaacuaaaacguagacauuauaccggcuggggaagacuuucacgaaaauugauuaauggaauaagggacaaacaguccggaaaaacaaucuuagacuuucuaaagagugacggcuucgccaaccgaaacuuuaugcaauuaauaaacgacgauucuuugaccuuuaaagaggcaauacagaaagcacaaguaucaggucaaggccacucauuacaugaacaaauagcaaacuuagccggcagcccugccauaaagaaaggaauacuacaaagcguuaaaguaguggaugagcuagucaaagucaugggacacaaacccgaaaacauaguaaucgagauggcuagagaaaaucaaacuacccagaaaggacagaaaaauucacgugagcggaugaaaagaauagaagaaggaauaaaagaacucggaucacaaauuuuaaaggagcacccuguagaaaacacucaauuacaaaacgaaaaauuauaucuguacuaucuacaaaauggacgagacauguauguugaccaagaauuagacauaaaucgacuaagcgacuaugacguagaccauauuguaccacaaucauucauaaaagacgauucaauagauaauaaaguacucacacgaucagacaaaaacagagggaagucagacaauguacccucagaagaaguagucaaaaagaugaaaaauuauuggagacaacuguuaaacgccaaauuaauaacacaaagaaaauuugacaaccuaacuaaagcagaaagaggaggacuaagcgaacucgauaaagcagguuuuauaaaacgccagcuaguagaaacacgacaaauaacaaaacauguugcucaaauuuuggacucacgcaugaacaccaaguaugacgaaaacgauaaacucaucagagaaguuaaaguaaucacucuaaagucuaagcuaguaucagauuuucguaaagacuuccaauuuuauaaaguccgugaaauaaacaauuaucaucacgcccacgacgcauacuuaaaugcaguuguugguaccgccuuaauuaagaaauacccaaaacucgaaagcgaauuuguauacggcgacuauaaagucuacgauguuagaaaaaugauagcuaaaagcgaacaagagaucggcaaagcgacagcaaaaagauucuuuuacucaaauaucaugaauuucuuuaaaaccgaaauaacgcuugcaaauggagagauaagaaaacguccacuuauagaaacaaacgaagaaacuggggaaaucgugugggacaaaggaagagacuuugcuacaguuagaaaaguucuaagcaugccacaaguuaauauugugaagaaaacugaaguacaaaccggagcuuuaacaaacgaaagcauauacgcaagaggaucauuugacaaacuaauauccagaaaacacagauucgagucaucuaaauaugguggauucggaagcccaacagucacauacucaguacugguaguagcaaaaagcaaaguacaggauggcaaaguuaagaaaauuaaaacagguaaagaacuaaucggaaucacguuauuggauaaauugguauuugagaaaaauccucuuaaauucauugaagauaaaggauacggcaauguacaaauagauaaauguauaaaacucccaaaauauagcuuauucgaauuugaaaauggaacuagaagaaugcuagcaaguguaauggcuaacaacaauagcagaggagauuuacaaaaagcgaaugaaauguuccuaccagcaaaacucguaacacuacucuaccaugcacauaaaauagaauccagcaaagaauuagaacaugaagcauauauauuagaccacuauaacgaccucuaccaacuuuuaaguuacauagaaagguucgcaagucuguacguagacguagagaaaaacauuaguaaaguuaaagaacuauucagcaauauagaaaguuacagcaucucagaaaucugcucuagcguaauuaaucuacuaacgcuaacagccaguggugcgccugcugauuucaaauuccuaggaacaaccauuccuagaaaaagauauggaaguccacaaaguauuuuaucaucuacccuaauucaucaaucaauaacaggacuauaugaaacgcgaauagaucuaagccaacuaggaggggacuga

SEQ ID NO: 5465 - RNA, 4116 nt, Artificial Sequence
  Cas9 variant
auggacaagaaauacagcauaggucuagacauuggaacgaacucuguaggaugggcagugauuacagacgacuauaaaguuccaucuaagaaauuuaaagugcuaggcaacacugaucgacauaguauaaagaaaaacuuaaucggcgccuugcuauucgacucuggcgaaaccgcugaagcaacaaggcuaaaaagaacagcaagaagaagguacacaagaaggaaaaacagaaucagguaucuacaagaaaucuuuuccagcgagaugucaaaaguagacgauaguuucuuccaucggcuugaagaaucuuuccuuguagaagaagacaagaaacaugaaagacauccuauuuuuggaaauauuguggacgaaguagcauaccacgaaaaauauccuaccauuuaccauuuacgaaagaaauuggcagauaguacagauaaagcagauuuaagauuaauauaucuagcuuuagcccacaugaucaaauuuagaggacacuuucuaauagagggagaccuaaaucccgacaauagcgacauggacaaacuauucauacaauuaguccaaacauacaaccaauuauucgaagaaaacccaauaaaugcgucacguguagaugcuaaagccauccuuagugcaagauuaucaaaaagcagaagauuagaaaaccuaauugcacaacugccaggugagaaaagaaacggacuuuuuggaaaccuaaucgcacugucuuuagggcucacaccaaauuucaaaucaaauuucgaccuggcagaagacgccaaauuacaacuaucuaaagauacauacgaugacgaccuugauaaccuacuagcacaaauaggugaucaauaugcggacuuauuuuuagcugcgaaaaauuuaucagaugcaauacuguuaagugacauuuuaagaguaaacucugaaauaacaaaagcaccauuaagcgcaucaaugauaaaaagauacgacgaacaucaccaggaccuaacacuacuaaaagcccuaguaaggcaacaacuaccagaaaaauauaaagaaauauuuuucgaccaaaguaaaaauggauacgccggauauauugauggaggagcaucccaagaagaauuuuacaaauuuauaaaacccauuuuagagaaaauggacgguaccgaagaacuauuagcaaaauuaaauagagaagauuugcuucgaaaacaaagaacuuuugacaacggcucuauaccgcaucaaauacaucuaggugaauuacaugcuauauuaagacgccaagaagauuucuauccauuucuuaaagauaacagagagaaaauagagaaaauacugacauuuagaauaccuuacuauguaggcccacuugcuagggguaauucacgauucgcauggaugacaagaaaauccgaagaaacgauaacaccauggaacuuugaagaagucguugacaaaggcgccucugcacaauccuucaucgaaagaaugacaaauuuugauaaaaaccuaccaaacgagaaaguguuacccaagcacucucucuuauaugaauacuuuaccgucuacaaugaacucacaaagguaaaauaugucacagaaggaaugcgaaaaccagaauuucuaucagggaaacaaaaggaagcuaucgucgaucucuuauucaaaacaaacagaaaagucacagugaaacaguuaaaggaagacuauuuuaagaaaauagaauguuuugacagcgucgaaauaaguggagucgaagaucgauucaaugcaucacuuggcacauaucacgaucuuuuaaaaaucauaaaagacaaagauuuucucgauaacgaagaaaaugaagauauucuugaggacauuguacuaacauuaacacuauucgaagacaaagaaaugaucgaagaacgacuaaaaaccuacgcucaucuauucgaugauaaggucaugaaacaacuaaaaagacgacauuacacaggauggggaaggcuaucaagaaaauuaauuaacggaauaagagacaaacaaucaggaaaaacaauauuagacuuucucaaaucagauggauuugcuaaucguaauuucauacaauuaauacacgacgauucacucacguucaaagaagcuauacaaaaagcucaagucuccggucaaggacacagucuacacgaacaaauagcaaaccuagcaggaaguccugccauaaagaaaggaauccuacaaucagugaaaguaguugaugagcucguaaagguaaugggacauaaaccagaaaacauagucaucgagauggcaagagaaaaccaaacaacacaaaaaggacagaaaaauucaagagaaagaaugaaaagaauagaagagggcauaaaagaacuagggucgcaaauacuaaaggaacacccuguggaaaacacacaacuacaaaacgaaaaacuauacuuauacuaccuucaaaacggcagagauauguauguugaucaagaacuugauauaaaccgccuaagugauuaugacguugaucauauagucccacaauccuucaucaaagacgauuccauagacaauaaaguacuuacaagaagcgacaaaaauagagguaaaucagacgacgugccaucugaagaaguugugaagaaaaugaaaaacuacuggcgacaauuguuaaacgcgaaacucaucacacaaagaaaauucgacaaucuuaccaaagcagaaagagggggauuaucggaacuagacaaagcaggcuucaucaaaagacagcuuguagaaaccagacaaaucacuaagcauguugcucaaaucuuggacucgaggaugaauacuaaauacgacgagaacgauaaacugauuagagaaguaaaaguaauaacucuaaagucuaaauuagugagugacuucagaaaagacuuucaauucuauaaaguaagagaaauaaauaauuaccaucacgcucaugaugcauauuuaaacgcaguaguagggacggcauuaauaaagaaauaucccaaauuagaaucagaguucgucuauggugauuauaaaguauaugacgucaggaaaaugauugcaaaaagcgaacaagaaauugggaaagcaacugcaaaacguuucuucuacucaaacauaaugaauuucuuuaaaaccgaaaucacucucgcaaauggagaaauccgaaaacgaccacuaauugagacuaaugaagaaacaggagaaauuguguggaacaagggacgcgacuucgccaccguaaggaaaguacuaaguaugccccaaguaaacaucguaaagaaaacagaaguucaaacaggagcuuuaacuaacgaaucgauauaugcgcguggaucauuugauaaauuaauuucaagaaaacaucgauuugaaucgagcaaauacggaggauuuggaagcccaacagucacauauucuguauuaguuguagccaaaucaaaaguccaagaugggaaaguaaagaaaaucaaaaccggaaaagaauuaaucgggauuacauuacuagauaaacuuguauucgagaaaaacccacuaaaauuuauagaagauaaaggauauggaaacguccaaauagauaaaugcauaaaacuaccaaaauauaguuuauuugaguucgaaaacgggaccagacguaugcucgccucgguaauggcuaauaacaauucaagaggcgacuuacagaaagccaaugaaauguucuuaccagcgaaauuagucacacuacuguaccacgcccacaaaaucgaauccucaaaagaacuggaacacgaggcuuacauccuugaccacuacaacgaccuguaucaacuacuaucuuauaucgaacgauucgcaucauuauacguagacgucgaaaagaacauaagcaaaguuaaggaauuguucucuaauauagaaaguuacucuauaucagaaaucuguucgagcguuauaaacuuacugacauuaacggcaucaggagcacccgcagacuucaaauucuuaggaaccacgauaccacgaaaacgauacggaucaccgcaaucaauuuugucaucaacacuaauacaccaaucaauaacuggccucuaugaaacuaggauagauuuaucccaacuaggaggagacuga

SEQ ID NO: 5466 - RNA, 4116 nt, Artificial Sequence
  Cas9 variant
augaacaauaacaacuauaguauaggccuagacauaggcacaaacaguguagguugggcaguaauaacggaugacuauaaaguaccaaguaaaaaaaugcgcguacugggaaauacagacaaacguuucaucaagaagaaucuaauaggcgcucuccuauucgaugaaggaaccacagcagaagacagaagauuaaaaagaacagcacgccgacgauauacuagaaggaaaaacagacuaagauaccuucaagaaaucuucgcugaagaaaugucuaaagucgauucuaguuucuuucacagacuugaugacaguuuucuaguuccagaggauaagucagguucuaaauauccuaucuuugcaaccuuggcugaagaaaaagaauaccacaaaaaauucccgacuauauaccaucuaagaaaacaccucgccgauucaaaagaaaaggcagaucuaagacuaauauaucuagcgcuagcucacauuaccaaguaccgcggccauuucuuguacgaagaagccuuugauauuaaaaacaacgacauccagaaaauauuuaacgaauucaucaacauauaugauaauacauucgaaggcucuucacuuucugggcaaaacgcccaaguagaagcaauuuucaccggcaaaauaagcaaauccguaaaacgagaacacguacuaaaauuguuuccggaugaaaaaucgaccggacuauuuucagaguucuuaaaacugauaguaggaaaccaagccgauuucaagaaacauuucgacuuggaagaaaaagccucacuacaauuuagcaaagauacguaugaugaagaucuggaaaaucuacucggacaaauaggcgacgacuuugccgaccuauuccugguagccaaaaaauuauaugacgcaauccuccuauccggaaucuuaacgguaaccgauccauccacaaaagcucccuuaagugccucaaugauagaacgauaugaaaaccaucaagaagacuuagccgcccuuaaacaauucaucaaaaacaacuuaccagaaaaauacgcggagguuuuuagcgaccaguccaaggauggcuaugccgguuauauagacggcaagacuacucaagaagccuuuuacaaauauauuaaaaauuuauuauccaaauucgaaggcgcagauuacuuucuagacaaaauagaaagggaagacuuccuacgaaaacaacggaccuuugacaaugguaguauaccccaccaaauacaccuccaagaaaugaacgcgauacuaaggcgacaaggagaacacuauccccuacuaaaagaaaauaaagaaaaaauagagaaaauauugacauuccgaauaccauauuacguaggaccacuagcaagaggaaacagggauuucgcuugguugacaagaaacagcgaccaagcuaucaggcccuggaauuucgaagaaauugucgauaaagccaguucagcagaaucuuuuauaaauaaaaugacaaauuaugaccuauaccuaccugaagaaaaaguauuaccuaaacauagucucuuauaugagacauucgcuguauauaacgaacuaacuaaaguuaaauuuauagcggaaggccuaagagauuaccaauucuuugacucaggccaaaaaaaacaaaucguaaaccaauuguucaaagagaaaagaaaaguaaccgaaaaagauauuauacauuaccuacauaaugucgacgguuacgacggaauugaacugaaagggauagaaaaacaauucaacgcaagucuaucaaccuaucacgaucuauuaaaaauaauaaaggacaaagaauucauggauaaccauaaaaaccaagaaaucuuagaaaauauaguacacacccuaacaauauucgaagaccgagaaaugauuaaacaaaggcucgcacaauacgauuccauauucgacgaaaaaguaauaaaggcgcuuacaagacgccauuauaccggauggggaaaacucagcgcaaaauugaucaauggaauuugugauaaaaaaacaggcaaaaccauuuuagacuacuuaauagacgacgguuauaacaaccgaaauuuuaugcaauuaauaaaugaugauggcuuaucauucaaagaaaucauacaaaaagcccaaguaguuggaaaaacagaugacuuaacucaaguuguuagagagcuaucgggaaguccagccauaaaaaaagggaucuuacaaucgaucaaaauaguagaugaacuagugaaaauaauggguuacgcaccagaaagcauagucauugagauggccagagaaaaccaaacaacugcaaaaggaaaaaaaaacucacaacaaagauauaaacggauagaagaugcauuaaaaaacuuagccccaggucucgauucaacgauuucaaaagaaaauccaacagauaacauacaacuacaaaaugaccgacuuuuucuuuacuacuuacaaaacggaaaagacauguacaccggagaggcacuugacauaaaucaguuauccucguacgacauagaccauauaauaccucaagcauuuaucaaagacgacucccuagacaaucguguccucacaucuucuaaagauaauagaggcaagagcgauaacguaccaucacuagagguaguaaaaaaaagaaaagcauuuuggcaacaacuacuggacuccaaacuaauaucagaaagaaaauucaacaaccuaacuaaagcagaacgcggaggacuagaugaaagagacaaaguagguuuuaucaaacgccagcuaguagaaacaaggcaaauaacgaaacacguugcgagaauacuagaugcacgauuuaacacagaaguaucggaaaaaaaucaaaaaauuagaucaguaaagaucaucaccuuaaaaucaaauuuagugaguaauuuccgaaaagaauucaaauuauauaaaguaagagaaauaaaugauuaucaucaugcacaugacgcauaucuaaaugcaguaguugccaaagcuauacuaaaaaaauacccaaaauuagaacccgaauuuguuuacggagauuaccaaaaauacgaccuaaaacgauacaucucaaaaucgaaagacccuaaagaaguugagaaagcaacagaaaaauauuuuuuuuacaguaaccuucuuaacuucuucaaagaagaagugcacuacgcagacggaacaaucguaaagagggaaaauauagaauacucaaaggauacaggcgaaauagcuuggaauaaagaaaaagacuucgugacuaucaaaaaaguacuaucauacccucaaguaaacauugucaaaaaaagagaaguacaaacagguggauucucgaaagaaucgauacuuccaaaaggcaauuccgauaaacuaauaccgcgaaaaacaaaagacauacuaugggacaccacaaaauauggaggauuugacucuccaguaauagcuuacaguaucuuacucauugcagacauugagaaagguaaagcaaagaaacuaaaaacagugaagacucuaguaggcaucacaauaauggaaaaagccgccuuugaaaaaaaccccauaacguucuuagagaauaaaggauaucauaauguuagaaaagaaaacauacuaugcuuaccaaaauauagccuauuugagcuagaaaauggaagaagaagacuguuggcuagcgcaaaagaauuacaaaaaggaaacgaaauuguacuuccugucuaucuaacaaccuuauuauaucacucaaaaaauguucacaaauuggacgaaccagaacaccuggaguacauucaaaaacacagguacgaauucaaggaucuuuuaaauuuagucuccgaauuuucacaaaaauacguccuugcagaagcaaauuuagaaaaaauaaaaucccuauacgucgauaaugaacaagccgauaucgaaauccucgcaaacucguucauaaaucuacuuacauuuacagccuuaggcgcuccugccgcauuuaaauuuuucgguaaagacguagacagaaaaagauacaccacgguuucagaaauucuaaacgccacacuaauacaccaaucaauaacaggcuuauaugaaacccggauagaucuuucaaaacuaggcgaagauuga

SEQ ID NO: 5467 - RNA, 4116 nt, Artificial Sequence
  Cas9 variant
augacagagaaaaacuacucuauaggucuagacaucggaacaaacucuguaggaugggcaguaauaacggaugacuauaaagugcccgccaagaaaaugaaaguacuagguaacaccgauaagaaauacaucaagaaaaauuuauuaggagcacuacuguucgacaauggagaaaccgcugaagcgacgcgacuaaaaagaacagcacgacgcagguacacccgaaggaaaaaucgacuaagauaucugcaggaaauuuucgcagaagaaauggcaaaaguagacgagagcuucuucuaccgucuugacgaaucauuccuaacaacagacgacaaagauuucgaaagacacccaauauucggaaacaaagccgacgaaauaaaauaccaccaagaauuuccaaccauauaccaccuaagaaaacacuuagcagauagccaugaaaaagcagaucugcgccuaauauaucuagccuuagcacacaugauaaaauuucgaggccacuuuuuaauagaaggugaacuaaaugcugaaaacacggacguacaaaaauuauuugaagcauucguagaaguauacgauagaaccuucgacgauagcaauuuaagcgaaauaacaguagaugcgagcucuauuuuaaccgaaaaauucuccaaauccagaaggcuugaaaacuuaauuaaacauuauccuacagaaaagaaaaauacauuauucgggaacuuagucgccuuagcauuaggccuacaacccaacuuuaaaacauccuucaaauuaucagaagacgcaaaacuacaguucucuaaagauacauaugaagaagacuuagaagaacucauaggaaaaauaggagaugaauaugcagaccuauuuacuucagcuaaaaaccucuaugacgcuauauuguuaagcggaauacuaacgguggcagauaauaccaccaaagcaccccuaagcgcgaguaugauuaaaagguauaacgaacaccaaguagaucuaaagaaacuaaaagaguucauuaaaaacaacgccagugauaaauacgacgaaauauucaaugacaaagacaaaaaugguuaugcaggauacauagaaaaugguguaaaacaagaugaauuuuacaaauaccuaaaaacuacccugucaaaaauagauggcucggacuauuucuuagauaaaauagaaagagaagauuucuuaaggaaacagcgcacuuucgacaacggcaguauaccacaucaaauacaucuucaagaaaugcacgcuaucuuacgccgacaaggagaacauuaugccuuccuuaaagaaaaucaggcaaaaaucgagaaaauacuuacauuucgaauacccuauuacgugggaccauuagcccggaaaaacagcagauuugcaugggcagaauaucauucagaugagaaaauaacuccauggaauuucgaugaaauaauugauaaagaaaaaucugccgaaaaauucauuacaagaaugacacuuaaugaucuauaucugccagaagaaaaaguuuuaccaaaacacagccucgucuaugaaacauauacaguauacaaugaacuuacuaaagucaaauacguuaacgaacaaggcaaaucuaacuuuuucgacgcuaauaugaaacaagaaauauuugaacauguauucaaagaaaaccgaaaaguaacaaaagacaaauuucuuaauuaccuaaacaaagaauuuccugaauaucgaauacaggacuuaauaggauuagacaaagaaaauaaaucuuucaacgcuagucucgguacguaucaugacuuaaagaaaauacuugauaaaucauucuuagaugauaaaacaaaugaaaccaucauagaagacauaauucaaacuuuaacauuauucgaagacagagauaugauccgucaacgucuacaaaaauacucugauauauucacaccccaacaacuaaagaaauuggaaagaagacauuacacagguuggggaagauuaucauacaaauuaauuaacggaauacgcaacaaagaaaaugggaaaaguauuuuagacuaucuaauugaugacgguuacgcgaacaggaacuucaugcaauuaauaagugacgacacgcuacccuucaaacaaauaauaaaagaugcacaaauuauaggagauauagaugauguaaccucagucguacgagaacucccaggaucccccgcaaucaagaaagguauauuacaaagugucaaaaucguugacgaauugguaaaaguaaugggccacaauccagauaacauaguaauagaaauggcgcgcgaaaaucaaacaacaaacagaggaagaaaucaaucacaacaaagacuuaagaaacuccaagauagccuaaaagaauuagguagcaauauccuaaacgaagaaaaaccaucauauauagaagguaaaguagaaaacaaucacuuacaggacgaccgacuauuucuauacuacauacaaaacgguaaagauauguacacaggagacgaauuagacaucgaccacuuaucagacuaugacauagaucauauaauuccucaagcauuuauaaaagacgauuccaucgacaauagaguucucacaagcagugccaaaaauagaggcaaauccgacgacguacccucgcuugauauaguacaugauagaaaagcugacuggauacgacuauacaaaagcggguuaauaucaaaacgaaaauuugauaaccuuacuaaagccgaaagagguggacuaacagaaaacgacaaagccggauuuauaaaaagacaauuaguagaaacgagacaaauaaccaaacauguugcacaaauauuagacaguagauuuaauacugaaagagacgaaaaugacaaaguaauuagaaaugucaaaguuaucacauuaaaaucuaaucuagucagucaauucagaaaagauuucaaauuuuacaaaguaagagaaauaaaugacuaucaccaugcacaugacgcuuauuuaaaugcuguaguagguaccgcccuauuaaagaaauacccuaaauuagcacccgaguucguauacggagaauacaagaaauaugauauucgaaaauuuauuaccagcuccggugauaaagcaacagcaaaauauuucuuuuauucuaaucuaaugaacuuuuucaaaagaguaaucagauacaguaacgguaaaguaguaguaaggccaguaauagaaugcaguaaagacacaggugaaauagcauggaauaaacaaacagacuucgaaaaagucagacgggucuuaagcuauccccaaguaaauaucgucaagaaagucgaaacccaaacagggggcuuuagcaaagaaaguauauuaccuaaaggcaacagugacaaacuaauuccaaggaaaacaaagaaauuucggugggacacaccaaaauacgguggauucgauucgccaaacaucgccuacaguguauucguaauugccgacguagaaaaaggaaaagcuaagaaacugaaaaccgucaaagaauuaguugguauaaguaucauggaacgaucuaguuucgaagaaaauccugugguauucuuagaaaagaaaggauaccaaaauguacaagaagacaaccuaauaaaauuacccaaauauaguuuguucgaguucgaaggaggcagaaggcgucuacuugcgagugcaucugaauugcaaaaagggaacgaagucguauuaucuagacaucuaguagaacuauuauaucaugcgcaccgagucaacucauuuaauaauagcgaacaucuaaaauacgucuccgaacacaagaaagaauuuggagaaguauuaucaugugucgagaacuucgcaaaaucuuaugucgacguagagaaaaacuuagggaaaauucgcgccguagcagauaaaauagauaccuuuuccauagaagauauuagcauaucauuuguaaauuuauuaacacucaccgcacuuggagcccccgcugacuuuaacuuucugggugagaaaauuccgagaaagagauacacaucaacaaaagagugccuuaaugcaacucuaauacaccaaagcaucacaggucuauaugaaaccagaauagaucuaucgaaauuaggugaagaauga

SEQ ID NO: 5468 - RNA, 4116 nt, Artificial Sequence
  Cas9 variant
augaauuuaagaaauguugaaagcuaucaagucggacuagacauugguacaggaaguguaggcugggcaguccuagacgacaauggugauuuauguagauuuaaaggaaaaccgaccuggggaucacgcguuuuucccacagcagaaacagcagcggaagcacgcguacacagagggcaaagacgaagauaugaucgaaggagacaaaggaucgauuuauuacaacguuucuuugcagacgaaguugcaaaagucgaccccgaguucuuuauccgacuuaaucaggccagacuucacccagaaaacagagacccugcucacgcggacuauagauggccacucuuuaacggaucaaacuuuacggaaaaagauuauuaucgacaauuuccuaccauuuaucaccuccgggcacacuuauuaaaaucagacgaaccagcagauauaaggcuugucuauuuagcacuacauaauauaguuaaacacagaggaaauuuucuacaucaagauaacccgagcuuaucagcucguaaugcuaacguuggagaugcgguggaagccuugugcuuggcauuggacgaauggugcggugcacaugacguagaaugugcgugugacgaagcugcgcuagcggaagcccuuggagacgcgagcuuacgaccaggggagaaaagggaacgugcagaagcagccuuaggggucgaaaaagcacauaagaaacucgcuaaagcaguuagcucagcagugguaggauaugcagcugaauuuggacauguauucuuugcagaaagugaagguaguaaauuugcguuaaguaacgacgaaaaaguagaagccuacguauguccggacgaaggaagagauuuguucgaugcgaugcgugccguccauaguucauacguucuaaugggaauauuaagcgaagcgcaaggagaauuacuaucaguauguaaaguaggagaauaugaacgauauaaaagggaccuugaaacacuuaaaucauuagugcgagcguaugguccagaaagguaugaugaguucuucugcggaccauuuuaugaaggaacuagagauuacgaccccggaaaagcgcaaggauacacaaaauauaaucucggagcuucaaaauuaucacacgaagacuuuuuaaaagaagugcaaaaauuacuaaaagauaucggagcacaagcagaugaacgauacgcugacaucgaaagagcaauagaagccggugcauuccuaagacgguuaaaaacuucagacaaugguacuauccccuaucaauuacaucuggaagaaauggaugcgauaauagaaaggcaagccgcauuuuauccguuucuggcacaagaaaaagauaaacuaaaaagucuaguaucauuucguauaccauauuacguuggaccauugacacaaaagaaugcugcuagagacggaaaaggagaagcaagauuugcauggucaagccguaaaccagggauggaagacgcgcgaguauacccuuggaacugggaagauguaaucgacaaagaucaauccgccgaagauuuuauaagaagaaugacagggacgugcacauaucuaaaaggagaaccagugcuugcgcgauguucacuggauuaugaauuauuuugcguucuuaacgaauuagcgggagcuagauggacccaagacggcgauaaaagcuauagauucgaugcugcagauagacuaggaauuguagaagauuuauucaaaaagaggaagcgagucacauacgaagcagcagaaaaauggcuugcucgaacacauggacccgagucaggaaaauccgcaggaggagcuuaucauguaucugggggucaaggagaagaugcuuucgaaagccaauuaagcagucauuaugauuucuguaagauucuaggcguagaugaacuaagugaugcagacgaagcuauggcagaagacaucauauuauggaacaccguuuuugaagacagaaguauacucaaacggaaaauaaaacuagccuacggagacagguugggagacgcacagguaagaaaacucugucagaaaagguauaccggauggggcagauugaguggugaacuacuacgcggacuuaggucagccacagauaaugguccaaaaacaauaauggauauuuuguuagaaggggauccuaaccaugcaagaaggaugggugcagcgaugaaucuuauggaaauccuccacgaugauuugcuagaguuucaagcaaaaaucgaugaacauaauagagagagagcacuagcgguagguggcaugagcguugaugaggugacggggaguccggcguuaagaagaggaauaaaucaagcgcuacguguaguugaugaaaucgcaggaauugcaggcaaaccacccgcacauauauacguggaaguaacucgagaugaaggagcaagaaauaaaggacguagaacaacaagucgauacagagcuuuagaagcagcacuaaguaguaucaaagcacaaugugcugauguuuaugcagaauuaaaggaaagagaucccagagcacuugaugaugaaagauugaccuuauauuuuaugcaaugugggaaguguauguauucuggagaugcacuagauaucaacaaacuacaaacuuaucaaguugaucauauacuaccacaaucauacguaaaggaugauaguuucgaaaacaagguacucgucagaccagauacaaaccaacgaaaaggggauacucuguuauuggaugaaagacucauagcacgaaugaggggauuuuggagaacauuaagagacgcagaauuaauaggggaaaagaaauuuaauaauuuaacgcgaacaaguguaagugaugaacaaaugaagaaauucguaagcagacagcuuguagaaacuggucagaugguuaaacaaguacagcaacuauugcaagcaagauacccagagucagaaguacaaccaguaaaagcuggaguaucucaccaguuaaggguagggugugcacuugcaaaaagcagagaaauuaaugacuuccaucaugcacacgaugcauaucuggcaugucaaguggguagauuuguacaguaucgacauucagcaguauauucagaacccguuaaaauggcagcgguugugaaacaauuuauaaagaaacaggcagaagauuaucgacguacucgugaacuaccagguagugauggauuuauuguaagcuccuucaugacaccagguuucgauguaaaaacaggugaaguauuuagagaugcaugggaugcuggggcugaaauagaccgaauuagaagaugcuuugauuauaaagacugcuuuaucaguagaaugccagaagagacccacggggcauucugggacgcaacuauuuacucaccgagagcugccggaaaaacuuuaagccuaccucuaaaaagaggucuugauccucgaaaauacggaaguuacaguagagaacaauuugccuacuuuuucguuuacgaagcaguaaagccuaaaaagaaacaaagaguacuagaauuugcuccagucccaguuagaguugcaagcgccuuagcaaaugauccagaugcacuagaagacuaugcaagggaacucgcugaagcggaagggcuaguuuucgaaagaauacgaaggcgaaaaguuuacaaauaucagcaaauaaucguuggagacuccagauuauauguuacagggagagaagaagugagaaacgcccgacaacuagcauucucacaagacgaaacaaaacuaauaugucguaucgaacaaggggaagaaugugaagaaggcgaauuauuagacuuauuuagauccaugcaaaggaaauaccuagcgugugcaccgagacucgcucgauuaaugaaaguugcagaaauggaagaaggauuuauugcugcuacagcaucuggaaaaagagaaguauuauuaaguuugaccucaauagcugcagcacaccgaaauaguauugauuuaaaaccaauaggaagaaaaggaucuucaggacaaaugaaaaucacuuuuaguaaagaauuaucaacaaacgguauacuauucguugacucaaguguuaccgguauguuugaaagacgguguagacuuggauuauga

SEQ ID NO: 5469 - RNA, 4116 nt, Artificial Sequence
  Cas9 variant
auggaaaacaaaaacuacaguauaggauuagacaucggaaccaauucagugggcugguccguaaucacagacgacuacaaaguccccucaaagaaaaugaaaguauuagggaacacagauaaacguuuuauaaagaaaaacuugaucggugcucucuuauuugaugaagguacaacagcagaagcacgucgacuaaaacgaacagcccgacgucgcuauacacgcagaaagaaccgauuaagauaccuacaagagauauuugccgaagagaugucaaaaguggauagcucuuucuuccacagauuagacgacucuuuccuaaucccugaagauaaaaggggaucaaaauacccgauauucgcaacacuagcagaagaaaaagaauaucauaaacaauuuccaaccauuuaucaucuaaggaaacaacuugcagacucuaaagagaaaacagaccuaagacuuauauaucucgcacuagcccacaugauuaaauaccgaggacacuucuuauaugaagauacauuugauauaaagaacaacgauauucagaaaaucuuuuccgaguucauuagcauauaugauaacacauucgaaggcagcucauuaagcggccaaaacgcacaaguagaagcuaucuucacugacaagauaucuaaaucagcaaaaagagaacgaguucucaaauuguucccagaugagaaaaguaccgggcuuuucucagaauuucuaaaauuaauagucgguaaucaagcagacuucaagaaacauuuugacuuaggcgaaaaagcaccauuacaguuuuccaaagacaccuacgaugaagaccucgaaaacuuacucggacagauuggagaugacuucgcagaucuauucuuaguagccaagaaacuuuacgaugcaauauuauuaucagguaucuuaaccguuacagauccaucaacaaaagcuccauuauccgcaucuaugauugaaagauacgaaaaucaucaaaaagaccuagcaguacucaaacaauucaucaaaaauaaucugcccgaaaaauaugaugaaguuuucagugaccaaucaaaagacggcuacgcaggcuauauagaugguaaaaccacacaagaggcuuucuauaaauacauaaagaaucuauuaucaaaauucgaagguacagacuauuuccuagaaaagauugaacgagaagacuuuuuaagaaaacaaagaacauucgauaaugguaguaucccacaccaaauacaccuacaagaaaugaacgcaauccucaggaggcaaggugaacacuacccuuuccucaaggacaauaaagagaaaauugagaaaauacuaacauuccgaauaccauacuacguaggccccuuagcaagaggaaauagagacuuugccuggcuaacuagaaacuccgacgaagcaauacgcccauggaacuucgaagaaauaguugauaaagccucaucagcagaagauuuuauuaacaaaaugaccaauuacgaucucuacuuaccagaagaaaagguuuuaccuaaacacucccuccuauaugaaacuuuugcagucuauaacgaacuaacuaaaguaaaguuuaucgcagaagguuuaagagacuaucaauuccuagacucaggccaaaagaaacaaauaguaacgcaauuauucaaagaaaagcguaaaguuacugaaaaagacauaauucaauuccuacacaacguagacggauaugauggaauugaacuaaaagguauugaaaaacaauucaacgcaucccugucaacuuaccaugacuuguuaaaaauaauuaaagacaaagaauuuauggacgacuccaaaaaugaagaaauacucgaaaauaucguccacacauuaacaauauucgaagauagagaaaugauuaaacaaagacuagcacaauaugacucauuauucgaugaaaaaguaauaaaggcuuuaauaaggagacacuauacaggauggggcaaacuaucugcuaaacuuaucgacgguaucugugauaaacagaccggcaauaccaucuuggacuacuugauagacgaugguaaaaacaacagaaauuucaugcaacucauaaacgacgacggauuaucauuuaaagaaaucacucaaaaagcacaggucguuggcaaaacagaugauguaaaacaaguaguacaagaacugccugguagcccagcuauaaagaaaggaauauuacaaagcauaaaaauaguagaugagcuaguaaaaguaaugggccauacaccagaaucuaucguaaucgaaauggcuagggaaaaccagacaacagcacgcggaaagaaaaacucucaacaacgcuacaaaagaauagaagaugcccucaaaaaccucgcuucgggacuagauuccaacauucucaaagaacauccaaccaacaauauacaacuacaaaacgauagacuguuucuauacuaccuccaaaauggaagagauauguauaccggaaaaccacuggauauuaaccaauuauccucuuacgacauagaucauauaguaccacaagcauucaucaaagaugacucauuagacaauaggguucuaaccagcuuaaaagauaaccgagguaagucagacaauguaccuucaauugaaguaguucagaaaagaaaagcauucuggcaacaacuucuugacagcaaacuaaucucugaacguaaauucaacaaccuaacuaaagcagagagaggaggacuagaugaacgagauaaagucggcuucauaaagcgacagcuaguagaaacuagacaaauaacuaaacauguagcccaaauucuggacgcacgauuuaauaaagaagucaaugaaaaagacaagaaaaauagaacaguaaaaaucaucacacuaaaauccaaucuggugucaaacuuuagaaaagaauuucgacuauauaaaguacgagaaauuaacgauuaccaucacgcacacgacgcuuaccuuaaugccgugguagcuaaagcaauacucaaaaaguauccaaaauuagaaccggaguucgucuauggugacuaccaaaaauaugaccucaagagauacauaagccguucacgcaacccuaaagaagucgaaaaagcuacggaaaaguacuuuuucuauagcaauuuauuaaacuuuuucaaagaagaaguccauuacgcugauggaacaauaguaaaaagagaaaauauagaauauucgaaagacaccggagaaaucgcauggaacaaagagaaagauuuugccacaaucaagaaaguacucucauacccacaaguaaacauagugaagaaaagagaaguucaaaccgguggauucucaaaagaaagcauacucccaaaaggaaacagcgauaaacuaauacccagaaaaaccaaagacauacuaugggaaacuacuaaauacggagguuuugacucaccaguaauagcuuauaguauacuacucauagcagauauagaaaaagguaaagcuaagaaacuaaaaacugucaaaacccuaguaggaauaacaauaauggaaaaagcagcguucgaagaaaacccuauuacauuccuggaaaacaaaggauaccacaacguacgaaaagagaauauauuaugcuugccaaaauacucuuuguuugaacucgaaaaugguagaagaagauuacucgcaucugcaaaagaacugcaaaaagguaaugaaauaguauugccaguuuacuuaacuacucuuuuguaccauuccaaaaacguccauaaacucgacgaaccagaacaccuagaauauauccaaaaacauagaaaugaguucaaagaccuauuaaaccuaguaagcgaauuuucacaaaaauauguauuagcagacgcaaaucuugagaaaauacaaaacuuguaugcugacaacgaacaagcugacauagaaauccuagcaaacagcuuuauaaacuuguuaacauucaccgcauuaggcgcuccugcagcuuuuaaauuuuucggcaaagacauagacagaaaaagauacacaaccguaucagaaauuuuaaaugcaacacucauucaucaaaguauaacgggauuauacgaaacacgaauagauuuaaguaaauuaggugaagauuga

SEQ ID NO: 5470 - RNA, 4116 nt, Artificial Sequence
  Cas9 variant
auggacaagaaauacucaauaggccuagauauuggaacuaauucaguagguugggcaguaauaacugacgacuacaaaguuccuucaaagaaauucaaaguacuaggaaacacagacagacacucaauaaagaaaaaucugauaggugccuuguuauuugauaguggagaaacggcagaagcaacuagacuuaaacggacagcacgccgacguuauaccagacguaaaaacagaauaagauaucuucaagaaauuuucaguucggaaaugucaaaaguagaugauucauucuuucauagacucgaagagucuuuucuaguagaagaagacaagaaacaugaaagacauccaauauuugggaacauaguugaugaaguugcuuaccacgaaaaauauccaacaauauaccauuuacgaaagaaacuggcagacucgaccgauaaagcugaccuaagauuaauauaucuugcacuagcacauaugauuaaauuuagaggacauuuucuaauagaaggagaccuuaauccggacaacucagauauggauaaacuauucauacagcuaguacaaacauauaaucaauuauucgaagaaaauccuauaaaugcuucucgaguagacgcuaaagcaauacuaucagcucguuuaagcaaaaguagacguuuggaaaaccuaauugcacaacugccaggagaaaaacgaaacggauuauucggaaaccucauugcucuaucccucgguuuaacaccaaauuuuaaaucuaauuuugauuuagcagaagaugcaaaauuacaacuaagcaaagacacauaugacgacgaccuugauaaucuacuagcccagauaggagaccaauaugcagacuuauuccucgcagcuaaaaaccucucagacgcaauauuauuaucagauauacucagaguuaauuccgagauaacuaaagcuccacuaucagcaagcaugauaaaaagauaugacgaacaucaucaagaucugacacuucuaaaagcucuugucagacaacaauuaccugaaaaauauaaagaaauauucuuugaucaaagcaaaaauggauacgcaggauacauagacggaggugcgucacaagaggaauuuuacaaauuuauaaaaccuauccuagaaaagauggacggcacagaagaauuacuagcaaaacucaauagagaagaccuacuccgaaaacagcgaacauuugauaacggcucaauuccucaccaaauccacuuaggagaauuacacgcaauccuuagacgccaagaagauuuuuacccauuuuuaaaagauaacagagagaaaauugaaaagauauuaacauuucgcauaccuuacuaugucgguccucuggcgcgaggcaauucacgcuuugcguggaugacaagaaaaagugaagaaaccaucacucccuggaacuucgaagaagucguagauaaaggcgccucagcacagucguuuauagaaaggaugaccaacuuugauaaaaauuugccuaaugaaaaaguucuaccaaaacacucuuuacuauaugaauauuucacuguauacaacgaauuaacaaaaguaaaauaugugacggaaggcaugagaaaacccgaguucuugucaggaaaacaaaaagaagccauaguggauuuauuauuuaagaccaacagaaaagucacggucaaacaauuaaaggaagacuauuuuaagaaaauagaauguuucgauucaguagaaauaagcggcguugaagacagauuuaaugcuucccuaggaacauaccaugaucuacuaaaaauuauaaaagacaaagauuucuuagacaaugaagaaaacgaggauauuuuagaagacauaguacuaacucuaacacuauucgaagacaaagaaaugauugaagaacgccuaaagaaauacgcaaacuuauuugacgauaaaguaaugaaacaacugaaacgaagacauuauacaggauggggcagauuaucaagaaaacucauaaauggaauacgagauaagcaaucagggaaaaccauauuagacuuucucaagagugauggauuugcaaauagaaacuucaugcaguuaauaaacgaugacagccuaacuuuuaaagaagccauacaaaaagcccaaguaaguggucagggacauucacuucaugagcaaauugcuaaccuagcagguucuccagcaauaaagaaaggcauuuuacagucagucaaaguaguagacgaacugguuaaaguaaugggacacaaaccugaaaacauagugauagaaauggcucgagaaaaccaaacuacgcaaaaaggacagaaaaacagcagagaaaggaugaaaagaauagaagaaggaauaaaagaacugggaucacagauauuaaaggaacacccagucgaaaacacgcaauuacaaaaugaaaaguuauacuuauacuauuuacaaaacggacgagauauguacguggaucaggaacuagacauaaaucgacuauccgacuacgauguagaucauauaguuccccaaucauuuauaaaagaugacaguauugauaauaaaauacuaacaagaagcgacaaaaaucgaggaaaaucagacaacguaccuucagaagaaguaguaaagaaaaugaaaaauuacuggcgacaauuauuaaacgcuaaacucauuacacagagaaaauucgacaaccuaacaaaagcugaaagagggggauugucggaguuagauaaagcaggauucaucaagcgacaauuagucgaaacacgacaaauaacgaaacauguagcacaaauauuggacucacgaaugaacacaaaauacgacgaaaaugauaaacuaauaagagaagugaaagucauaacccucaaaaguaaacucguaucagauuuccguaaagauuuucaauuuuauaaagugagagaaauaaauaacuaccaccacgcacacgacgcauauuuaaaugcugugguaggcaccgcacuaauaaagaaauauacuaaacuagaaagcgaauuuguauauggugauuauaaaguauaugauguacgaaaaaugauagcaaaaucagaacaagaaauagguaaagcaaccgccaaaagauucuuuuauucaaauauaaugaacuuuuucaaaaccgagauuaccuuggcaaacggggagauaaggaaaagaccacuaauugagacaaacgaagaaacaggggagauaguuugggacaaaggaagagauuuugcuacaguacgaaaaguucuaaguaugccacaaguaaauaucgucaagaaaaccgaaguccaaacaggugcuuuaacaaaugaaucgauauacgcacgugggagcuuugauaaauuaauuucgagaaaacauagauucgaaucaucuaaauacgguggauuuggguccccaacaguuacauauagcguguuggucguagcuaaaucaaaaguccaagacggcaaagucaagaaaauaaaaacaggaaaagaacucauaggaaugacucuauuagacaaauuagucuuugagaaaaauccacugaaauuuauugaagacaaagguuauggaaacguacaaauagacaaaugcauuaaacugcccaaauauucgcuauuugaguucgaaaauggcacaaggcguaugcuagcgagcgucauggcaaacaacaacucccguggcgaucuacaaaaagcuaaugaaauguuuuuacccgcaaaauuaguuacccuacuauaucacgcacauaagauugaaagcaguaaagaacucgaacaugaagcauacauauuagaucauuacaacgaccuauaucaauuauuaagcuauauagaacgguucgcuucacuauacguugacguagagaaaaauauaucaaaaguaaaggaacuauucaguaauauagaaagcuauucuauaucagaaauauguaguucuguuauuaauuuacuaaccuugacugcaagcggggcuccagcagacuucaaauuucuagguacaaccaucccgagaaaaagauacggcaguccacaaucuauccucucuucaacauuaauacaucaaagcauuaccggauuauacgaaacgaggauagauuuaucacaauuaggaggugacuga

SEQ ID NO: 5471 - RNA, 4116 nt, Artificial Sequence
  Cas9 variant
auggauaagaaauauucuauaggacuagauauaggcacaaacagugucggaugggcagucauaaccgaugauuauaaagugccauccaagaaauucaaaguacuggggaacacagacagacauagcaucaagaaaaaccuuauaggugcccuauuauucgauucaggagaaaccgccgaagcaaccagauuaaaacggacugcaagacguagguacacucgacgcaaaaacagaauaagauacuuacaagaaauauucucuagcgaaaugucaaaaguagacgacuccuucuuucauagacuagaagaaucauuucuaguagaagaagauaagaaacaugaaagacaccccauauuugguaauauaguugaugagguugcuuaucaugaaaaauaccccacaauauaucacuuaagaaagaaauuagcggauucuacugacaaagccgaccuucgauugaucuaccuugcccucgcucauaugauuaaauucagaggucauuuucuuauagaaggagaccugaauccugauaacucagacgucgauaaacuuuucauacaauuagugcaaacuuacaaccaacuauucgaagaaaauccaauaaacgcaaguaggguggacgcuaaagcaauacucuccgcuaggcuuaguaaaucacguagauuagaaaaccucaucgcacaauuaccaggagagaaaagaaacggacucuuuggcaaccuaauugcacuaucgcuaggacuaacaccaaacuucaaaucaaauuuugacuuagccgaagacgcuaaacuacaauuaucuaaagacacguaugaugacgauuuagauaacuuacucgcacagauuggggaccaguacgcugaucuauuccuagccgcuaaaaauuuaucagaugcaauacuacuuagcgacauacuucgcguaaauucugaaauaacuaaagcaccacuaucugcaucuaugauuaaaagauacgaugaacaccaucaggaucucacauuauuaaaagcccuaguacgacaacaacuaccugaaaaauacaaagaaaucuucuucgaccaauccaaaaauggauacgcaggauacauagaugguggagcaucccaagaagaguucuacaaauuuauuaaaccaauacucgaaaagauggaugggacugaagaacuguuagcaaaauuaaauagggaagauuuauuacgaaaacaacggacuuucgauaacggaagcauaccccaucaaauacauuuaggagaacuucaugcaauauuaagaagacaagaagauuucuaucccuuccuuaaagacaacagagagaaaauagagaaaauuuuaaccuucaggauuccauacuacguaggcccacucgcuagagguaauucaagauucgcauggaugaccagaaaaagcgaagaaaccauaacaccauggaacuucgaagaaguagucgacaaaggagcaucagcacaaaguuuuauugaaaggaugacaaacuuugacaaaaacuuaccuaaugaaaaaguuuuaccaaagcauagucuauuauacgaauacuuuacuguuuacaaugaacuaacaaaaguuaaguauguuacugaaggaaugcgcaaaccagccuuucuuucgggagaacaaaagaaagcgauaguugaccucuuauuuaaaacaaauagaaaaguaacaguaaaacaauuaaaagaagauuacuucaaaaagauagaauguuucgacucuguagagaucuccgguguggaggaccgcuuuaacgcuagccuagguacuuaucacgauuuauuaaaaauaaucaaagacaaagacuuucuagacaaugaagaaaacgaagauauacuagaagacauaguucuaacccuaacacuauucgaagacaaagaaaugauagaagaacgcuugaaaaccuaugcacacuuauucgaugacaaaguuaugaaacaacuuaaaaggaggcacuauacuggauggggaagauuguccagaaaguuaaucaauggcauccgagauaaacaaucggguaaaacuauacuugauuuucuaaaauccgauggcuucgcaaaucguaauuucauacaguuaauacaugacgauagcuuaaccuucaaagaagcaauacaaaaagcucaaguaaguggucaaggacacucacuacaugaacagaucgccaaucuagcaggcucacccgcuaucaagaaaggcauucuacaaagcgucaaaguagucgaugaacucgucaaagugaugggccacaaacccgaaaacauuguaauagaaauggcccgcgaaaaccagaccacccaaaaaggacagaaaaacagcagagaaagaaugaaaagaauagaagaagggauuaaagaacuagguagccaaauccuaaaagaacacccgguagaaaacacacaauuacagaaugaaaagcuauaccuauauuaccuccaaaauggaagagacauguauguagaucaagaacuagacauaaacaggcuuucggauuaugauguugaccacauaguaccacaaaguuuuauaaaggacgacagcauugacaauaaaguuuugacaagaucugacaaaaaccgaggcaaaagcgacaauguccccucagaagaaguaguuaaaaagaugaaaaauuauuggagacaacuacuaaaugcaaaacuaaucacucaacgaaaauucgacaacuuaacaaaagcagaacgaggaggccuaagugagcucgauaaagcagguuuuauaaaaagacaacugguagaaacacggcaaauuaccaaacacguagcacaaauuuuagacucuagaaugaauaccaaauacgaugaaaaugauaaacuuaucagagaaguaaaaguaauaacauuaaaaucuaaacuuguuucugacuuucgaaaagauuuccaguucuacaaaguacgagaaauuaauaacuaucaccaugcacaugaugcuuaucuaaaugcuguagucggaacagcacuuauaaagaaauauccaaaacuagaaucagaauuugucuauggugacuauaaagucuacgacguaagaaaaaugaucgcaaaaucagaacaggaaauuggaaaagcaacagccaaaagguucuucuacuccaauaucaugaacuucuucaaaacagaaauaacucuagccaacggcgaaauuagaaagagaccauugaucgaaacuaaugaagaaaccggcgaaaucguaugggacaaaggaagagacuucgcaaccguucggaaaguauuaagcaugccacaaguaaacauaguaaagaaaaccgaaguccaaaccggugccuuaacuaaugaauccauauaugcaagaggcuccuuugacaaacugauaucaagaaaacauagauucgaaucaucuaaauacggaggauucggcucaccaaccgugacguacucaguccuaguaguagcaaaauccaaaguacaagacggaaaggugaagaaaauaaaaacaggaaaagagcuuauaggaauaaccuuauuggacaagcuaguuuucgagaaaaacccuuuaaaauucauagaagacaaagguuauggaaacguacaaaucgauaaauguauaaaauuaccuaaauauucacuuuuugaauuugaaaacggcaccagaagaaugcuugccaguguuauggcuaauaacaauucaagaggagaucuacaaaaagcaaaugaaauguuuuuaccagcaaagcuaguuacacuacuauaccacgcacauaaaaucgaaucaucuaaagaacuagaacacgaggcuuauauauuagaccauuacaacgacuuguaucagcuauuaucguauauagaacgcuuugcaagucucuacguagacguugagaaaaacauaucaaaagucaaagaauuguuuuccaauauagaaaguuacucaauaagugaaauuuguuccucaguaauaaaccuccucacacuaacugcgucaggagcuccugcagacuucaaauuuuuaggcacgaccauuccuagaaaacgauacgguuccccacagucaauauugucuaguacacuaauacaucaauccaucaccggcuuauaugagacaagaaucgaccuuucacaauuaggaggagauuga

SEQ ID NO: 5472 - RNA, 4116 nt, Artificial Sequence
  Cas9 variant
auggaaaacaaaaacuacuccauaggucucgacauaggaacaaauucaguuggauggucaguuauaaccgacgauuauaaaguuccaagcaagaaaaugaaaguauuaggaaauacagauaaacauuuuauaaagaaaaauuuaauaggagcauuauuauuugacgaagguacaacagcugaagcaagaagauuaaaacgaacugcacgccgaagauauacaagaaggaaaaauagacucagauaccuacaagaaauauuuuccgaagaaauagguaaaguggauucuucauuuuuccacagacuagacgacucauuucucauaccagaagacaaaagagguaguaaauacccgauauuugcuacucuugccgaagaaaagaaauaccacaaacaauuccccaccauauaucaccuaagaaaacaacuugcagauucuaaagagaaaaccgaucuaagacucaucuaccucgcacuugcacacaugauaaaauaccguggucacuuucuuuaugaagaagcauucgauaucaaaaacaaugacauccagaaaaucuucaaugaauuuauuucaauauacaauaauacauuugaaggaaacaguuuaaguggacaaaauguacaaguugaagcaauauucacagacaaaauaucaaaaucugcaaaaagagaaagaguccuaaagcuauuccccgacgaaaagaguaccgggcuauuuagugaauuucuaaaacuaauuguaggcaaucaagcugauuucaagaaacacuuugaucuagaagaaaaagcaccccuccaauucucaagggauacauaugacgaagacuuagaaaaucuccucgggcaaaucggcgaugauuucgcggaccuauuuuuaguugcaaagaaacuauacgaugcaauucuauuaucuggcaucuuaaccgugaccaacccaucaacaaaagcaccuuuaucagcuaguaugauugaaagauacgaaaaccaucaaaaagaccuagcaucuuuaaaacaauucaucaaaaauaaccuucccgaaaaauaugaugaagucuucucagaucaaagugaagacggcuacgcaggauauauagauggcaaaacaacgcaagaaacauuuuauaaauacaucaaaaaucuauuaucgaaauucgaaggcgcagauuacuuuuuagauaaaauagaacgggaagauuucuuacguaaacaacgaaccuuugauaauggaaguauaccccaccaaauacaccuucaagaaaugaaugcuauucuaagaagacaaggcgaacacuauccuuucuuaaaagagaacaaagagaaaaucgaaaagauacuaacauuucguaucccauauuauguugguccucuagcaagaggaaacagggacuuugcauggcuaaccagaaauucagaucaagcaauacgccccuggaacuucgaagaaauaguugauaaagcgucgucagcugaagacuucaucaauaaaaugacaaauuacgaccuguauuuaccagaagaaaaaguacuaccaaaacacagccuauuauacgaaacuuucgccguguauaacgaacuaacaaaagucaaauuuauugcugaaggccuaagagauuaucaauuccuagacuccggccaaaagaaacaaauagugacgcaacucuuuaaagagaaaagaaaaguuacagaaaaagauaucauacaauuccuacacaacgucgauggcuacgauggcauagaacucaaaggaauugaaaaacaauuuaacgcaaguuuguccacuuaccacgaucuauuaaaaauaauuaaagauaaagccuuuauggacgaugccaaaaaugaagcuauccucgaaaacauuguacacacuuuaaccaucuucgaagauagagaaaugauaaaacaaagacuugcucaauacgauagccuauucgacgaaaaaguaauaaaagcacugacacgacgacauuauacaggauggggcaaacugucggcuaaauuaauuaacggcauaucagauaaacaaacaggaaauaccauauuagauuaucuaauagacgauggagaaaucaacaggaauuucaugcaguuaauaaacgacgacgggcugucuuucaaagaaauaauccaaaaagcacaaguaguagguaaaacaaacgauguaaaacaaguuguccaagaacuacccgguagcccugcaaucaagaaagggauauuacaaucuauuaaaauaguagaugaacucgucaaggugaugggccaugccccagaaagcauaguaauagaaauggcgcgugaaaaccaaacgacagcaagagguaagaaaaacucucagcaaagauacaaacgcauagaagacagcuuaaaaauauuagcaucugguuugaacaguaaaauacucaaagaacacccaaccgacaauauacaacuacaaaacgacagacuauuccucuauuaucuacaaaacggaaaagauauguacacaggagaagcauuagauaucaaccaacuaucgucaugugauaucgaccacaucauaccacaggcuuucauaaaggaugauucacuagacaaccguguacuaaccucgucaaaagacaaccgcggcaaaucugauaauguaccaaguuuagaaguugucgauaaaaugaaaguuuucuggcaacaacuccuugauaguaaacuaauaagcuaccgaaaauucaacaaucuuaccaaagcagaacgaggcgggcuaaaugagcuggauaaaguaggauucauuaaacgacaacugguugagacccgucagauaacaaaacacgucgcacaaauacucgaugcacgauucaauaaagaaguaacugagaaagacaagaaaaauagaacaguaaaaauuauaacccuaaaaucaaacuuaguauccaacuuuagaaaggaguucgaauuauacaaaguuagagaaauaaaugauuaccaccacgcucacgaugccuaccuaaacgcaguagucgcuaaagcuauucugaagaaauauccaaaauuagaacccgaguucgucuauggagacuaucaaaaauaugaucuaaaaagauacauaagcagaagcaaggaccccaaagaaauugaaaaagcaacugaaaaauauuucuucuauagcaaccugcucaacuucuucaaagaagaaguacacuaugcagauggaacaauagucaagagagaaaacaucgaauacaguaaagacacaggugaaaucgcauggaauaaagaaaaagauuucgcaacaaucaagaaaguccuaagucuaccucaaguaaauauagucaagaaaagagaaguacagacuggaggauucagcaaagaaucaauacuaccaaaaggaaauucagacaaacuuauaccaagaaaaaccaaagacauucuuugggauacaacuaaauacggcggguucgauagcccggucauagccuacucaauucuucucauagccgacaucgaaaaagguaaagccaagaaacuuaaaaccguuaaaacacucguaggaauaaccauuauggaaaaagaugccuuugagaaaaacccuaucgcauuccuagaaaauaaagguuaucacaauguuugcaaagaaaacauacuuuguuuaccaaaauacucacuguuugaacuagaaaauggacguagaagauuguuagcaagcgcaaaagagcugcaaaaaugcaacgaaauaguccuaccaguuuacuuaacuacacucuuauaucauagcaaaaacguucacaaacuugaugaaccgggucaccuugaguauauacaaaaacacagaaaugaauuuaaagacuuauuaaaucuaguaucagaguucucacaaaaauauguacucgcagacgcuaacuuagagaaaauuaaaaaucuuuaugccgauaacgaacaagcagacauagaaauauuggcgaacuccuucaucaauuuguuaacuuuuaccgcguuaggagcuccugcagcauucaaauucuuuggaaaagauguagaccgaaaaagauacacgaccgucagcgaaauccucaacgccacacuaauucaccaaucaaucacuggauuauacgaaacccgcauagaccuaucaaaauuaggagaagacuga

SEQ ID NO: 5473 - RNA, 4116 nt, Artificial Sequence
  Cas9 variant
augaaaguaaauaauuaucacauaggccuagauaucggaacauccucuauaggcuggguugcaauuggagaagacggaaaaccacuacgcauuaaagguaagacagccauaggagcaagacuauuucaagaaggcaacccagcagcugacagacgaauguuuagaacgacucgaagaagauuaucucgaaggaaauggagacuuaaacuacucgaagaaauauuugauccguacauuacuccaguugauagcaccuuuuuugcaagauuaaaacagucaaacuuaucacccaaagacucaagaaaagaauucaagggaagcaugcuauucccggacuuaacagacaugcaguaccacaaagacuauccaaccauauaucaucuuagacacgcacucaugacccaagacgaaaaauuugacauucgaaugguauaccuugcaauacaucacaucgucaaguaccgcggaaacuucuuaaacucaaccccaguagauagcuuuaaagccucaaaaguaaauuucguagaccaauucaagaagcuaaacgaacuauauacagcaauaaaucccgaagaaucauuucaaaucaauuuagccaacagugaagauaucggucaccaauucuuagacccuucaauaagaaaauuugauaaaaaaaaacaaauccccaagauaguaccgguaucaguagacgacaaagcgacugacaaaauaaacggaaaaauagcaagcgagaucauuaaugcaauauuagguuacaaaucaaaauuagacguggucgugcaauguacaccggucgacucaaaaucaugggcccugaaauuugaugaagaagacauugacgcuaaauuacaaaaaauauuaccagaaauggaugaaaaccaacagaguaucauagcuauacuccaaaacuuauacagucagguaacacuaaaccaaauuguacccaacgguaugagccuguccgaaucaaugauugaaaaauacaacgaucaucaugaccacuuaaaacuauauaaaaaaauaauagaucaacuugcugauccaaaaaaaaaagcagcucuaaaaaaagcauauagucaauacguuggggaugacggcaaaguuauugaacaagcagacuucuggucaaguguuaagaaaaaccuugacgauucagaucuaucaaaacagauaauggaccuuauugacgcagagaaauucaugcccaaacaacgaacaucccaaaauggggucauaccacaccaacuacaucaacgagaauuagacgaaauuauagaacaucaaaguaaauacuacccauggcuagccgagauaaacccaaacaaacaugaccuccacuuggccaaauauaaaauagaagaacuaguagccuuccgagucccuuauuacgucggaccaaugaucacaccggacgaccaagcuaaaucagcggaaacaguauuuucuuggauggaaagaaaaggaaaggaagcaggacaaaucacucccuggaacuucgacgaaaaagucgauagaaaugcaucagccaaccgauucaucaaaagaaugacaacaaaagacacauaccuaauaggagaagacgugcuaccagacgaaaguuuacuauacgaaaaauucaaaguacuaaacgagcuuaacaugguaagaguaaauggaaaacuauuaaaaguggccgacaaacaagcaaucuuccaagaccuuuuugaaaacuacaagcacauaaguguaaaaaaacuucaaaacuauauaaaaaguaaaacaggccuaccaagcgaccccgaaaucucaggguugucagauccagaauacuucaacaacagccuaggcacauauaaugacuuuaaaaaacuguuuggaaacaaaguagacgaacccgaucuucaagaugacuucgaaaaaauaguagaguggucuacggucuuugaagacaaaagaauauugagagaaaaacuaaacgaaauaaccuggcuaucagaucaacaaaaagauguauuagagucaucacgcuaucaaggauggggaagacuuaguaaaaaauuauuaacaggcauaguaaaugaucaaggagaacggaucauagaugaguuauggaacacaaauaaaaacuucaugcaaauacaaucagauaacgauuuugccaaaagaauccaugaggcuaaugcggaccaaaugaaagcagucgauguugaggacguauuagcagaugcauauacauccccccaaaacaagaaagcaauaagacaaguuguaaagguaguagacgauauucaaaaggcaaugggcggaguggccccgaaauauauauccaucgaguucacucggucugaggaucggaaccccagaagaaccauaucucgacaaagacaauuagaaaacacauugaaagauacagcaaaaagucuagccaaaucgauaaauccagaacuacuaagugaacuagacaacgcagcuaaaucaaagaaaggacuaauugauaggcucuacuuguacuucacacaacuaggaaaagauauauacacagguaaaccaauaaauaucgacgaaauuucaaccuaugauauagaucacaucuuaccccaggcauucguuaaagaugacagucucaacaacagaguacuuguuucaaaagcgaucaacaaugguaaaucagacaauguccccguacaacuauuuggugcuaaaaugggacauuuuuggaaacaacuggcagaagcagguuuaaucaguaaaagaaaauuaaaaaaucuucaaaccgaucccgacaccauaucgaaauacgccaugcacggauuuauucguagacaacuagucgaaaccucacaaguaauaaaacuaguugccaacauuuuaggcgacaaauauagaaacgacgauacuaaaauaauagaaauaacagcuagaaugaaucaucaaaugagagacgaguuuggcuucauaaaaaauagagaaauaaacgauuaucaucaugcguucgacgcauaccugacggcauuccuaggaagauauuuauaucauagauauauaaaacuacgaccauacuuugucuacggagacuucaaaaaauucaaagaagauaaaguaaccaugagaaacuuuaacuucuuacacgaccucacugacgacacucaagaaaaaauagcugaugcagaaacaggagaaguaauuugggaccgagaaaauucuauacaacaguugaaggacguuuaccacuauaaauucauguuaauuucacacgaaguauacacauuaagaggggcaauguucaaucaaacaguauacccggcauccgaugcaggcaagagaaaacuaauaccaauaaaagcagacagaccaauuaauguauauggaggauauagcgguagugccgacgcauacauggcuauugucagaauacauaacaaaaaaggcgauaaauaucgaguagucggaguuccuaugagagcaagagacagauuagaugcugcaaaaaaaguaucagacgcagacuacgacagggcacuaaaagacguauuaacaccacaauuaaccaaaacaaaaaaaaguagaaaaacaggugagauaacacaagucguagaagacuucgaaauugucuuagguaaaguaauguauagacaacuaaugauagacggugacaaaaaauuuaugcuaggcucuuccacauaucaauacaaugcuaagcaauuaguauugagcgaucaaucuguuaagaccuuagcaucuaaaggucgacuugauccccugcaagagucuauggauuacaauaacguuuauacagaaauacucgauaaaguaaaccaauacuucucacuauacgacaugaacaaauucagacacaaauuaaaccucggauuuucaaaauuuauaucauuuccaaaccacaacguauuugacggaaauacaaaagccucguccggaaaaagagaaauucuagaagaaguauuaaauggacuacacgcaaacccaaccuucggaaaccucaaagacauaggaauaaccacaccuuucggacagcuccaacaaccaaacggaauccuacuaucagaugaagcuaaaaucagauaucaaucuccaaccggucucuuugaaagaacaguaucucucaaagaucucuga

SEQ ID NO: 5474 - RNA, 4116 nt, Artificial Sequence
  Cas9 variant
augaaaguaaacaacuaucauauaggccuggauaucggcacaaguucuaucggcuggguagcaauaggaaaagauggaaaaccucuaagaguaaaaggaaaaacagccauuggagcacgccuauuccaagaggguaauccagccgcugaccgacguauguuuaggacaaccagacgucgacucuccaggagaaaauggcgacuaaaauugcucgaagagaucuucgacccauauauaacacccguugacuccacauucuuugcaagacuaaagcaaucaaaucuaagcccaaaagacaguagaaaagaauuuaaaggaucaauguuauuuccagaccuuacagacaugcaauaccauaaaaauuaucccacuaucuaucaucuaagacacgccuuaaugacccaagacaagaaauuugacauacguauggucuacuuagcaauucaccauaucguuaaauauagagggaacuuuuuaaacagcacuccaguugauucauucaaagcaucuaaaguagauuucguagaucaauucaagaaacuaaacgaauuauaugcggccauaaacccagaagaaucuuucaaaaucaaccuugcgaauagcgaagacauaggucaccaauuccuagauccauccauccgaaaauuugacaaaaagaaacagaucccaaaaauaguaccaguaaugaugaaugacaaaguuacagaccgauuaaacggaaaaaucgcgagcgaaaucauacacgccauacuaggauacaaagcaaaacuagacguagugcuacaauguacaccaguagauucaaaaccaugggcauuaaaauuugaugacgaagacauagaugcuaaacuagagaaaauccuacccgaaauggacgaaaaucagcaauccauaguagcuauucuccagaauuuauacucacaaguaacauugaaucaaauagucccaaaugguaugucauuaagcgaaagcaugaucgaaaaauacaaugaucaucaugaucaucuuaaacuauacaagaaauuaaucgaccaacuagcggacccgaaaaagaaagccguacuaaagaaggcuuacagucaauacguaggagacgauggcaaaguuauagaacaagcagaauuuuggucaucuguaaagaaaaauuuagaugauuccgaacucucuaaacagaucauggaucuaaucgacgcugaaaaauucaugccaaaacaaagaacuucccaaaauggagucaucccucaccaacuccaccaaagggaacuagacgaaauaauagaacaucaaucaaaauauuacccauggcugguagaaaucaauccaaauaaacacgaccuacaccuagcuaaauauaaaauugaacaacugguagcauuucgaguaccguauuacgucgggccgaugauaacuccaaaagaucaagcagaaagcgccgaaacaguauuuucguggauggaaagaaaagggacagaaacaggacaaaucacacccuggaacuucgaugaaaaagucgaucgaaaggcuucugcaaaccgauucaucaaacguaugacaacuaaagauacauacuuaaucggugaagacguacuaccugaugaguccuuauuguaugaaaaauuuaaaguauuaaaugaacuaaauaugguaagagugaacggcaaacuauuaaaagucgcagacaaacaagcuaucuuccaagaccucuucgaaaacuauaaacauguuucaguuaagaaacuacaaaacuauauaaaagcaaaaacaggcuuaccaucagauccugaaauauccgguuuauccgauccggagcacuucaauaauagucucggaaccuauaacgauuucaagaaacuauucgguucaaaaguagacgaaccagaucuacaagacgauuucgagaaaaucguagaauggucaacaguauuugaagauaagaaaauauuaagagagaaacuaaacgaaauuacaugguugagcgaccagcaaaaagaugugcuagaaucuucuagauaucaaggauggggaagacuuaguaagaaauuacuaacaggaauaguaaacgaucaaggcgagagaauaaucgacaaacucuggaacacaaauaaaaauuuuaugcaaauacaaucugacgacgacuucgccaaacgaauccacgaagcaaacgccgaccaaaugcaagcagucgauguagaagauguccuagcagaugccuacacuucaccacaaaacaagaaagcgauaagacaagucguaaaaguaguugaugauauacaaaaagcuaugggagguguggcuccaaaauacauaucaaucgaguucaccagauccgaagacagaaaucccagacgaaccaucucuagacaaaggcaauuagaaaacacauuaaaagacacugcaaaaucacuagcgaaaucaauuaacccugaacuccuaucugaauuagauaaugcagccaaaagcaagaaaggccuaacagaccgacuauacuuauacuuuacacaacuaggcaaagacauauacacuggcgaaccaaucaacauugaugaacuaaauaaauacgacauagaccauauucuaccacaagcauuuauaaaagauaauagccuugacaaccguguccuaguacuuacggcagugaacaauggcaaaagcgauaauguucccuugagaauguucggggcaaaaauggggcacuucuggaaacaauuagccgaagcuggucuuauuucaaaaaggaaauuaaagaaccuacaaacugauccugacacuaucucaaaauaugcuaugcacggauucauucgucgacagcuagucgaaacaagucaaguaauaaaauugguagccaauaucuuaggagacaaauaucgaaacgaugacacaaaaaucaucgaaaucacagcacgaaugaaucaccaaaugagagacgaauuuggguuuauuaaaaacagagaaauaaacgauuaucaccaugcguucgacgcauacuuaacugccuuucuaggaagauaucuauaucaccgcuacaucaaacuacgaccauacuuuguauacggugacuuuaagaaauuuagagaagauaaaguaacuaugagaaacuucaauuuucuucaugaucuaacagaugacacucaagagaaaauagccgacgcugaaaccggagaagucauuugggacagagaaaacucgauacaacaacuaaaagauguauaucauuacaaauucaugcuaauaucucacgagguuuauacucucagaggagcaauguuuaaucaaacagucuacccagcaagugacgcaggcaaacguaaacuaauaccagugaaagcagacagacccguaaaugucuacggaggcuauucaggaagugcagaugcuuauauggcgauaguaagaauacauaauaagaaaggcgauaaauacaggguaguaggugugccaaugagagcucuagauaggcuagacgcggcgaaaaacguuuccgacgcagacuucgaccgugcucucaaagauguucuagccccacaauuaacaaaaacaaagaaaucaagaaaaacuggcgaaauaacccaagucaucgaagauuuugagauaguucuaggaaaagugauguacagacaacucaugauagauggagauaagaaauucauguuggguucaucaaccuaucaauauaacgccaaacagcuggucuuaagugaccaaaguguuaaaacguuagcaaguaaaggacgacuagauccacuucaagaaucaauggauuacaacaacguauauacugaaauacuagauaaaguaaaucaauacuucucucuuuacgacaugaauaaauuucgccauaaacuaaaccuuggauuuuccaaauuuauaucuuuuccgaaucauaacguacuggauggaaacacgaaaguauccucaggaaaacgugaaauauugcaggaaauuuuaaauggucuucacgcgaacccaacauuugguaauuugaaagacguagguauaaccacgccguucggccaguuacaacaaccaaacgguauucuacuuagugaugaaacaaaaaucagguaucaaucgccaacaggccuauucgaaagaacaguuucauuaaaagaucuauga

SEQ ID NO: 5475 - RNA, 4116 nt, Artificial Sequence
  Cas9 variant
auggacaaaaaauauuccauaggauuagacaucgguacuaauagcguugguugggcuguaauaacggacgauuacaaagugccaucaaaaaaauuuaaaguucuagggaacacagauaggcacagcauaaaaaaaaaccucauaggggcacuccuguuugacucaggcgaaacagcagaagcuacuagacuaaaaagaaccgccaggaggagauauacuagaagaaaaaacagaauauguuacuuacaagagauauucucaaaugaaauggcaaaagucgacgauagcuuuuuccaccggcuagaagaaagcuuccugguagaggaggacaaaaaacacgagcgacacccuaucuucggaaacauaguggaugaaguggcauaucacgaaaaauauccaacgauauaccaccuaagaaaaaaauuagcagacucgaccgacaaagcggacuuaagacuuauuuaucuagcuuuagcacacaugaucaaauuuagaggacacuuucuuauagaaggagaccuuaaccccgacaacuccgauguagacaagcuauuuauccaacugguacaaacuuacaaucaacuauucgaagaaaacccaaucaacgcgucucgugucgacgccaaagcaaucuuaucagcgagauuaucuaaaucuagacgauuggaaaaccucaucgcacaauuaccuggcgaaaaaaaaaacggguuauuuggaaauuuaauagcacucagcuuaggacucacaccaaauuuuaaaucuaacuuugaccuagcagaggacgcaaaacuccaguuaaguaaagacacauacgacgacgacuuggacaaucuauuagcacaaauaggugaccaauacgcggaucuauuuuuagcagcaaaaaaucucucagacgcuaccuugcuaagcgacauccuacgcguaaacucggaaauaacaaaagcaccuuuauccgccucaaugaucaaaagauaugaugaacaucaucaggaucuaaccuuauuaaaagcacuaguaagacaacaguuaccagaaaaauacaaagaaauauuuuucgaccaaagcaaaaaugguuaugcaggguauaucgacgggggagccucucaagaagaauuuuauaaauuuauaaaacccauacuagaaaaaauggacggaaccgaagaacucuuagcaaaacuaaauagagaagauuugcuaagaaaacagagaacauuugacaauggcaguauaccacaucaaauacaucucggagaacugcaugcuaucuuacgaagacaggaggauuuuuacccauuucucaaagauaaucgugaaaaaauagaaaaaauacucacuuuuagaauccccuauuacguaggaccauuagcgaggggaaacucacgcuucgcuuggaugaccaggaaauccgaagaaaccauaacacccuggaauuucgaagaaguuguagauaagggagcaagugcucaaucauuuauagaaagaaugaccaacuucgacaagaaucuuccaaaugaaaaaguuuugccaaagcauucacuauuauaugaauauuucacaguuuauaacgaacuaaccaaaguaaaauacguaacugaaggaaugcgaaaaccagcguucuuauccggcgaacaaaaaaaagcuauuguagaucuacuauucaagacaaacagaaaaguuacugucaaacaauuaaaagaagacuacuuuaaaaaaaucgaauguuucgauagcgucgaaauaucagggguagaagacagauucaaugcaucuuuaggaacuuaucacgaucuacucaaaauaauaaaagauaaagauuuccuggauaacgaggaaaaugaagauauacuugaagacauaguucucacguuaacacuauucgaggauaaagaaaugauugaagaacgacuuaagaccuaugcucaucucuuugacgauaaaguaaugaaacaacugaagcggagacacuauacuggcuggggaagacuuuccagaaaacuaauaaaugguauaagagauaaacagagcggaaaaacuauacuagauuuucugaaaagcgacggauucgcaaauagaaacuucauccaauugauacaugaugacucacuaacauucaaagaagcgauccaaaaagcacaaguaucaggacaagggcacucucuucacgaacaaauagccaauuuagcagggucucccgcaaucaaaaaaggcauacuacaaucaguaaaaguaguagacgaauuagucaaaguaaugggccacaagcccgaaaauaucguaauagaaauggcaagagaaaaccaaacaacacaaaaaggacaaaaaaauuccagagaaagaaugaaaagaauugaagaagggaucaaagaauuaggcucacaaauacucaaagaacacccuguggagaauacacaauuacaaaacgaaaaacuuuaccuauauuaucuacaaaaugggcgagauauguauguagaccaagaacuggauauaaaucgauuaagcgauuaugauguagaccauauagucccacaaucuuuuauuaaagacgauucaauugacaacaagguacugacuagaucagauaaaaaucguggaaaaucggacgacgucccaagugaagaaguaguaaaaaaaaugaaaaauuauuggcgccaauuacuaaaugcaaaacuaauaacacaaaggaaauucgacaacuuaacaaaagccgaaagaggaggauuaagcgaauuagauaaagcagguuucauaaaacgccagcucguagaaaccaggcaaauaacaaagcauguggcucaaauucuagacucaagaaugaacacaaaguacgaugaaaacgacaaacuuauaagagaagucaaaguuauuacacuaaaaucuaaacuaguaagcgauuuuagaaaagauuuccaauuuuauaaaguccgagaaauaaacaacuaucaccacgcucaugaugcauaucucaaugcaguaguagguacagcauuaauaaaaaaauacccgaaauuagagucagaauuuguauacggagauuacaaagucuaugauguaagaaaaaugauagcaaaaagcgaacaagaaauaggcaaagcaacagcuaaaagauucuucuauucaaauaucaugaacuucuuuaaaacagagaucacucuagcuaacggggaaaucagaaaaagaccacucauagaaacuaaugaagaaacaggagagaucgugugggauaaaggaagagacuuugcaacuguaagaaaaguacuaucuaugccacaaguuaacauaguaaaaaaaacugagguacagacgggcgcguugacaaaugaaaguauuuacgcaagaggguccuucgauaaauuaauaucacgcaaacauagguuugaauccucgaaauacggcgguuuuggcucaccaacaguuacuuacuccguauuaguaguagccaaaagcaaaguucaagacggaaaaguaaaaaaaauaaaaacagguaaagaacuaauaggaauuacucuacuagacaaacuugucuucgaaaaaaacccauugaaauuuauagaagacaaaggauaugguaacguacagauagauaaauguauuaaacuaccuaaguauucccuauucgaguuugaaaacggaacacgacgaaugcucgcuucaguaauggcaaauaacaacuccagaggagaccuacaaaaagcaaaugaaauguuccuaccagcaaaacuugucacauugcuuuaccaugcacacaagauagaaucaucaaaagaacuagaacacgaagcuuacauacuggaccauuacaaugaucuauaccaacuacuaucauacauagaaagauuugcaucucuauacguagacguagaaaaaaauauauccaaagucaaagaguuauucucaaacauagaguccuauuccauaagcgaaauauguuccuccguaaucaacuuacuaacacuaacugccuccggugccccugccgauuucaaauuuuuagggacaaccauaccuagaaaaagauauggaucuccucaaaguaucuuaucaucaacacuuauacaccaaagcaucaccggauuauacgaaacucguaucgauuuaucacaguuagguuccgacuga

SEQ ID NO: 5476 - RNA, 4119 nt, Artificial Sequence
  Cas9 variant
augaacaaugaauacuucguuggauuugauauagguacuaauucgguuggagcggcaguaacagaugaaaaauaucacguacucaaauucaaaggaaaugcgauguggacuucagcuguuuuugaaagcgcacaacaaucugccgacagaagauuaaaccgaacugcucggcgccgccuagaccgaagucaacaaagacgagaucuuuuacaagagcuaauagcgccagcaauaacacccguugacccacgcuuuuucgacagaauaagagaaagcgccuuaugggcggaagacaaaacuacuggcucacgguuuacguacuuuucagaugaaggauauacagauaagcaauaucacaaagaguauccaacaauucaucauuuaauaugcucauuaaugaaugauccggcaccucacgauccucgcuuaguguauauagcgugcucauauaugcucacucacagaggacacuuuuuaaacgaagcugauaaagagaaaauagaugauguccuugauauacgcaggguauucaaugaauuaugcucuugguucacgaguuauggaauagaaguaccuuucuccugcuuuccagaagaguucgggaauguauuaacugcaaacagaggcguacaagacagaacucgcgccuucuaugaucuauuauuugcaggaaagaaacccaaaccuagcgaagaugaucaaguagacaucgauguccucauuaaauuaauuucaggagguaagauugaauuaagcaaacuauuucugaacgaagaauacucagaacuagaaaacaacaaaauacaacuuagugacgcuggauuugacgaaaaggaacccgaauuaagaucggaauuaggagaugacuucggucuaguagcagcugcaaagaauauuuacgauuggucacuuuuaacaggaguacucggagaaugcaagagcauaucagaagcaaaagucaaaacauacgaaaaacauagugaggaucuagcagcuuuacggagggucgugaggaaguaccacccugacaaauacaaagaaaucuucaagaaauacgugguuggaaauuacaccaguuauucaggcaacgugaaaucggcgggaaagaucagugaaaccaagcuaaaaagauguaaccaagcagaguucugcgacuauuugaaaucaaagcucaaagacguuaaacccgcgccaggugaugaugaaugugaaagagugcugaaagaaauaucaaagcauacauuuuguccuagacaaguaaccacugauaacagaguuaucccauaccaauuauauuauacagaauuaaagaaaguuuuagaaaaugcgaaaagauacauuccacaauuaaauguuacugaugaauauggaagugcggccgacaaaauauuaucacuaaugacauuuagaaucccauauuauguaggaccauuaguaaagaaaaacgauucaucaaacgcauggauagugcguaggggcgaaggucguauacucccauggaauuuugaugaacuuguugauaaagauaaaugugaagacgaauuuauaaggagaaugacauguaaauguaccuauauagcaggcaaaaaugucuuacccaaaaauucauuauuauauugcaaauuuaugguucuaaaugagauuaacaacauaaagaucaacggagaaagaaucucaguaggagauaaacagaaaauauauacagaacuauucgaaaagaaacguaaaguuacuguccgagacauucggaauuuauuaacaagugaaggcagacucaaagcaggcgauacuuucggaggcauagacauaaccguaaaaucgucacuaaaaccacaacaugaccuaaaaagauuaauggcagcggguguuauaaccgaagcagaugcggaagaaaucauugaaagaaucacauguaccaccgacgucucacgauuaagaacaugguuagguaaauucggauuaucagcggcagaugcuaaauacguaucaggacuaaaauauucagacuucgggaggcuaucaagagaauuuuuaacagaaguuaacgauguugauccagcgacaggagaaguuauuaauccaaacauuauuacgaugaugugggaaaauaacauaaaccuaauggaauuauuaagucaaaaguacaguuauagaucacaaauagaaaguaugaacagagaauauuacgcggcaaauccauuaacauuagacgaaagaaugagcgaaauguauauaccaagugcuguaagacgaccagucaaaagaacaauagaaaugaugaaagaauacaugcauauaaugagaaaaccacccaaaagaauauuuauagaaauggccagagaauugacagaucuugacaauaaagguaaaagaacaucaucuagacguaauacacuauuagaauuuuucaagaaauguccccaagacaccacggaacuaagagcccaacuagaaaagaaauccgacgaugaauuaagaucagagaaauuauauuuauacuuugcacaauuaggaaaaugcauguauucaggagaaaguauagauauagaacgacugggcucaaaauuauaugacguagaccacaucuuuccgcaagcuagagucaaagaugacaguauagaaaacaaaguccuagucuuauccgaucuuaacggagcaaaauccgauagauacccaauaaaugcugacauucguaauaaaaugcauagcuucugggacaaacugcacagcauaggacuaauuggggagaagaaauaugaaagacuaacaagaucaacuggauucacagaugaugaacuagccggcuuuauaucacgacaacuugucgagacaagacagagcaccaaagccgucgcagcauuguuggcugaagaguucccagaauccgagaucgucuauguaaaggcgggucuagcuucacaauucaggcaugaauuuggacuacugaaaugucgagagauaaaugacuuacaucaugcaaaagacgcuuaucuaaacauuguuaugggaaacaucuaccauguaaaauucacuaaagacccgaugaacuuuguaaaagaauauagaagaaaagaacaagucuucgauuuaaagauccagagcauguuaacccacgacgccauuagaaauggggaaacagcauggauaggagauggaaccuggcuagaaacuguuaaaaagcaaauggagaaaaacaauaucagauacguacgguauucauuuaggaggaaaggugcacucuucaaucuaaugccagaacgcaaaaauccaucauuacuaccaaggaaaaacgguaaaaauaugguacuaccagcagaaaaauacggaggauacaacaauacugcggccagcuucuuuagucuagucaaauaucauucagcaaaagguaguggcguuguaaucauaccuguagaacuaauacacgcacauagauacgaacaugauagcucauuugccgaagaauaugcauuacggguguuagcagauauaguuucucuaaagaaaggagauguauugcagagugucgaauuuccccuagggaguagaauauuaaaagucaacacuuuauuagacaucgaugguuucagggcaaacauaacaggaaaagacucaggagguaaauaucuaggcauaagcucugcaucaucauuaauaauuucccagguagauacaacauacauaaaaagagucauaagcauaaaugaaagaauaucugccugcgagaaaaacaagcaaucguauaccauacgaccagaauuugauguuauuacaagugaaagaaauauagaaauuuacaauaugcuaugugagaagauaagcagcagaccauuuuguauaaaauuugcaaacacuucggacacauucguuucaggacgagaaaaauucauagcccuaucgcucaaugaacaaguaaaaacuuuaacaaacaugcuuucuguuuuuaaaaccggccgugcuucagguugugaccuuacuaauauaggcggcuccaagaauacggcaauaguuaaacuaaaugcaguacuaucaaaccuuaaagauuucaaaucaguaaggauaauugaccaaaguccaacagggcuauacgaaaaaguguccccaaacuuauuaucucuauga

SEQ ID NO: 5477 - RNA, 4119 nt, Artificial Sequence
  Cas9 variant
augacgaagaaaaauuacagcauuggauuagacaucggaacaaacucggucggaugggcgguaauaacagacgacuacaaaauaccagcuaagaaaaugaaaguauuaggaaacacagacaaagaauacaucaagaaaaaucuacuaggggcacucuuauucgauaguggggaaaccgcagaagcaacccgacugaaacgaacagcacgaagacgauauacaagaaggaaaaacagacuaagauauuuacaagaaaucuuugcagaagaaauagcaaaagcagauaauagcuucuuucaaagacucgaugaaaguuuucuaacugaugacgacaaagauuuugacucccaucccaucuuugguaacaaagcagaggaagaugcauaucaccaaaaauuuaguacaauauaccaucuccgcaaauaccuugcggacagucccgagaaaagugaucuacgauuagucuacuuagcauuagcacauaugauaaaauaucgcggacacuuccuaauagaaggugaacugaaagcagaaaacacagauguacaaaaauuauuuacagauuuuguagaagucuacgaccgaaccuucgacgacagccauuuaagugaaguaacuguagaugcaucaucgauccuuacagagaaaaucaguaaauccagacgacuggaaaaucuaauagaaucguauccaaaagaaaagaaaaacacacuauucgguaacuuaauugcgcuuucacuuggacuacaaccuaacuucaaaacgaacuucaaacucucugaagaugcaaaauuacaauucuccaaagacacauacgaagaagauuuagaagaaguauuagagaaaauaggagacgauuaugccgaucuguucacaucagcgaaaaaccuauacgacgcaauauuguuaagcggcauauugacaguugacgauuccucuacaaaagcaccacuaucagcaucaaugaucaaacgauacgcagaacaccaugaagaccuagaaaaacuaaaagcauucauaaaaacaaacaaaccaaaucuguaccaugacauuuuuaaagacgaaacacaaaauggauaugcuggguacauagaaaacggaguaaaacaagacgaauuuuauaaauaucuaaaaacaauacuaucaaaaaccgauggaucagaauacuuuuuagacaaaauugaaagagaagacuuuuuaagaaaacaaagaacguucgauaauggauccauaccucaucaaauccaucuacaagaaaugcaugcaauacuaagacgacagggagacuauuaccccuucuuaaaagaaaaccaagacagaauagagaaaauccuaacauucagaaucccauacuacguagguccauuggcgaggaaaaauaguagauuugcuugggcagaauaccauagcgacgagaaaauaacaccauggaacuuuaacaaaguaauagacaaagaaaaaucagcagaaaaauuuauuacacguaugacauuaaaugaucucuaucucccagaagaaaaagugcugccaaaacauagucacguauacgaaacuuuugcaguauauaacgaacuaacuaaaauaaaauacgugaacgaacaaggaaaagaagccuucuucgacagcaauaugaaacaagaaauauucgaccacguauucaaagaaaaccgaaaaguuaccaaagaaaaacuucuaaacuacuuagacaaagaguucccagaauaucgaauccaagacuuaauaggacuugacaaagaaaacaagagcuuuaacgccagcuugggaacguaccacgaccuaaagaaaauacuagauaagagcuuccuagaugauaaaguaaaugaagaaguuauugaagacauaauuaaaacuuuaaccuuauucgaagauagagaaaugauacaacaacgccuucacaaauacucagacauauucucgacacaacaacucaagaaauuagaacggagacauuacaccggcuggggacgacuuucauauaaauuaauaaacggcauaagaaauaaagaaaauaauaaaacgauauuggaauacuuaauagacgacggauaugcgaauagaaacuucaugcagcuaauuaacgacgacaccuuaccauucaaacaaaucaucaaagacgcacaaauaauaggaaacauagaugauaucgcagccguaguccaugaacucccaggaagcccagcaaucaagaaaggaauacuacaaucgaucaaaauuguggacgaauuaguaaaaguaauggggcacaacccagauaauauaguaauagaaauggcaagagaaaaucagacaacaaauagagggagaucccaaagucaacaaagauugaagaaacuucaagacucacuuaaagaauuagguuccaauauacucaauaaaaagaaaccuaguuauguagaagauaaaguagaaaaugugcaucuccaagacgauagauuauucuuauauuacauucaaaacggaaaagacauauauacgggugaagaauuagacauugacagacuaucagacuaugacauugaccacauaauaccgcaagcauucaucaaagacgauucaauagacaaucggguccuaacaagcagugccaaaaaucggggaaaauccgacgaugucccuaauuuagauauuguccgagcaagaaaagcagacuggguaagacuauauaaaucaggacuuaucuccaagagaaaauucgacaaucuaaccaaaagugaaagaggaggcuugacagaagcagauaaagcagguuuuauaaaacgccaguuaguagaaacccgacaaauaacuaaacacguagcacaaauuuuagacgcaagauucaauaccgaacacgacgaagaugacaaagucauacggaacgugaaaguaauaacuuuaaaaucaaauuuaauaucucaauuccgaaaagauuucaaauuuuauaaaguaagagaaaucaacgauuaucaccaugcucacgaugccuaccuaaacgcagucguagguacagcccuauuaagaaaauacccuaaauuagcaccagaauuuguguauggagaauacaagaaauacgauguaagaaaauuaauaacuucuucaagugauaaagcaaccgccaaguauuucuucuauucuaaccuaaugaacuucuuuaagagaguaguacgauauaguaacggaagagucauaguaagaccuguaaucgaauauucaaaggauacaggagaaauaguauggaacaaagaaacagacuuuagaacaauaugcaaaguuuuaucauauccacaaguuaacauugucaagaaagucgaaagucaaacuggaggauucucaaaagaaucaauacucccgaaaggagauuccgacaaacuaaucccucgaaaaacuaagaaaguuuacugggauaccaagaaauacgggggcuucgacucuccaauaaucgcauauucgguguucguagucgcggaugucgaaaagggaaaagccaagaaacuaaagaaagugaaggaacucguaggaauauccauaauggaaagaccgucauuugagaaaaauccaauagucuuuuuagagaagaaagguuauagaaacguacaagaagauacauuaauaaaacugcccaaauauagccuauuugaauuugaaggcgguagacggagauuauuagccucagcgagugaacuacaaaaagggaaugaaguaguauugagugauagacucgucgaacuauuauaucaugcacauagagugaacaguuuuaacaguaccgaacaucuuaaauacguaagugaacauaagaaagaauuuggugaaguacuaucaugugucgagaacuuugcaaauucauauguggauguagagaaaaauuuagauaaaaucagagcaguaauaaauaaaauagauaccuuuucaauagaagaaaucagcaccuccuuugugaauuuacuaacacuaaccgcauuaggagcaccagcagacuuuaauuucuuaggcaagaaaauuccacguaaaagauacacaaguacaaaagagugcuuaaacgcaacacuaauacaucaaucaauaaccggucuuuaugaaacaagaaucgaucucucaaaacuaggggaagacaaauga

SEQ ID NO: 5478 - RNA, 4119 nt, Artificial Sequence
  Cas9 variant
augacaaagaaaaauuacucaauaggccucgauauagguacaaacucaguuggaugggcagucauaacagaugacuauaaaguaccagcaaagaaaaugaaaguacuggguaacacugauaagaaauacauaaagaaaaaccugcuaggagcacuucuauucgacaguggugaaaccgcugaagcuaccagauuaaaacguaccgcuagaagacgcuacacucgcagaaagaauagacuaagauauuuacaagaaauauuugcaaaugaaauagcuaaaguagacgaaaguuucuuccaacgacuagacgaaucauucuuaacugacgaugacaaaaccuuugauucucauccgauauuugggaauaaagcugaagaagacgcauaccaccaaaaauuuccaacgauauaccaccuaagaaaacaucuagcggacuccucagaaaaagcugaccuaagguuaguauaccucgcauuagcacacaugauuaaauuuagaggccacuuccucauagaaggagaauuaaaugcagaaaacacagaugugcagaaaauauucgcggacuucgugggaguauauaauagaacauucgacgauagucaccucuccgaaauaacgguagacgucgcuaguauacucacagaaaagauaucgaaaagcagaagacuagaaaaccuaaucaaauacuacccuacggagaagaaaaauaccuuauuuggaaaccuaaucgcacuggcucugggucuacaaccaaauuucaaaacaaacuucaaacucucggaagacgcaaaacuucaauuuucgaaagauaccuaugaagaagaccuugaagaauuacuaggaaaaauuggugacgacuacgcggacuuguuuaccagugccaaaaaucuguacgaugcaauacuauuaucagggauacucaccguggaugacaacagcacaaaagcaccacuaucagcaucaaugaucaaaagauaugucgaacaucacgaagacuuagaaaaauuaaaagaguucauuaaagcuaacaaaucggaacuuuaccaugauaucuucaaagauaaaaacaaaaacggauacgcaggauauauagaaaauggaguaaaacaagaugaauuuuacaaauaccucaaaaauauacucuccaaaauaaaaaucgaugguagcgauuauuuccuagacaaaaucgaacgagaagauuuccuuagaaaacaaagaacuuucgacaacggauccauaccccaccaaauacauuuacaagaaaugcacgcaaucuuaaggagacaaggggauuacuacccguuccuuaaagaaaaacaggaccgaauugaaaagauauuaacauuccgcauaccauauuacguuggaccacucguaagaaaagacagccguuucgcaugggcugaauacagaucggacgagaaaauaacuccauggaacuuugacaaagugauugauaaagagaaaagugcggagaaauucauaaccaggaugacacuuaacgauuuauaucugcccgaagagaaaguauuaccuaaacacucacauguguacgaaacauacgcuguauacaaugaacuaaccaaaauaaaauauguaaaugaacaagggaaagaauccuucuucgacagcaauaugaaacaagaaauauuugaucauguuuuuaaagaaaacaggaaagucacuaaggagaaauuauuaaauuaucucaacaaagaauuuccggaauacagaauaaaagaucuuauuggccuugauaaggaaaacaaauccuucaacgccagcuuaggcaccuaucacgaucugaagaaaauauuagacaaagcauucuuagacgacaaaguaaaugaagaagucauagaagacauuauuaaaacccuaacccucuucgaagacaaagauaugauccaugaaagacugcagaaguauucagacauuuuuacugcuaaucaacuaaagaaacuagaaagaagacauuacacuggauggggaagacucucguacaaacuaauuaacggaauacgaaauaaagaaaacaauaaaaccauucuugacuaccucauagacgacggauccgccaacagaaauuuuaugcaacuaauuaaugaugacacucuaccauucaaacaaauuauacaaaaaucacaaguaguaggagauguagaugacaucgaagcaguaguacaugaucuaccugggucucccgcuaucaagaaagguauacuccaaucaguuaaaauagucgaugaacucguaaaagucaugggaggaaacccagacaauauaguaauugaaauggcacgugaaaaccaaacaacuaacagaggacgaucacaaucucaacagagauuaaagaaacuacaaaauucacuuaaagaauuaggaucuaacaucuuaaaugaagaaaaaccgaguuacauugaagauaaaguagaaaauucacacuuacaaaaugaccaauuguuuuuauauuacauccaaaacggaaaagacauguauacaggagaugaauuagauaucgaucaucuaucugacuaugacauagaccacaucaucccacaagcauucauaaaagaugauagcauagauaauagaguacuaacaucuucagccaaaaauagaggaaaaucugacgauguccccaguuuagauauagucagagcaagaaaagcagaauggguacgacucuacaaaucaggcuuaauauccaagcgaaaauucgauaauuuaacaaaagcugaaagaggaggauuaacagaagccgauaaagcggguuucauaaaaagacagcuaguagaaacaagacaaauuacaaaacauguugcucaaauucuagaugcaagauuuaacacagagcaugacgaaaacgacaaaguaauuagggacguuaaagucauaacccuaaaauccaacuuaguuucgcaauuccgaaaagacuucgaauuuuauaaagucagggaaauuaaugacuaccaucacgcucacgacgcauacuuaaaugccguugucgggacagcauuacuuaagaaguacccaaaauuagcaucagaguucguauacggagaauacaagaaauaugacaucagaaaauucaucacaaacagcucagacaaagccaccgccaaauauuucuuuuacucaaacuuaaugaacuucuuuaagacaaaaguuaaauacgcagacgguacaguuuucgagaggccuauaaucgaaacaaacgcagacggugaaauugcauggaacaaacaaaucgacuuugaaaaaguuagaaaaguacuaucauacccccaagugaauauagucaagaaaguugaaacacaaacgggagguuuuucuaaagaauccauauuaccaaaaggcgacucagacaaauugauacccagaaaaacuaagaaaguauauugggauacgaagaaauacggagguuucgauuccccaacuguugccuauagcguauucgucguagcagauguagaaaaaggcaaagccaagaaacuaaaaacaguuaaagaacucgucgguauaucuauuauggaaagauccuuuuucgaggaaaacccgguugaauuuuuagaaaacaaaggauaucauaauauaagagaagacaaacuaauuaaacuaccaaaauauagcuuauuugaauuugaagggggccgaagaagauuauuagcaagcgcaucagaacuacaaaaaggaaacgaaaugguucuaccagguuaucuugucgaacuuuuauaucacgcacaccgggcugacaauuuuaauucuaccgaauaccuaaauuacguaucagaacacaagaaagaguucgaaaaaguacuuaguugcguggaggauuuugcaaaucuauauguagauguagagaaaaaucuaucaaaaauuagggcuguggcagauagcauggacaacuuuagcauagaagaaauaucaaacucuuucauuaauuuacuaacauuaacagccuuaggagcaccagcagacuuuaacuuccuaggagagaaaauaccgcgcaagcguuauacaucuacaaaagaaugucugaaugcaaccuuaauccaccaaucaauaaccgguuuauaugaaacacggauagauuuguccaaacuaggagaagaauga

SEQ ID NO: 5479 - RNA, 4119 nt, Artificial Sequence
  Cas9 variant
augaacagugauaaaagggaagauuacuacguuggacuggauaugggcacuggaagucucggaggugcuguuacagauacccaguaucaccuacuaaaaguaaaaggaaaagauuucugguucguacgugaauacgagacagcaaaaucacaauuagauagaagaacacaucggauagcaaaaagacguuuacaacggcacaaagcacgaauaggcuuaaucagaucuuauuuugcagaagacauacucaagcaugacccacuauucuacaucagacaggauaauuccaaauacuaccaugaagauaaagacguacgguuaaccaccaaagauucaauauuugcugauccaggauacggagacaaggaauaucuagaugauaaagaauacccaacaauuuuucaccuacgacaagcauuguuaagagaucagauaaaagacgaagaacguuauagucguuucuuauaucuugcaaucaucaauauguuugagcauagaggucauuucuuacucaauacagaaucaagcgaucuuaacgccgacaugauaaaagacgucggagaacucgucaugaacgcuauauguggaguuagugaauacggaucaguaaccuacaaagaaauuauagaaauuuuagaagacaaaaauauaucacggacugcuaaaaaagaucaaauagcuucaaaaauagacaucaaaaaaucagaaaaagcucaaauggaaaggaucaaaugcuuaugugguauggaagcagaugcaagaguaauguucgaaauagaagcggacgaaaagauuaaaauagcauuucaacaagcggcauuugaagaugaaaaagaagagauagaagcagugauaggagaagacagauauuuaauaaucgaaaacaugaaacaacuauaugauuauagccaacuccaaagcguauuaaauggauuugauuaucuaucagacgcuagagugcaaauguaugaaaaacauaaagaagaccuucaccuauuaaaaaaaguguauagaaagaaucucgacagagaaauauacgacagaauguuuaggaguggcgaagaaggaucuuauugcgcguacucuaauaguacaaauagcguagauagccucgcugaagcuaaaaaauacagacgaaacaugaaaaaaaggagucaaaaggacuuauaugacagaauaaaaaaagaccuaaaggaaguacaugaugcagaugcugaugcaauacguaaagaaauggaauuggaacgguucuuacccaaacaaaucacaggggccaacgguauuauuccgaaccagguacauagaaaagaauuaaaaaaaauacucgagaaugcagagcaucaucuagacuuccuaaaagagaaagacgaaaguggcuauacaguaucugaaagaauacuaauguuauucucaagcaacauaccuuacuaugucgguccagugggcaguggaagcaagaccggcugggcaaagauucaagaauccggucaaguauuaccauggaauauggagcaaaaaauagauauagaacaaaccagugaaagauucaucacgaaucuaaucagggagugcacauaccugucaggagagaaaguauuaccaaaacaaagucuauuauaugaaucauacugcguccuuaacgagauaaauaaccuccgaauacacggcaaacgaauaguuccagaacuaaaacaagauauuuauaaggaaguauuucaaggauuuagacuugguaaaaaaguaacaaaaaaaaauauauguacauaccuuauaaacagaggauuaauaacggaagaaagcgaaguaagcggaauagacaaagaaauaaacgcauaccuuccaucauauggaaaaauguauggcguauucggagaaagacuaagagaagaggcuguucaagagauagcugaaaaaauaauauacuacggaacgauauacggcgaugcaaagucuauguucagaaaaaaauuaaaccaauauguaagugacggauggaugacagaauaccaagcaaaaagaauaaguggauauaaauucaaggacugggccagauuaucaagaucuauguuaugccucagcggaugcgacaagucaacuggggaaaaaaucuccuuaauaagagccaugugggaauauaaccuaaacuuuauggaacuaauauacagggaagauuucacuuuccaaaaggaacuagaagagagaaggaaagcauuaggcaagacguuacaagaguuccaauucgaggaccuagaugaauauuauuacucagcaccaguuaagaggaugauuuggcaagcaguucaagcauuaaaagaaauaacccaaauaaugggacauaauccaaaacguauauuuauagaaaugacaagaacggaagaagaaaaaggcgagcaaggaagaaaaaacagccgagaaaaaagacuacuaaaaauguacgaaagcauucgagaugagagaaacugggcagcagaaauaaaaaaugcuaacgcuucagguaaacuaaauagcaaaaagcucuauuuauacuauuuacaaaugggacgagauguuuacacuggagaacccauagauauagaagaccuauucgacgacucaagauacgacaucgaccacauauauccccgaaguuuaacaaacgauaacaauauagaaaauaaucucgugcuaguaucaaaaacaauaaaucaaaaugaaaaaaaaaacgauuaucccguaccagaaaaaauuagacgcaauaaaaaggugagaaaucuuuggcauacacuacauaagaugggauuuaugaaugaugaaaaauacaaucgauuaacauccacugaaagacuauccgaggaccagcucgcaggauucauagcaaggcaacuaguugaaaccgcacaaggagcaaaaggaauagccgaauuaaugaaggcaaugcuaccaggcacugacauaguauacgcuaaagcuagaaauguaucagauuucagaaaagaauacaaaaugcuaaaaagcagguuaguaaacgacuaucaccaugcacaggaugcuuaccuaaacauagugguagguaauguauacuuuaugaaauuuacaagaaacccaaugaauuuuguaaaaacggaagcaagacgggacggacgaaauuaugacuacaaccuauauaaaauguauaguaaagauaucauaagaaacggcgaaaaagcauggauugcaacaagcgaacaaggacccgguaccaucagacuaguaaaagaaacuaugggacgcaauacaccuauaauuacacgccaagcguucgaacaaagaggagaauuauuuaauuugcaaccuguagguaaauauagugccaaaaaagauaauuacgugccgcucaaaauaaacgaugaaaaaaugcaagacguaagcaaauaugggggauacacaucucuaaauccaaguuauuuuauauuuauugaacacgguccagaaaaaaaaagaaaaaaaugcuucgaaguuauacauucguauuacgcugcucaaauaaaaacagaaaaagauuuaauagauuuucucuuacagaagggcuauaaaaauccaagaguaauaaaugcuagaauuaaaaaaaacgcacucauaaaauacaacggauauuucuuauacauuauaggaauggaugcaagaaaaaacauagaguucagcaaugcgacagcaaugugucugaaaaacaaauauauucaauauguaugcaaauuggaaaaaaugaacaaagcaauucuauugucggaaaaacagaaaacuaacuuacacugggacgagaaaaucacaugugaaucaaacuuagaguuauauagggaauuaacagaaaagcaucuacacucgaucuaccaaagacaccccagaaguauaggaaaaugcuuagcggacggagaaggugcauuuaaacuacuugauauagaggaacaaguaaaaauaauaugcgauauaguacaauacacuuccuuucaacgcggaguauuuagcuuaaaaguucuaggaggaccgaaagaagugggccgaauaagaauaagugguaauaugaccgaagcgaaagaaugcaaguugguaaauuacucaauaacaggcauguauaaaacagaaauggaucuucuaaaaaaauga

SEQ ID NO: 5480 - RNA, 4122 nt, Artificial Sequence
  Cas9 variant
auggaaaaaacauacucuaucggacuggauauaggcacuaauuccguuggcuggucggucauaaccgaugacuacaaagugcccgccaaaaaaaugaaaguacuaggcaauaccgauaaaaaauauaucaaaaaaaacuuacucggugcgcuccuuuuugacaguggagaaacugcagaaguaacaagauuaaaacguacagcaagacgacgcuacacacgccgcaaaaaucgacuuagauauuuacaagaaaucuucgcaaaagagauggccaaaguagacgaauccuuuuuccaaagauuagaagagaguuuccucacugacgaugauaaaacauucgauucucauccuauauucggaaacaaagcagaggaagacgccuaucaccaagaauuuccaacaauauaccaccugagaaaacaccucgcugauucgucagaaaaagcugacuuaagauuggucuauuuagcacucgcucacaugauuaaauucaggggucacuuccuaaucgaaggugaacuaaaugcagaaaauaccgacauacaaaagcucuucaacgacuuuguagaaacuuacgauaaaauagcggacgaaucccaucuuagcgaaguugaugccucaucuauacuaacaaacaagauaucuaaaucgcgaaggcucgaaaacuugaucaaacaauacccaaccgaaaaaaaaaauacccuauuuggaaaucuuguugcauuaguguuaggacuacaacccaauuuuaaaaccaauuucaaguuaucagaagacgcaaaacuccaguuuucuaaagauacauaugacgaagaucuagaagaacuucuggggaaaauaggggaugauuaugcagauuuguucaccgcagcuaaaaacuuauaugacgcaauauuacugucagguauacugacuguagaugacaauucuacuaaagcaccccuaagcgccucaaugaucaaaagauacgaagaacaccacgaagaucuggaaaaacucaaaaaauucauaaaaguaaacaauuucgacaaauaucacgaaauauucaaagauaaaagcaaaaauggauacgcuggcuauauagagaauggcguaaaacaagauauuuuuuacaaacacuuaaaaucaaucauaagugaaaaaaaugguggucaauacuucuuagacaaaauugaacgagaagacuuccucagaaaacaaagaacauuugacaacggauccauuccccaccaaauccaccuccaagaaaugagggcgauauuaagaagacagggggaauacuauccguuuuuaaaagaaaaucaagccaaaaucgaaaaaauucuaacauucagaauuccuuauuacguaggaccucucgcgagaaaagacaguagauucgcaugggcaaacuaccacuccgacgaaccaauaaccccauggaauuuugacgaaguaguagauaaagaaaaaucagccgagaaauuuauaacaagaaugacacuaaaugaucucuauuuaccugaagaaaaaguacuacccaaacauucucacguuuacgaaaccuuuacagucuacaacgaauuaacuaaaaucaaauauguaaaugaacaaggagagucauuuuuuuuugacgcaaacaugaaacaggaaauauucgaucacguuuuuaaagaaaaucguaaaguaacaaaagcaaaauuacucucauaucuaaauaaugaauucgaagaauuuaggauaaacgaucuaauaggacucgacaaagacagcaaaucauucaacgcuagccuagguacguaucaugaccuuaaaaaaauccuagacaaaucauuccuugacgauaaaacgaacgagcagauaauagaagacauaguccugacauuaacacuauucgaagauagagacaugauccacgaacguuuacaaaaauauucagacuuuuuuacuagccaacaauuaaaaaaacuagagaggagacacuauaccggaugggggagacuuucauacaaauuaauaaacggaauaaggaacaaagaaaauaacaagacgauauuagauuuccuaauagaugauggucaugcuaauagaaauuuuaugcaacuaaucaaugaugaaagccuaucauucaaaacaauaauccaagaggcucaaguagucggcgacguagaugauauagaagcuguuguacacgaucucccagggagcccagcuauaaaaaagggaauauuacaaucuguaaaaauaguagacgaacuaguaaaagucaugggcgacaauccggauaacauaguuauagaaauggccagagaaaaccaaaccacuaaccgagagaggagucaaucccaacaaagacuaaaaaaacugcaaaauucucuuaaagaauugggcucuaacauucuaaaugaggaaaaaccaucauacauagaagacaaagucgaaaacagucaccuacaaaacgaccaacuguuccuguacuauauacaaaauggaaaagauauguauacuggugaugaauuagacauagaucacuuaagcgauuacgauauagaucauauaauaccgcaagcauuuauaaaggacaauagcaucgauaacagaguacuuacuagcagcgcaaaaaaucgaggaaaaagcgaugacguuccuucacuagauauugucagggcaaggaaagcagaauggguacgauuauauaaaagcgguuuaauaucaaaaaggaaauuugauaacuuaacgaaagcggaaagaggaggccuaacagaagcagacaaagcaggauucauaaaaagacaauugguggaaacacgacaaauaacaaaacauguagcccaaauacucgaugcuagguucaacacgaaacgagacgaaaacgauaaaguuauuagagacguuaagguuauaacacucaaaaguaaccucguaucacaguuuagaaaggaauucaaauucuacaaaguaagggaaauaaacgauuaucaccaugcccaugaugcauaccucaacgcaguaguugguacagcuuuacuaaaaaaauaucccaaacuaacaccagaauucguuuauggagaauauaaaaaauacgauguaagaaaacuuauagcgaaaagcuccgacgacuauucagagauggguaaagcaacugccaaauacuucuucuacucaaaucuuaugaauuucuuuaaaaccgaaguuaaauaugcugacggucgaguuuuugaaaggccagacaucgaaacaaaugcagauggagaaguuguauggaacaaacaaaaagauuuugacauaguacgaaaaguacucagcuauccucaagucaauauagucaaaaaaguagaagaacaaacaguaggccaaaaugguggauuauuugacaacaauauuuuagcuaaaccugaaaaagaugauaaaaaaaaacuuuuccccaucaaaaagagcuuaaguacaaccucuuaugguggauacgcccgagcaacaauagcguacucuauucucauaguaagcgaguucggcaaaaauaaagaacuuaaauuauuaggccuaccucuauuagauaaaguaaaauaugaaaaaaacccuauagcuuaccuaaauaguauagguaucaucaacguuaaaucaauauucaaauuaccaaaguauugucuauucgaauuucaagaaaaaaacacaaauuauagaagauauauggucucuaaccaggaacuaaaaagagccaaccaacuauuccuaacaugcaaagaaaccgaauuaguauacaaauauauaaaauccgacaaugacaacacccaccucgucgguaacgaaaagacaaucuuaucuaucuggaauaaauuaguaauauuuauggaacggacuaaauuaauagauaaaaaacuauuugcaagccuaaaacaacuaaaagaugaagucgaucucauaaacauacuugacaugacugcaaaaagccuagacuucacaaaaauaucagccggccaaaaaaaaauaacaauaagcgauucauuaagucuacccauuaaaagauggcaguuuaguucagacgaaaaaaugcuaaaacaauuaaaaacagcaaccuuaauccaucagucaguaaccggacuauacgaaacuagaauugauuuaucuaaacucggugaagaauga

SEQ ID NO: 5481 - RNA, 4122 nt, Artificial Sequence
  Cas9 variant
auggagaaaacauauuccauaggucucgauauaggaacaaauagcguaggauggaguguaauaacagacgauuacaaagugccagccaagaaaaugaaaguacuaggaaauaccgauaagaaauauaucaagaaaaaccuacugggcgcuuuacuauuugacucaggugaaacagcagaagucacuagauuaaaacgcacagcacgaagaagguacacgcgaaggaaaaaccgccuaagauaucuacaagaaauuuuugcaaaagaaauggcaaaaguagaugaaucauucuuucaacguuuagaagaaucauuucuaacagaugacgacaaaacuuucgauucacacccaauauucgggaacaaagcugaggaagacgcguaccaucaagaauuuccgaccaucuaccacuuacgcaaacaccuagcggacucaucugaaaaagcagaccuaagauugguauaccucgcauuagcucacaugauaaaauucagagggcacuuccugauagaaggagaauuaaacgcagaaaacaccgauauacaaaaauuauuuaacgacuuuguggaaacauacgacaaaauagcagaugaaagccauuuaucagaagucgaugcaucaucuauccucacaaauaaaauauccaaaucaagacgacucgaaaaccuaauuaaacaauauccaacagagaagaaaaauacacucuucgggaaccuaguagcccuaguacucgggcugcaacccaauuuuaaaacgaacuuuaaauugucagaagaugcaaaacuucaauuuucaaaagauacauacgaugaagaccuagaagaacuuuuaggcaaaauaggggacgacuacgcagaccuauuuacagcggccaaaaacuuauacgacgcaauccuccucuccgguaucuuaaccguagaugauaauuccacuaaagcgccccuuucagcaucaaugauuaaaagauacgaagaacaccaugaagaucuagaaaaacucaagaaauucauuaaaguaaacaacuucgauaaauaucaugaaauuuuuaaagauaaaucgaaaaacggcuacgcaggcuauauagaaaauggaguaaaacaagauaucuucuacaaacaucucaaaucuauaauaucugagaaaaacggcggacaauauuuccucgacaaaauugaacgcgaagacuucuuacggaaacaacggacauuugacaauggcucaauuccgcaucaaauacaccuucaggaaaugagagcaauucuacgucgacaaggggaauauuauccauuccugaaagaaaaucaaucaaaaauagagaaaauacuaacguuuaggauucccuauuacguaggaccccuagcaaggaaaaauucaagauucgcaugggcuaaauaccacucagaugaaccaauaacccccuggaacuucgaugaaguaguagauaaagaaaaaucagcugaaaaauucauuacaagaaugacccuuaacgaucucuaccuaccagaagaaaaaguccuacccaaacauucccacguuuacgaaacauacgccguauacaaugaauugacaaaaauuaaauacguaaaugaacaagguaaagaaucauucuucgauucaaacaugaaacaagaaauauuugaucacguguucaaagaaaaccgaaaaguuacuaaagaaaaauuacuaaauuaccuaaauaaagaguuccccgaauacagaauuaaagacuuaaucggacuagauaaagaaaacaaaucuuucaaugcuucauuagggaccuaccaugaucucaagaaaauacuagauaaaucuuuccuggacgacaaaguaaacgaagaaguuauagaagauauaauaaaaacacuaacccuuuuugaagacaaagauaugauacaugaacgcuuacagaaauauagcgacauuuucaccgcaaaccaacuaaagaaacuagaaagacgccauuauacaggguggggaagauuaaguuauaaacuaauaaacggcauucgaaacaaagaaaauaauaaaacaauccucgacuaucuaauagacgacgguagugcuaacagaaacuucaugcaauuaauaaacgaugauacacuaccauucaaacagauuauccaaaaaucccaaguaguuggagacguagaugauauagaagcaguaguccaugaccuacccggcaguccagcaaucaagaaagggauauuacaauccguuaaaaucguggacgaauuaguaaaaguuaugggaggaaauccagauaacauagugauugaaauggcacgagaaaaucaaaccacuaaucgagguaggucgcaaucacaacaaaggcucaagaaauuacaaagcucauuaaaagaacuagguaguaacaucauaaacgaagagaaaccgucauacauugaagauaaagucgaaaacagccacuuacaaaacgaccaacuauuuuuauauuacauacaaaauggaaaagacauguauaccggagacgaacuagauauagaccauuuaagcgauuaugauauagaucacauaauaccgcaagccuuuauaaaagaugauaguauagacaaccggguacuaacaaguuccgccaaaaauagggguaaaucagaugacguaccuagccucgacauaguaagagcacgcaaagcagaauggguuagacucuacaaaagcgggcucaucucaaaacgaaaauucgauaaccuaacuaaagccgaacgaggaggacuaacagaagccgauaaagccggauuuauaaaaagacagcuaguagagacgcgccaaauaacuaaacauguagcccaaauucuugacgcgcguuuuaauacugaacaugaugaaaacgacaaaguaauaagagacguaaaaguuauaacccuaaaauccaaucuaguaucgcaauuccgaaaagacuucgaauuuuacaaaguacgcgaaauaaaugacuaccaucaugcacaugaugccuaucuaaaugcaguagucggaacggcauuacuaaagaaauacccaaaauuggcaccagaauuuguauauggagaauauaagaaauacgacgugaggaaacuaauugcaaaaucuucagacgaccacucagaaaugggcaaagcuacagcaaaauacuucuuuuacagcaacuuaaugaacuucuucaaaaccaaaguaaaauacgcagacggaagugucuacgaacgaccaauaaucgaaacaaacgcggauggcgaaguaguguggaacaaacaaaaagauuuugaaaucauacgaaaagucuuaucauacccucaggugaauauagucaagaaaguagaagaacaaacagucggccaaaacgguggacuuuuugacaacaauauacucgcaaaacccgaaaaagacgauaagaagaaacuuuuuccgauuaagaaauccuuaaguacaacuucauacggcggauaugcaagagcaaccaucgcauauucgauuuugauaguuucugaauuugguaaaaauaaagaguuaaaauuacuaggacuuccccuuuuagacaaaguuaaauacgagaaaaauccaauagccuaccuaaacucaauaggcauaauuaauguaaaaucaauauuuaaguuaccaaaauauugucuauuugaguuccaagagaaaaacacaaacuacagacguuacaugguaucaaaucaagaauugaaaagagcuaaucaacuuuucuugacuuguaaagaaacagaacuuguguacaaauauauaaaaagugauaaugauaauacucacuuggucggaaaugagaaaacuauccuuaguaucuggaauaagcuaguuauauucauggaaagaacuaaacuuauagauaagaaacuauuugcaagucucaagcaacuaaaagaugaagucaaccuaauaaacauccuugacauagcaucuaaauccauugacuucacaaaaauuagcgcaggucaaaagaaaauaguacuuaaugauucucucucuuuaccaauaaaacgauggcaguucaaaucagaugagaaaaugcugaaacaauuaaaugaugcgaccuugauucaccaaagcauuacaggacuuuaugaaaccagaauagaccuaagcaagcugggagaagaauga

SEQ ID NO: 5482 - RNA, 4122 nt, Artificial Sequence
  Cas9 variant
augaauuuaagacgagcuagagauuacagcauaggacuagacuuagguacaggaaguguggguugggcugucacagacgcagaaggaaaucuauacaguuucaaaggaagaccggcaaugggcaguagaacauuuccaaaugcggaacccgcaucaguagccagaauaccgaggggucaaaggcgaagauacgaacguagaagacaaagaauaaaacuacuucaacaauucuuuaugagugacauggaaagagucgaucccgacuucuuuacgagauuaaaucaaucaacacuauuagcagaagauaaagaugagagaauagcaaguugcgcauggccuauauuuaauucauccgacuuuacagaaaaagauuacuacaagaaauuuccgacuauauaucauuuacgcgcuuuucuuugugaaagcgacgaaaaaggcgaucuacgacucguguauuuagcccugcacaauauaguaaaacauaggggaaacuuuuuguaccaagauaauccugcauugagugcaucugaugcuucagucgaugaagcgguuagacaauuaguagaugcacuagcugaauggugucagaauaaagaaauagagcuuucuugugaugcagggagaauuauagaaguguuuggugaugcaucgcucagaagaacugauaaaagagaucaauuaaaaggauuauuaggauuaccugcagaucuagcgaaaacuaugggcaaagagcuugcaucggccguauuagguuaugcagcaaacuuuucuaaaaucuuucuaauaucagaugcagaacauaaguuuucauuagggaacgacgaaaaggucgaggaauuugaaacaaucugcccaaaugaauguaccagccucuucagcgcacuacguacagcguacucagcauauuuauuaucuggcauucuaagagaugcuaauggaaaaacauuaaguuucuguaagaagaaagaauacgaucgauaucacgaugauuuagcauuacuuaaagcauuaguuagagaauacgcgcccgaaaguuaucaaucauucuuuggaggggaacgguuaguaguaaacggcagaaugacaaaacgguaugauccaacaaaagcuaaaggguauaccaaauacgaucuuguucauagugcugguaguuacgacgaguuagcaaaagauguaaagaaacuccuugggaguuuagcagcugaugauucaagauaucaacgaaugaugcaagcauuugaugaagaacgguuucuuagaaggcuuaaaacgucugauaaugguucgauuccauaucaacuucaccuagaagaacuaagagcaauaauagcaaggcaaggugaauuuuauccauucuuaaaagaggaaaguaaaaagauagaaucccuaguaaguuucaggauaccuuauuauguagggccauuaacgacuaaaaacgccgcuguagauguucacgguaauaaacgauuugccuggucggagagaaagcccggaauggagagcgcuaaaguaagaccauggaauugggacgauguaaucgacagagguaaaucagccgaaaauuuuauaguaagaaugacaggaacaugcacuuaucuccaaaacgagaaagucuuaccaaaaugcagcuuacuauaugaggaauuuugcguguuaaacgaauugaacggagcccauugguccgcugauggagaccaugagugccccuuugauacaagcgacagaaggggaauaguccaggauuuauuuugugggaaaagaagagucucauacaaacaagucgaagacuggcuaagacagcacgguucgcggagagcaagaguauccggaggacaaggugcgagugguuuugaaucaaaaaugucuucguauaucuucuucucaaaagauguuuugcauguagauagaauagauccugcagauuucccuaugauugaagaaauuauacuuuggaauacguuauucgaggaccgagauauauuaaaagaaagaauagaagaagcguauggcgacagacuaaaugcagaacaaauuaaaacaauaugcaaaaagagguucacaggaugggggcguuuaagucgaagacuuuuaacaggaauaaaggcucaaacagaccaaggggauuuaaguauaauggacauuuuaagagaaggagauccgaauaaugaucacagagguaaagcaaugguguucaugggaauacuccauagcgaagauuuaggauuucaaaagaaaaucgaucagauuaaucaagagaaaguuucugcagguaaaguuaguuuagaggauuugccugguaguccagcacuuagaagaagcauaaaccaagcaaugagaguugucgacgaaaucguuucaauugcaaaaugcccacccucucauauauaucuagaagucacaagagaugaagauggagcaaggaaaggacgaagaaguacgagaagauacgacgcuauaaaagcugcauuagaaaaauuuaaagaagagucacccacaugguucgaccaagacgucuuuggagaauuuagaagaagcagagcagaagaucuagacgaaagauuaucgcucuacuuuaugcaaggagggaaaagucuauacucagcuacaccacugaaauuggaacuauuacacacuaaucaauaucaaguugaucacauaauuccucaaucauauauaaaagaugacagcuuugaaaauaaggcuuugguacuagcuggagaaaaucaaagaaaaagcgaugcucuauuaauagacucgaguauacgaacugcgauggccccauacuggcgugcucuccaucaagccgguuuaaugggggauaagaaauuuaauagcuugaugugcucgucuauaagugacaaaagaguaagaggauucauagcaagacaacugguagaaacaagccaaauaguuaaacuagcaggaaugauguuacaaaguaauuacccagaagcagaugugcaaccaguaaaagccucguuaggacacgaucucagaguacaagcuggauuuauuaaaugcagagaagugaaugacuuucaccacgcccaugaugcccucauugcaugugaaguugguagguauauaaaucaaugucaucccggcauuuaugauaauccuauaggauacgcaagagcuguaagggaacuuguaagaaagcagaaugaagaaaugcguaaauacggcagacuuccaggaucagcaggguuuauaguaggagguuucaugagaacccauguagacguugauacaggagaagucguuugggacgcugaagaggaacuaucccgaauaagagcauaccuugacuauucaaacguauucgucacacgaauguccgaagaaacaucaggugcguuguggaaugcuacaaucuacagcccacacuacgggaaaacugcaccaacauuacacauaaaacaaggauuagauguacaaagauacgguggguauuccucagcuacauucgcuuauuuuacuuuauauguagcagaaaaaggaaagaaaagaaaagcggaacuauuaggaauaccaauaucaguagcccggaaaauagaaggagaaccaaguaaauuggaugcauucguagcucaagaugccgaagcgaagaaacuaaaacacccacuuauaauaagagcacgaauauuaaaauacgcaagauuugaaauggaggguaaucaauuuuauuuugcagcacaagaugcaguuuacucagcaaggcaguuaguauuaaaaggugaucuauacucaguagccgcaaaagccugugauaaacacuugaaugacagcuguaucaguaaugaagacuuaauucgguuauaugaugaauugguacauaagggggauuuauuaugcaauaaauuuggcaauguuacggauguucuccgagcaggcagagaaagauaugcagggcuaaguauaagugagaaacgacagcuagucuguaauguucuggccuauuacagauccgccacggcaagaguugacauaucauuaguagguggacccaaacaugcagguaauuuagggaucgccuuuguauuaaacaauccagaagcaauagucuucguagaucaaaguguaacagggauguuugagaaaagaaccagaguagaacuauga

SEQ ID NO: 5483 - RNA, 4122 nt, Artificial Sequence
  Cas9 variant
augaagaaaauacuuggucucgaccuaggaacaaacucgauaggaugggcuuuaguaaacgaagcggacaacgaaagagaaaaauccagcauaauaaaaauaggagucagaguaaacccgcuaacagucgacgaacaacaaaauuucgaaaaaggaaaauccauaacaacuaacgcagaucguacucuuaaaaggagcaugcgccguaauuuacaaagauucaaacuacgaaaagaaaacuugauagaaauucucaagaaacaaaaauuuauaaaugaugaaacaauauuaagcgaaaauggaaacaaauccacuuuugaaacauacaaucugagggcgaaaagugcuacagaagaaauaacacuagaacaauuugcacguguacuacuaaugaucaauaagaaacgaggauacaaaaguagcagaaaagcaaaaucacaagacgaaggacaauuaauagauggaauggaaauagccaagaaacuauauaaugacaaucuaacgccagggcaauucguuuuccaaauucugaaagaagguaagaaauacauacccgacuucuacaggagcgaccuucaagccgaauuugacaaaauauggucauuucaaaaacaauuuaaccccgauauccuaacagaagaauuuaauaaacaaaucauaggaaaagggaaaguaaauacaacuaaaauauuucuggcaaaauacgguaucuauacaauagacaauaaaggggcagacaagaaaucucaagcauacaacuggagagucgaagcccuaaccaaccaauugacgaaagaagaauuagcauucguaauaucagaccucaacggaaucauaagcaauagcuccggauauuugggauccauaucagacagguccaaagaacuauauuuuaacaaacaaacagucggacaauaccuaauugcucaauuaaaagaaaacccccauacccaacucaaaaaucaaguguucuauagacaagacuaucucgaugaguucaacacaauaugggaaacccaagcaaaauuucauaaagaauugaccaaugaauuaaaagaagaaauacgagauauuauaauauucuaccaaagaaaacugaaaucucaaaaaggccuuauaucauucugcgaguucgaaucaaaacaaauagaaauuaauauagacggcaaaaagaaauuaaaaacagucggaucuaaaguaugucccaaaucaagcccccucuuucaagucuuuaaaauuuggcaaauacuaaacaauauacaagugauagaaaaaucgacaggcaaaaguaaauuuuuagaacaagaugaaaaagaaauacucuucaaagaauuaaauuucaaagauaaaauaaguaaaacagaugcccucaaaauucuauauaaaaauuauaaagaauuagauuucaauuuuaaagaaaauauagaaggaaaccguacccaagcaacauucuuaaaagcauuucaaucaauaauagaauuaucaggacacgaaguaucugauuuuagcaaaauaaaaacagacgaaauacuugaaauuguaacuccaauuuucgaaggguucggauucaauacaaauuuauuacaauuuaauaguaacuuaaaaggaaaagauuucgaaaaacaagccguuuaucaacuuuggcauuuauuauacucauucgaaggagacaacucgaauacaggcaacgaaaaauuaauacagaaaauaagcgaacuauacgguuucgaaagagaguacgcaauaauaauugccaacaucuccuuucaaccagacuacggcuccuuaucgacuaaagcuauaagaaaaauccuaccucaucuaaaagaaggaauagaauuuucauuagcaugugaauacgccggcuaccgacauagcaaaaacucacuaaccaaagaagagaaaaacaagaaaauauuaaaagauaaaaucgacauuuuaccgaaaaauagucuacgcaacccagucgucgagaaaauucuaaaccaaaugauaaacguagucaacgcaacuaucgaaacauauggcaaaccugacgaaauacgaaucgaacuagcucgagaacucaagaaaucggccaaagagcgagaagaccuaaccaacgcuauuaauaaaucaaccuuggaucaugaaaaauacaaagcacugcuacaaaaagaguucggacuaucaaaugucuccagaaacgauaucauaagauacaaauuauaucuagaacucgagcacaacggcuuucacacauuauauucaaacacuuacauagaaccaaacaaacuauuuucaaaggaguucgauauagaacacauaauuccccaaagcagacuauucgacgacucguucucaaacaaaacaauagaaucucguagcgcuaauaucgaaaaagguaaugaaacagcauucgacuacguaagcaacaaaaauggcgaaguaggacucaaggauuaucuuaagaacauagaagaccuauuuaacaaugguaaaaucucaaaaacuaaauacaacaaauuaaaaaugaaaggugacgaaauaccgucagacuucaucgcccgagaccuaagagacacucaauacauaucaaagaaagccaaaucuauuuuagaagaucuaguaaaagacguagucucaacaggugguuccaucacugauagacugcgcgaagauuggcaauuaauagauauaaugaaagaacucaacugggauaaauaugacaaauuaggucuaaccgaaguaauagaaaacaacgauggacacaaaauaaacagaaucaaagauuggacaaaaagaaacgaucaccgucaucaugcaauggacgcauugacaauagcauucacaaagagauccuacauacaauaccucaacaauuuaaacgcaagaucugacaaaucaggaagcauuuacgggauugagcaaaaagaauuauaucgcgauaaaaacaauaagcucagauuuaaaccaccaauaccacuagacgauuuuagagcagaggccaaaaagcaacuggaaaacacccuaguuuccauaaaggcuaaaaacaaaguagcgacaaucaacauuaacaauacuaagaaacaaggcggagagaacaagaagaaacaacuaaccccacguggccaacuacaucuagaaaccauauacgggucgauccaacaauacgucacuaaagaagaaaaaguaggagcaaauuuuaacaaagaacuuauagaaaaaguagcaaacaagaaaugcagagaagcacugcucaaacgcuuaauagaguucgacaacgauccaaagaaagcauucaccaggaaaaacucacuuaauaaaaauccauuauacaucgacacuauaaaaaccuacaaaguaccagaaaaagucaaaaccguaacuacagaaacaauauacacgaucagaaaagacauaaauccugaccugaaaaucgauaaagucguagauaagaaaaucaaaaacauccuagaacugagauuaaaagaguucaauggagacgcgaaaaaggcuuucuccaacuuagaugaaaaaccaauaugguugaacaaagaaaaaggaaucuccaucaaaagaguaacaauaacugggaucaguaaugcuauagcgcuucacgacaagaaagauaaggaaggaaacuuuauacuagacaaccaaggcaagaaacaagccguagauuuuguaaauacaggaaauaaccaucauguagccaucuauaaggaugaaaaaggaaaucuccaagaaaacgucauaacauucuacgaagcagucgaacggguuaaucaggguaucccaauaauagauaaaacauacaaacaaaaugaaggauggcaguuccuauuuaguaugaaacaaaaugaauacuucguguuccccaaugagaaaacaggauuuaacucgaaugaaaucgaucuacucaauccagaaaauuaccaucuuauauccccaaaccucuucagaguacagaaaauagcaacaaaagauuacuucuuucgucaucaucucgagacuaaugucgagaacauaacaaccacaaaagacuuaacguggaaacgccuuggaauaaacggaauaauaaacauacuuaaagucagaauaaaccacauagggcaaauaguaucaguaggugaauacuga

SEQ ID NO: 5484 - RNA, 4122 nt, Artificial Sequence
  Cas9 variant
augacaaaaaaaaacuacucaaucggccucgacauaggaacuaauucaguaggcugggcagucauuacagacgauuacaaaguaccagcaaaaaaaaugaaaguacuaggaaauacggacaagaaauacauaaaaaaaaaucuacuuggagcauuacucuucgacucuggcgaaacagcagaagcaaccagauuaaaacgcacugcccgacgacgauauacucgcagaaaaaaccgccuaagguacuuacaagagauauuugccgaagaaaugacaaaaguagacgaaucauucuuucaaagacucgaugaaucauuucuacgaugggaugacgauaauaaaaaauuaggacgauacccaauauucggaaacaaagcagacgucguaaaauaccaccaagaguuuccaacaauauaucaucuacgaaaacacuuagcagacuccagcgaaaaagcagaccugcgucuuguauaucucgcucucgcacacaugauaaaauuuagaggacacuuuuuaaucgaaggagaacucaaugcugaaaacacagauguccagaaaauauuugcugacuucguagggguguaugaccgaacauucgaugauucgcauuuauccgaaaucacaguagaugcagcuaguauacucacagaaaaaauaucuaaaucacgucgacuagagaaccuaauuaaauauuauccuacagaaaaaaaaaauaccuuauuugguaauuuaauugcgcuagcacuaggccuacaaccuaacuuuaaaaugaauuucaaauuguccgaagacgccaaacuacaauucagcaaagacucuuaugaagaagauuuaggcgagcuguuagguaaaaucggugaugauuaugcagaccucuuuaccagugcuaaaaaccucuacgacgcaauacuauuaucuggaaucuuaauaguagaugacaauaguacuaaagcaccucuaagugccaguaugauaaaaagauauguagaacaccaagaagauuuagaaaaguuaaaagaauucaucaaagcuaacaaaagcgaacuuuaccaugacauauucaaggauaaaaacaaaaauggauaugcagguuacauagaaaauggaguaaaacaagacgaguucuauaaauaucuaaagaacacgcugucgaaaauugcagguuccgacuauuucuuggauaaaauagaaagagaagacuucuuacgaaaacaacgaaccuucgauaacggauccauuccacaucaaauccaucugcaagaaaugcacgcaauauuaagaagacaaggagauuacuaucccuucuugaaagaaaaucaagacaggaucgaaaaaauauuaacauuucgaauucccuauuauguuggacccuuagcaagaaaggauucaagauuuucuugggcugaauaccacagcgaugaaaaaauaacaccauggaacuuugacaaagucauagauaaagaaaaaagugcagaaaaauucauaacaagaaugacgcucaacgaccucuacuugccagaagaaaaaguauuaccuaaacacucccauguauaugaaacguaugccguauauaacgagcuaacaaaaauaaaguacguuaacgaacaaggaaaagauucguucuuugacagcaauaugaaacaagaaauauuugaucacguguuuaaagaaaaucguaaaguuaccaaggaaaaacugcuaaacuauuuaaacaaagaauucccagaguauagaauaaaagaccuuaucgggcuugacaaagaaaacaagagcuucaaugcaucacuaggcacauaccaugaucucaaaaaaauccuagauaaagcauuccuagacgauaaaguaaacgaagaaguaauagaggauauaauaaagacguuaacccucuuugaagauaaagauaugauccacgaacgacuccaaaaauauagcgacaucuucacagccgaccaauugaaaaaacuagaacguagacauuacacaggauggggcagauuauccuauaaacuaauaaaugggauaagaaacaaagaaaacaacaaaacaauacucgacuauuuaauagacgauggcucagcaaaucgcaauuucaugcaacucauaaaugaugacacacugccauucaaacaaaucauacaaaaaucccaaguaguaggagauguagacgacauagaagcaguuguacaugacuugcccggaucucccgcuauaaagaaaggcauccuacaauccgucaaaauaguagaugaacuaguuaaaguaaugggugacaauccagacaauauugugauagaaauggcaagggaaaaccaaacaacgaauagagggagaagccaaucacaacaacgauuaaaaaaacugcaaaacagucuaaaagaauuaggaucaaauauuuuaaaugaagagaaaccaaguuacauagaagacaaagucgaaaauagucauuuacaaaaugaccaauuauuccuguacuacauacaaaauggaaaagacauguacaccggagaugaauuagacauagaccaccucucagacuaugauaucgaccauauaauaccccaggcauuuauaaaagacgauaguauagauaaccgcgugcuuacuaguucugccaaaaauaggggaaaaagcgacgacguaccuucccuggacauaguucgagcacgaaaagcagaguggguaagacuuuacaaguccggccucauuagcaaaagaaaauucgacaaucuaacgaaagcagaaagaggaggacuaaccgaagccgauaaagcaggguucauuaagcgccaacuaguggaaacgcgacaaauuaccaaacacguagcccagaucuuagaugcgagauuuaauacagaaagcgaugagaacgacaaaguaauacgagauguuaaaguaauuacucugaaaucaaauuuagucagucaauucagaaaagacuucgaauuuuauaaaguucgagaaauuaacgauuaucaccacgcgcacgacgcuuaccuaaacgccguaguaggaacagcacuucuaaaaaaguaucccaaauuagcaucagaauucgucuacggagaauacaagaaauacgacauaagaaaguucauuacaaacuccucagauaaggcaacagcuaaguauuuuuucuauaguaauuuaaugaauuucuucaaacgaguaauacguuauucaaacggaaaagugauuguacgaccuguaguagaauauagcaaggacacggaagauauugcaugggauaaaaaaucaaauuuuagaacaauauguaaaguucuauccuacccacaagucaacauuguaaagaaaguagaaacgcaaaccggagguuuuagcaaagaaucaauauuacccaaaggcgauucagauaaacuaauuccgagaaaaacaaaaaaggcauacugggacacaaagaaguaugguggauuugacucaccaacuguagcauauuccguuuucguuguagcagaugucgaaaaaggaaaagcaaaaaaacucaagacagugaaagagcucgugggaauauccauuauggaacgauccuucuucgaagaaaauccaguggaauuucuagaaaacaaaggauaucacaauauacgugaggacaaacuaauuaaacugcccaaauacucauuauuugaauucgaaggcggaaaacgaaggcucuuagcaucugcaucugaacugcaaaaaggaaacgaaauggucaucccaggccaucuagucaagcuacuauaccaugcccaaagaauaaacucauuuaauucaacaaaauauuuagacuauguaagcgcacauaaaaaagaauucgaaaaaguacuaucgugugucgaagauuucgccaaccuauauguagauguagaaaaaaauuuaucuaaaauaagagccguagcugauucaauggauaacuucucaauagaagaaauaagcaauuccuucauaaaccuuuuaacacugacggcacuuggagcaccagcagacuuuaauuuccuaggagaaaaaauuccucgaaagcgauacacaucaacuaaagaaugcuuaaacgccacucuaauacaucagucaauuaccggguuauacgaaacuaggauugauuuaagcaaaauaggagaagaauga

SEQ ID NO: 5485 - RNA, 4122 nt, Artificial Sequence
  Cas9 variant
auggaaaacaaaaacuauaguauagguuuagauauaggaacaaauagcguuggcugggcaguuauaaccgaugacuacaaagugccauccaagaaaaugaaaguauuaggaaauacagacaaaagauuuaucaagaaaaauuuaauaggagcacuauuguuugacgaagguacaacugcugaagcacgcagacuaaaaagaacagcacgacgccgauacacucggaggaaaaaucgcuuaagauaccugcaagaaauauucgcugaagaaaugucgaaaguugauucgucauucuuccauagacuagacgauagcuuuuuaauuccagaagacaagaaaggaucaaaauacccaauauuugcaaccuugaucgaagaaaaggaauaccacaagcaguuuccuaccauauaccaccuacgcaagcaacuggcagacaguaaagagaaaacugaccuaagacuaauuuauuuagcccuagcccacaugauuaaauaccgagggcauuuccuauacgaagauacauuugauauuaaaaauaacgacauacagaaaauauuuaacgaauuuauaaguauauauaauaacacauucgaaggcaauucucuaucaggccaaaacguacaaguagaagcuaucuucacagauaaaauaagcaaaucagcgaaacgcgagagaguauuaaaacuauucccagacgaaaaaucuacaggauuauuuucagaguuccuaaaacuaauaguaggaaaucaagccgauuuuaagaaacacuucgaccucgaagaaaaagcaccuuuacaauuuucaagagauacuuaugacgaagaucuagaaaaucuucuuggacaaauaggagaugauuuugcagaccuguucgucgcagccaagaaauuauacgacgcgauucuuuuaagcggaauacuaacaguuacggacccuagcacaaaagcaccucuaucagcuucuaugauugaaagauacgaaaaccaucaaaaagaucuagcaacucugaaacaauuuaucaaaaccaauuuaccagaaaaauacgacgaaguauucucugaccaaucuaaagacggauacgcuggauacauugacggcaaaacaacacaagaaaguuucuacaaauauaucaaaaaccuauuauccaaauucgaaggagccgauuauuuccucgagaaaauagaaagggaagauuuccuacgaaaacaaagaacuuucgacaacggcaguauaccccaucaaauccaucuccaagaaaugaacgcaaucuuacggcgacaaggggaacauuacccguuucuuaaagaaaauaaagaaaagauagagaaaauacucacuuuucgaaucccuuacuauguaggucccuuagcaagaggaaaccgagacuuugcuuggcugacccgaaacucagaucaagccaucaggccuuggaacuucgaagaaaucgucgacaaagcauccucagcugaaucuuucauaaacaaaaugacaaacuaugauuuauacuuaccagaagaaaaaguauuacccaaacauucuuuguuauacgaaacauucgcuguuuauaaugaauuaacuaaaguaaaauuuauagcagaaggauuacgggauuaccaauuccuggacucacgucaaaagaaagauaucuuuuauacacuauuuaaagccgaagacaaaagaaaagucacagaaaaagauauaauucaauaccuacauaccguugacggcuaugauggaaucgaauuaaaagguauugaaaaacaauucaacgccagcuugucgacuuaccacgaccuacuuaaaauuauaaaagacaaagaauuuauggacgaccccaauaaugaagaaauuuuagaaaauaucguacauacacuuacuauauuugaagauagagaaaugauaaaacaacgacuagcacaauacgacucauuauuugaugaaaaaguaauuaaagcccuaacacgaagacauuauaccggauggggaaaauuaucaaguaaacucauaaacggcaucagagacaaacaaacaggaaaaaccaucuuagacuacuuaauggacgacggcuauaauaaccgaaacuuuaugcaacuaauaaacgaugacgaacucagcuucaaagaaauaaucaagaaagcccaaguaguuggcaaaacggacgaugucaaacaaguaguucaagaacugccuggaagccccgcaaucaagaaaggcauccuccaaucgauaaaauuaguugacgagcuaguaaaaguaaugggucaugaaccagagucaauaguaauagaaauggcaagggaaaaccaaacaacagcacguggcaagaaaaauucccaacaacgcuauaaacgaauagaagacucgcuaaaaauccuagcaucaggacucaacgcuaaaauucuaaaagaacauccaacagauaauauacaauuacaaaaugaccgcuuauuuuuauauuaccuacaaaaugggagggauauguauacuggaaaaccgcuagacauaaaccaacuuuccaguuacgacauagaccauauuguaccucaggcuuuuauaaaagacgacagucuggacaauagaguacuuacuucauuaaaagacaaccgaggaaaaucggauaacguaccauccuuagaaguaguagagaaaaugaaaacguuuuggcaacaacucuuagacucaaaacuaaucucuuaucgaaaauucaauaacuuaacgaaagcagaaagagggggucuagacgaacgugauaaaguaggauucaucaaaaggcaauugguagaaacaagacaaauaacaaaacacguugcacaaauuuuagacgcacgauauaacaccgaagucaaugaaaaagauaagaaaaacagaacuguaaaaaucauuacacuaaaaucaaacuugguaucaaauuucagaaaagaguuccggcuauauaagauaagagaaauaaacgacuaccaccaugcacacgaugcguaccuaaacgcaguagucgcaaaagcaauacucaagaaauaccccaaacuagaaccagaauuugucuacggagacuaccaaaaauaugaccuaaaacgcuacaucucaagaaguaaagauccaaaggaaauagaaaaagcaacugaaaaauacuuuuucuacuccaaccuucuuaacuuuuucaaagaagaagugcauuacgcagauggcaccauagugaaacgcgaaaauauagaauauucaaaagauaccggagaaauagcauggaacaaagaaaaagacuuugcaacaaucaagaaagugcugucccuaccacaagucaauauagucaagaaaagagaaguccaaacugggggauuuucaaaagaaucuauauuaccuaaaggaaauucggauaaacuaauuccuagaaaaacuaaagacauauuaugggacacgacaaaguacggagguuuugacucgccaguaauugcauacuccauuuuacucauugcagacauugaaaaaggaaaagccaaacgacuuaaaacuguaaaaacccuaguaggcauaacaauaauggagaaagcgaccuuugagaaaagcccuauagcauucuuagaaaacaaaggcuaucauaacgugagaaaagaaaauauauuauguuuacccaaauacagccucuuugaacucaaaaauggacgacgcagaaugcuugccagugcaaaagaauuacaaaagggaaaugaaaucguauuacccguccacuuaacaacgcuauuauaucaugccaaaaacauucaccgacuagaugaaccagaacauuuagaauauauacaaaagcauagaaacgaguucaaaggauuacuaaaccuagugagcgaguucucacaaaaauacguauuagccgacgcuaauuuggagaaaauuaaaaauuuauacgcugacaaugaacaagcagacaucgaaauacucgcuaacaguuucaucaacuuacuuacauuuaccgcacucggagccccagcagcauuuaaauuuuucggaaaagacguagaucgcaaaagauacacaaccguaagugaaauacuaaacgcuacucuaauccaccaaucaauaacaggacuauaugaaacacggauagaccucucaaaacuuggcgaagauuga

SEQ ID NO: 5486 - RNA, 4125 nt, Artificial Sequence
  Cas9 variant
auggagacuaaauuuacauauuaccuaggucuugauaugggaacugauagccuugguugggcuguaacagauucuucauaccauauacugcgagcuaaggggaaagaucuauggggcguuagauuguuuccaagcgcagagacguccguugaacgcagaacuuauagaguuaauagaagaagaagacaaagagaagucgcucgaauuggggcauugaaagaacuauuugcagaugagauagaaaaaguagauccgggauuuuucgucagacuagaugaaucuaaauuccacauggaagaucgaucagaaaauaauaaacaaaaauauggucuauuugcagauaaacuauuuucagacgcaggauauuauaaaaaauaccccacaauauuucacuuacgaaaagagcuacuagaaagcgaagaaccacacgauguucggcuagucuacuuagcacuauugaacauguuuaagcaccgcggacauuucuuaaauucgaguuuacaaauagaaggagaaaacagcaacauagccgaaagcuaucaaauguucguagacacacuaacagaugaagauuuggauuuucccgagcaagugaguggagaaagacuacaggaaauauuccguucgucugacucacgaaaaaaaaaaguugaaaaccuuuuagcggaaaugaaccuaucaaaaaaacaaaaaagagaaauacaauuuguuaaccucaucugcggguuaaagggaaaguuaagugaauuauuccccgacaaagaauaugacgaggagcagaaaaaaaucgcauucucauuucaagauucagacuacgaggacaaagagaacacuauacaagaauugcuagacgagucagaaaugaauaugauauaugcuguaaaagcuguacaugacuccggaguacuuucgggcauaaugaacggugaacgguaccuuucaguugcccgaguagcauccuacgaaaagcacaaaaaagauuugcaaauauuaaaagacauuuuaaaaaaauaugauacaaaagaauacuuugaaauguuccgaaacgaauccgcaaaaagugaaucuuacucagcauacgucggcucaguaaaauaucacgggacauuuagacgaggauuaucaggaggaaaacaggaagaccuauauaaacauaucaaaaaaguccuaggaaaauuuccacaagacgacgaaggcguuacauauaucuuagaagaaauugaaacagaaagcuucuuacccaagcaauuaacagcguccaauggcgucauaccaaaucaaguucaugcaagggagaugcuggcgauacucaaacaugcugaacuauacuuaccauuuuuacaggagaaagaugauacaggcuuaucaguaagcgaaaagauacuaaaauuauucauguuucaaauaccauauuauguaggaccuuuaggucaagaauauaaagauaaaaaaggauauaauguaugggccgaaaggaaagcaucaggaaaaauauaccccuggaacuuugaagacaaaauagacguuaaaaaaucugcagaaaaauucauagguagaaugguacggagaugcaccuaccuauccggggaacaagcgcuaccaaaacaaaguuugcuguaugaaaaauuucaaguacuaaaugaacuaaauaaccuacgaauaagaggagaaaaaauuccaguaucucugaaacaagaaauauaucacgacuuauucggagauggaaagaaaguaaguaugacacgacuaacuaauuacuuguuacaaaaugggguaaucucaggugaagagaaagauaguugcauuucgggaaucgauggaggauuucacaacuccuuaucaaguguagguaaauuuaaaggagucuuuggagauacagugcacacagaugaacaccgaaaaaugauagaagacaucauauuuuggggaacuguauucggagacggcaaaaaauuauuaaaagaaaaaguugaagaaguauacggaaaccaacucacagaagcacaaaaaaaaagaauauuugguuuuaaauuuuccucauggggcagacuaucuaaagcauuccuaacaauggaaggagcaaguaaagacgacggcgaaauuaaaggauuaauacaagcaaugugggauacuaacugcaaccuaauggaauuacuaucugaccguuucacauacaaagauaaacuaaacgaaaugguaaccacggcggaaaaacccuuaugugaguggaaaauagaagaccuugacgaaauguauuugucagcaccaguaaaaagaaugguauggcaaacgauuagaguuguagaugaaguacaacaaauaauagguuguccacccaaacgaauuuuuguagagaugacaagaagcgacggagagaaagguaaaaggacuguguccagacaaaaaaagcucguagauuuauacaaagcccucggaaaagaaggaaaaacuuggagugaagaauuaagcgacacacccgaaucgcaauuuagaauaaaaaaacuuuacuuguauuaccugcaaaugggaaaaugcauguacacaggcgaggcaauagaauuagaacaacuuaugaaugacaaucuuuacgacauagaucauauauaccccagacacuucauaaaagacgacaauauaucaaauaaccucguucuaguaaaaaaagaaaaaaacgcacauaaaucggacaguuucccgauugaaccagagauaagaaauaaaaugaugccauuuuggaaaucucuuaggaagaaagguuuucugacugaagaaaaauacaauagacuuacacggaugagugccuucacagaugaagaaaaagcggccuucaucggaagacaacucguagaaacaagucaagguacaaaagccauaacgcaaauauuugaacaagcauuugcgaauagugaaaucguuuuuuccaaagcuucgguagucagugcuuuuagacaaaaguucgacugcuauaagguuaggugcguaaauaauuaucaccaugcucaugacgcauaucuaaacauaguggcaggcaacacauauaggguuaaauuuacaagcaauccauuaaauuuuauaaaagaagcuaaaaaaaacccaaauaguagagagaauagguauaauauggacaaaaucuucgaaugggacguaacuagaaauggagaaacagcaugggucgcacaaacaaaagaacauccaggaaccauacaauuaguaaaaaaguacuugaacaaaaacaguccauuaauuacaaaaaugguuuacgaaaaacacgggggcauaacacagaaggcaacaauauggagugcaaaaaaagcugaaagcgggaauacugacgcauauauaccagucaaaaugaacgaucccagauuagcagacgucacaaaauacggaggaguaacgacuauagccguagcaggauauacguuauuagaauauaaagcaggaggaaagacgguuagaagccuagaagcauugccaaucuacuuaggagguucaaaaaagcugacagaagaacaaaugguggaauauuuuagcaauguacuacaacaagaaaauaaagaaaaagugguuagugacguuauaaucagaaaaaagaugauaccaucaggaagucuaaucaaguauaacggauucuacuauuaucuagcaggaaaaacaggagauaggauaauucucauaucugcaguacagcuaugcuuaccaauggauacgauguuauauauaaaaaagauagaaaaagcguguucaacaggaaauuuugaagaaaaagauaaaaauggcaagcagguccuaaguaaacaacagaacgaguuugucuaugaacuuauaauucaaaaguaccaacaaucuauauucaaaaaaaaaguuggggcaauaggagacacaauaaucgaaaaaagggaaaaauuugccgaaauaucauuagaagaacaaugcaaaguucucaugcaaauauuuuugaauuuccaauccggaauaggugucgaauuaaaaauaauugaaggagggaagaaaagcgguguaacuuaucuuaauaaaaaaguuaugaauguacaagagcuaaaacugaucgaucaaaguguaacaggaguauucucccgugaaauagauuuacucacaauauga

SEQ ID NO: 5487 - RNA, 4125 nt, Artificial Sequence
  Cas9 variant
augaagaaacguuauaguuauucuauuggucuagauauaggaacaaauucaguaggcugggcuguaauuaacgaagacuauaaaguuccagcgaagaaaaugacaguuuuuggaaauacugaccgaaaaaccauuaagaaaaaucuauugggaacaguacuuuucgacaguggagaaacagcacaagcucgacgacuaaaacggacaaauaggcgcagguacacaagacgcagauauagauuaugccaauuacaaaacauauucgcgacagaaauggucaaaguugacgacaccuucuuucaacgucugucugaaaguuucuucuacuaccaagacaaagcguucgauaaacacccaauauucggaaacucaaaagaagaaagagcguaccacaaaacauauccaacaauauaccacuuaagaaaagaccuagcagacagagaccagaaagcugaccuucggcuaauauaccuagcauuaagucauauaauuaaauucagaggacacuuccugauagaaggaaaauugaauagcgaaaacacugacguucaaaaauuauucaucgcauuaguuacaguauacaaucuacuauuugaagaagaaccuaucgcuggugaaacaugcgacgcuaaagcacuauuaacagcaaaaacuucaaaaucaaaaagauuagaaucacuuauaagugaguucccgggacagaagaaaaaugguuuguucggaaaccugcuugcacuagcucucggacuacggccaaauuuuaaaucgaacuuuggacugucugaagaugcaaaauuacaaaucacaaaagacacauacgaagaagaauuagauaaccugcuggcugaaauuggcgaucauuacgcagacuuauucuuagcugcgaaaaaucugucagaugcaauucuuuuaucggacauacuaacccuuucugacgaaaacacacgagcaccacuaagcgccucaaugauaaaaagguacgaagaacaccaagaagauuuagcacuucucaaaaagcuagucaaagaacaaaugccagaaaaauauugggaaauauuuucuaaugcaaagaaaaauggauaugcuggcuauauagaaggcaaaguuagucaagaagauuucuauagauauauaaaaccuauauuaucacgucuaaaaggaggagacgaauuucuugcaaaaaucgacagggacgacuuucugagaaaacaaagaacauucgauaauggcaguauaccucaucaaauacauuugaaagaauuacaugcaauacuaagaaggcaagaaaaauacuacccauuuuuagcugaacaaaaagagaaaauagaacaacuauuauguuuucgcauuccauauuauguuggaccacuugcuaaaggcgguaacucuaguuuugcauggcuaaaaagaagaagcgacgaaccaauaacccccuggaacuucaaagaugugguagaugaggaagcauccgcacaagcauuuauagaagguaugacaaauuaugauacuuaccuacccgaggaaaaaguacuaccaaaacacucacccuuauacgaaauguuuacuguauacaacgaauuaacaaaagucaaauauaucgccgagaacaugacgaaaccacuuuacuuaagugcagaacaaaaagaagcuaucaucgaucaucuauuuaaacaaacacgaaaaguaacagucaaagaccucaaagagaaauauuucagccaaauagaagguuuagaaaacgucgacguaacagguguagaaggagcauucaacgccagcuuagguacauauaacgaccuccuaaaaauuauaaaagacaaagcauuccuagacgaugaggcaaacgcagagauauuagaggaaaucguucuaauucuaacacuauuucaagacgagaaacuaaucgaaaaacgucuugcaaaauacgcuaaccuauucgagaaaagugucuuaaagaaauugcgaaaaagacacuauagggguuggggacguuuaucaagacaauugauugaugggaugaaagauaaagcaagcgguaaaacuauucuugauuucuuaaaagcugaugacuucgcaaauagaaauuuuauacaauugaucaacgacucuagccuagauuuugaaaaacugauugacgacgcccagaagaaagcuauuaaacgagagagcuuaaccgaagccguugcuaaucuugcaggaucaccagcaauuaagaaagggaucuuacaaaguuuaaaaguaguagacgaaauagucaaaguuaugggccauaauccagauaacaucguaauagaaauguccagagaaaaccaaacgacugcucaaggacucaaaaaugcaagacaacgacugaaaaagauuaaagaaguucauaagaaaacagggaguaggaucuuagaagacaacucugaaagaauuacgaaccuuacuuuacaggacaaccgauuauaucuauaucuauuacaagauggaaaagacauguacacgggacaagaucucgacauaaacaaccugucgcaauacgacauagaucauauaauuccacaaaguuucauaaaggacaauuccauugacaaucucguccuaacuacccaaaaggccaaucguggaaaaucagauaacguuccaucaauagagguaguaagagacaugaaggacaggguauggcgacgccagcuagcuaacggagcaauaagcagacaaaaauuugaucauuuaacuaaagcagaaagaggugggcuagcagauuccgacaaagcacgcuuucucagaagacagcuaguagagacacgacaaaucaccaaacauguagcacagcuucuagacucaagauuuaauucaaaauccaaucagaacaagaaacuggcaagaaauguaaaaauaauaacgcuaaaaaguaaaauuguaagcgauuuuaggaaggauuucggacuauauaaacucagggagguuaacaauuaucaccacgcacacgaugcuuauuuaaacgcuguaguagguacagcacuacuaaagaaauacccaaaacuagaagcugaauuuguuuacggagauuacaaacauuuugaucuaguuaaacuaauaaguaaaucagacccaucacuaggaaaagcuaccgcaaaaguauucuuuuauaguaacauaaugaacuucuucaaagaagaacuuucacucgcagaugguacucuaaugaaaagaccagucauagaaacuaacacugaaacaggagaagugguuugggauaaaguaaaggacuuuaagaccaucagaaaaguauuguccuauccacaaguaaauauagucaagaaaaccgaaauacagaguggagcauucagcaaagaaagugucuuaucuaaaggaaacagcgacaagcucauagaaagaaagaaaggcugggacccaaagaaauacggaggauuugacucuccuaacacagcauauaguauuuuuguuguagcuaaaguagcaaaaagaaaagcccaaaaauuaaaaacaguaaaagaaauaguagguauuacaauaauggaacaagcggaauaugagaaggauaauaucgccuucuuggagaagaaagguuaucaagacauacaggaaaagcucuuaauaaaacuaccaaaguacucgcuuuucgaauuagaaaauggacgacguaggcuucuagccucagcuaaugaguuccaaaaaggaaacgagcuagcacuuucagguaaauauaugaaauuucuauaccuagccagcagauaugauaaacuuucaucaaaaauugaaucagaacaacagaagaaauuauucguugaacaacaucugcacuauuuugacgaaauacuggacaucguagucaagcacgcaacuugcuacauaaaagccgagaacaacuuaaagaaaauuaucucauuauacaaaaagaaagaggcuuacucuauaaacgaacaagcucuuaacaugcuaaaccuauucauauuuacaucacuuggggcucccagcacauuugucuuuuucgacgaaacaauagacagaaaaagauacacuacaucaagcgauguacucaacgguauauuaauacaacaaucaaucacaggacuauacgaaacaagaauagacuuaucaagauucggcggagacuga

SEQ ID NO: 5488 - RNA, 4125 nt, Artificial Sequence
  Cas9 variant
augaagaaacagaaauucuccgacuacuaucuaggauucgacaucgggacaaacucaguuggauggugcgucacggacuuggacuacaacgugcuacgauuuaauaaaaaggauauguggggaagucguuuauucgaugaggcaaaaacagccgcugaacgaaggguccaacguaacagucgaagaagguuaaaaagaagaaaauggagacuaaaccuccuagaagaaauauucucggacgaaauaaugaaaauagauucuaacuucuucagaaggcuaaaagagucaucauuauggcuugaagacaagaauucaaaagaaaaauucacacuuuuuaacgacgacaacuacaaagauuaugacuuuuacaagcaauaccccaccauauuccaccucagagaugaacuaauuaagaaucccgaaaaaaaagauauuagguugauauaccuagcucuacauaguauuuuuaaaucaagaggacacuuccuauuugagggacaaaaccuaaaagaaaucaaaaauuucgaaacacucuauaauaaccucauuagcuuucuagaagacaacggaauaaacaaaagcauagauaaagauaauaucgaaaaguuagaaaaaauaaucugugacaguggaaaagggcuaaaagacaaagaaaaagaguuuaagggaauauuuaacucugacaaacagcuagucgcgaucuucaaacuuuccgucgguagcaguguaucuuuaaacgacuuauuugacacagaugaauacaaaaaagaagaaguagaaaaagaaaaaauaaguuucagagaacaaauauaugaagacgauaaaccaauauauuauucuauauuaggagaaaaaauagaacuucuggacauagcaaaaagcuuuuacgacuucaugguacucaacaacauacuaucagacucaaauuacauaagugaagcuaaaguaaaacuuuaugaagaacauaagaaagaccuaaaaaaccucaaguacauaauacgcaaauacaauaaagagaacuacgauaaacuauucaaagacaaaaaugaaaauaacuacccagccuacauuggacucaacaaagaaaaagacaaaaaagaagucguagaaaaaucaagacucaaaauagacgauuugauaaaaguaauaaagggcuauuuaccaaagccugaaaggaucgaagagaaagauaaaacaaucuuuaacgaaauucuaaacaagauagagcugaaaaccauacucccaaaacaaagaauuucugauaacgggacacuaccauaccaaauacacgaagucgagcuagaaaaaauauuagaaaaccaaucaaaguacuaugacuucuuaaauuacgaagaaaacgguguaagcacuaaagacaaacuacuaaaaaccuuuaaauuuagaauaccauacuacguuggcccucucaacucauaccauaaagacaaaggcggaaauucauggaucgucagaaaagaagaaggaaaaauucuaccguggaauuuugaacaaaaagucgacauugaaaaaagugcagaagaauuuaucaaacgcaugacaaauaaguguacauacuuaaauggcgaagacguuauacccaaagacucguucuuauacagugaauacauaaucuuaaacgaacuuaacaaaguacaaguaaacgaugaauuuuuaaacgaagaaaauaaaaggaaaauaauagacgaacuauucaaagaaaacaagaaaguaucagagaaaaaauucaaggaauaccuuuuaguaaaccagaucgcuaaccggaccguagaacuuaaaggcauuaaagacuccuuuaauucaaauuauguauccuacauuaaguuuaaagauauauuuggagagaaauuaaacuuagauaucuauaaagagauuuccgaaaaaucaauacuauggaaaugccuauauggagaugacaaaaagauauuugaaaaaaaaauuaagaaugaauauggugacauacuuaacaaagacgaaauaaaaaaaauuaauucauucaaauucaacacauggggacgccugucagaaaaacuacugacagggauugaauuuaucaaccuagagacgggggaguguuacuccagcguaauggaggcacuaagaagaacuaacuacaaccugauggaacuauugaguucgaaauuuacgcuacaggaaucaaucgauaacgaaaacaaagaaaugaaugaagugagcuaccgggaucuaauagaagagagcuacguaagucccucccuaaaacgagccauacuccaaacauuaaagauauaugaagaaauaaaaaaaauaacaggucgcguaccaaaaaaaguauucauugaaauggccaggggcggggacgaauccaugaaaaacaagaaaauaccagcgcgacaagaacagcuuaaaaaacuauaugacucguguggcaaugacauagcuaauuucucaauagacauaaaagaaaugaaaaacucacugucauccuacgacaauaacucauuaagacaaaaaaaauuauaucucuacuacuuacaguucgggaagugcauguauaccggaagagaaauagacuuagauagacuucuacaaaacaacgacacauaugacauagaccacauauauccacguucaaaaguuauaaaagacgauagcuucgacaaccuaguauugguucuaaaaaacgagaaugcugaaaaaagcaacgaauauccugucaaaaaagaaauacaagaaaaaaugaaaucuuucuggagauuucuaaaagaaaaaaacuucaucucugacgaaaaauacaaacgguuaacggggaaagacgauuucgaacugcgaggauucauggcaagacaacuaguaaauguccgucaaacaacaaaagaagucggaaagauccuucaacagauagaacccgagauaaaaauuguauacagcaaagcggagauagcaucauccuucagagaaauguucgacuucauaaaaguaagagaacuuaacgacacacaccacgcuaaagaugcuuaccucaauauagucgcuggaaacguauacaacaccaaauucacggaaaaacccuacagauaucugcaagaaaucaaagaaaacuacgauguaaaaaagauauauaacuacgauauaaagaacgcaugggacaaggaaaacagccuagaaaucgucaaaaagaacauggaaaaaaauacggugaacauaacgcgauuuauuaaagaagaaaaaggggaauuauuuaaucuaaacccuauaaaaaaaggagaaaccaguaacgagauuauaucaauaaaaccaaaacuauacgacggaaaagacaacaaacuaaaugagaaauacggcuacuacacgagucuaaaggcagcguacuuuauuuauguugagcacgaaaaaaaaaacaaaaaaguaaaaacauuugaaagaaucaccagaauagauuccacccucauaaaaaaugagaaaaaucuaaucaaauaucuaguaucacaaaaaaaacuauuaaaucccaaaauaaucaagaaaauauacaaagaacaaacccuaauaaucgacaguuacccauauacauucacaggaguggauagcaacaaaaaaguugaacuaaaaaacaaaaaacaacuauaccuagaaaaaaaauacgaacaaauccucaaaaacgcccuaaaguucguagaagauaaucaaggagaaacagaagaaaauuacaaauucauauaccuaaaaaaaagaaacaacaacgaaaaaaaugaaacuauagaugcaguaaaggaacgauacaacauagaauucaacgaaauguacgacaaauuccucgaaaaacucucaaguaaagauuauaaaaacuacauaaacaacaaauuauacaccaauuuucuuaacucaaaagaaaaauucaaaaaacuuaaauuaugggaaaagagcuuaauacuacgggaauuccuaaaaauauucaacaaaaacacauacggaaaauacgaaauaaaagacucacaaacaaaagaaaaguuauuuucuuuccccgaagacacgggcagaauacggcuaggccaaaguagcuuaggaaacaacaaagaacuacuagaagaaucuguaacaggacuuuucgucaaaaaaauaaaacucuga

SEQ ID NO: 5489 - RNA, 4128 nt, Artificial Sequence
  Cas9 variant
augucaaacaaaccauacaguauugguuuagacauaggaacuaauagcguuggaugggcuguuauaacagacgacuacaaaguuccaucuaagaaaaugaaaguauuagggaacacagauaaacauuucauaaagaaaaaucuaauuggagcauuacucuucgacgaaggcacuacagccgaagacagaagacuaaaacgaaccgcccgcagaagauauacaagaagaaagaacagacugcgauauuuacaagaaauuuucuucgaagaaaugucaaaauuagauagcggguuuuuccaccgcuuggacgauuucuuuuuaauuccagaagacaaacggggcagcaaauaccccauauuugccacccuagcugaagaaaaagaauaucacaaacaguuuccuacaauauaccaccuaagaaaacaacuagccgauucuaaagaaaaagccgaccucagacucauauacuuaacuuuagcccacaugaucaaauaccgaggccacuuucuauacgaagaaaguuuugacaucaaaaacaacgauauccagaaaauauuuaacgaauuuauauccauauacgacaauacauucgaagguuccucacuaagcggacaaaaugcacaaauagaagcgaucuucacagacaaaauauccaaaucagcuaaacgggaacgaguacuaaaauuauuccccgaugaaaaaucaacuggauuauucucagaauuuuuaaaacuuauaguaggaaaccaagccgacuucaagaaacacuuugaacuagaagaaaaagcaccacuacaauuucccaaagacaccuacgaugaagaucuagaaaauguccuagggcaaauaggugacgacuucgcugacuuauuuguugcagcaaagaaauuauacgacgcuauauugcuuaguggaauauuaacaguaacugacccaucaaccaaagcaccacuaucagcuuccaugaucgaaagauaugaaaaucaucaaaaagaccuggcagcacuaaaacaauucauaaaaacaaaucuacccgaaaaauacguagaagucuuuagcgaucaaagcaaagacggcuaugcuggcuauauagacggaaaaacuacucaagaagcauuuuacaaauacaucaaaaaucuauuaucuaaauucgaaggaacagacuacuucuuagauaaaauagaacgagaagauuuccuacgaaaacaacguacauucgauaauggauccaucccucaucaaauucaccuacaagaaaugaaugcaauacuaagaagacaaggugaacauuacccguuuuuaaaagaaaauaaagaaaagauagagaaaauacuuaccuuccguauaccauacuacguaggcccucuagcccgagguaaucgggacuucgccuggcuaacaaggaacuccgaccaagcaauccgacccuggaauuucgagaaaauuguugacaaagcaucgagcgcugaagauuucauaaauaaaaugacaaacuaugacuuauaucuuccagaagaaaaaguacuaccaaaacacagccuacucuaugaaaccuucgcaguauauaacgaacucacaaaaguuaaauuuaucgcagaaggacuaagagacuaucaauuccuugacagugggcaaaagaaacaaauagucaaccagcucuuuaaagagaaacgcaaaguuaccaagaaagauauaauccacuaccuacauacaguagacgguuacgacggaauagaacuuaaaggcauagagaaacaauuuaaugccagucuaucaacauaccacgaccuauuaaaaaucauaaaagacaagaaauuuauggacgauucuaaaaacgaagcaauucuagaaaacauaguucauacauugaccauauucgaggauagagaaaugauaaaacaaagauuagcccaauacgauagucuauuugacgagaaaguaaucaaagcauuaacucgccggcacuauacaggauggggcaaacuuucagccaaacuaaucaacgggaucugugauaaacaaacagguaacaccauacucgacuaccuaaucgaugacggggaaaucaacaggaauuucaugcaauuaaucaaugacgacggccucucauuuaagaaaauaauucaaaaaucacaagucguuggcgagacugacgauguaaaacaaguuguccgagaauuaccagguagcccggccauuaagaaagguauacuacaaucaauuaaaauagucgacgaacucgugaaaguaauggaccaugccccggaauccauaguuaucgaaauggccagagaaaaucaaacaacggcacgaggcaagaaaaauagucaacagcgauauaaaagaauagaagacagucucaaaaaccucgccucaggucuagacaguaauauacuaaaagaaaacccgaccgacaacauccaacuuaaaaacgacagauuauuccuuuauuaccugcaaaauggaaaagauauguacacaggcgaagcacuagauauuaaucaauuaucauccuaugauauagaucacauuauuccacaagcauucauaaaagacgauucauuagacaauagaguauuaaccaguucaaaagacaauaggggaaaaagcgacaauguaccaucccuagaagucguacagaaaagaaaggcuuuuuggcaacaacuucuagauucuaaacuaauaagcgaaagaaaauuuaacaacuuaacuaaagcugaacguggugggcucaaugaacgagauaaaguuggauucaucaaacgccagcuuguagaaaccagacaaauaaccaaacaugucgcucagauucuggaugcuagauacaacacugaaguaaacgagaaagacaagaaaaauagaacaguuaaaauuauaacuuuaaaaagcaaucuaguaagcaacuucagaaaagaguuccgacuauauaaaguaagagaaauaaacgacuaucaucaugcacacgaugcuuacuugaacgcaguaguugcaaaagcgauacuaaagaaauacccaaaacuagaaccagaauuuguauauggagaauaccaaaaauaugaccucaaacgcuacaucucacgaagcagaaacccuaaagaagucgaaaaagcaacagaaaaauauuucuucuacaguaaccuucuaaacuucuucaaagaagaagugcauuacgcagaugggaccauaguuaaaagagaaaacauagaauauucaaaagacacaggagaaaucgcauggaauacagaaaaagauuucgcaacaaucaagaaaauauuaucauacccacaaguaaauauaguuaagaaaacggaagaacaaacagugggacaaaauggaggacuauucgauaauaauauagucucuaaagaaaaaguaguagacgcauccaaacuuauacccaucaaaucaggccuaagucccaagaaauauggaggauacgcuagaccaacaauagcuuacucuguauuaguuacauacaaacaaaacaacaaaaucaaaaacacaaugguaggcaucccuguauuaacgaaacuagaauuugaacgcgaucccaauuuauacuuaaggaauuugggaauuaacaacguaucccacguaauaaaauuagucaaauauacaguccuugaauuuaagcacaaauacgguacguacagacgguucauaguaaguaaccaggaacuaaaaagagcaaaucaaaucuucguaacaacaaagcaaaugaaacuaauaucucaguauaccacacuugacaaaaaugaacaugauagucuacugaaaaauaaucaacaacuuauacaaucuaucuggaaccaauuucuagaguucaugcuagcgacugaccuggucaauaagaaacaauacgaugaauuaauauuaacaaacaaccaaacaauagaagagugcagaaauauuaugaaucgagucaucacaacccuuaguuuuacgaauauuaacgccggacagaagaaaauuaucuucgaugacacucuaucuuuaccaauaaagagauggcaauucacugacucugacaaaauggucaagaaaauaauugaaagcacacuaauacaccaaagcaucacuggacuuuacgaaacaaggauugaccuaucaaaacucggagaagacuga

SEQ ID NO: 5490 - RNA, 4128 nt, Artificial Sequence
  Cas9 variant
augaaagaauaccauaucggucucgacauaggaacaucgaguauaggcugggccgucacagacagucaguuuaaauuaaugaggauaaaagggaaaacagcaauaggaguccgacuauuugaagaagggaaaacagcagcagaaagaaggacauuccgcacaacacgacgacgucuuaaacgcaggaaguggagguuacauuauuuagaugaaaucuuugcaccucaucuacaagaaguagacgaaaacuucuuaagaaggcugaaacaaucaaauauacacccagaagauccagccaaaaaccaagcauuuauaggaaaacuacuauucccagaccuauuaaagaaaaacgaacgaggauauccaacauuaauaaaaaugcgagaugaacuaccaguagaacaacgagcacauuauccaguaaccaacauauacaaacuaagagaagcaaugauaaacgaagaucgacaauuugauuuacgcgaaguauaccuugcaguacaucauaucguaaaauaucgaggucauuuucuaaacaaugcgagugucgauaaauuuaaaguagguagaauagauuucgacaaaucuuuuaacguuuuaaacgaagcauaugaggaacuccaaaauggagaagggagcuucacaauagaaccaucgaaaguagaaaagauuggacaacuccuauuagacaccaaaaugagaaaacucgaccgacaaaaagcgguagccaaacuacuggaaguaaaaguggccgacaaggaggaaacaaaacguaacaaacaaaucgcaacugcuaugagcaaauuaguccuuggguacaaagcagauuucgcaacaguagcaaugguaaauggaaacgaauggaaaauugaucucucguccgaaacaagcgaagacgagauagagaaauuccgagaagaauuauccgacgcacagaacgacauauuaaccgagauuacuucucuauuuucacaaauaaugcuaaacgaaauuguaccaaacggaaugucaauaucugaaucaaugauggacagguauuggacccaugaaagacaacuugcagaaguuaaagaauauuuagccacacaaccagccagcgcucgaaaagaguucgaccaaguauacaacaaauauauaggacaagcaccuaaagaaaaagguuucgaccuagaaaaaggcuugaagaaaauauuaucaaagaaagaaaacuggaaagaaauugacgaacuacuaaaggcgggugauuuucugccaaaacaaagaaucagugcuaacgguguuauaccacaucaaaugcaccaacaagaauuagaccgaauaauagaaaaacaagcgaaguacuaccccuggcucgcaacagaaaacccagcgaccggagaaagagacagacaucaagcgaaauacgaacucgaccaacucguaucauuucguauuccauauuauguagggccauuaguuacaccagaaguacaaaaagcaaccucaggagcuaaguuugccugggcaaagaggaaggaagacggagaaauaacaccauggaaccugugggauaaaauagauagagcggaaucagcagaagccuuuauaaaacgaaugacgguaaaagauacguaucuauuaaaugaagauguucucccagcuaauucacuguuauaucaaaaauacaauguauuaaacgaacuaaauaauguccguguaaacggaagacgauugucggugggaaucaaacaagauauauauacugaacuauucaaaaagaagaaaacaguuaaagcaucugauguagcaucauuaguaauggccaaaacgaggggcguuaauaaacccaguguggaaggucugucggauccaaagaaauuuaacucgaauuuagcaacauacuuggaccugaaaucaauaguaggggauaaaguggaugacaauagauaccaaauggaccucgaaaacauuaucgaauggcgaucaguguuugaggacggagaaauauucgcagauaaacuuacagaaguagaauggcuaacagacgaacaaagaagcgcucuaguaaagaaaagauauaaaggaugggggagauuaaguaagaaacuacucacaggaauagucgaugaaaauggccaacgaauaauagaucuaauguggaauacagaucaaaauuuuaugcaaauuguaaaucaaccgguauuuaaagaacaaauagaccaauuaaaucaaaaagcaauaacaaaugacggcaugaccuuacgugaacggguagaaaguguacuagacgaugcauauacauccccgcaaaacaagaaagcaauauggcaaguaguuagagucgucgaagacauaguaaaagcaguuggcaaugcuccaaaaucgauauccauagaguucgccaggaaugaaggaaauaaaggagaaauaacccgaaguagaagaacucaacuucaaaaacucuuugaagaccaagcgcacgagcuaguaaaagacacauccuuaacagaagaauuagaaaaaguaccugacuuaucagauagauauuacuuuuacuuuacucaaggaggaaaagacauguacacaggggacccaauaaauuuugacgaaauaucaacgaaauaugauauagaccacauuuuaccacaauccuuuguaaaagaugauagucuagauaauaggguauuaacgucccgaaaagaaaauaauaagaaauccgaucaaguaccugcaaaacuuuaugcagcaaaaaugaaaccauauuggaaucaacuccuuaaacaaggguuaauaacacaacgaaaauuugaaaaucuuacaauggauguugaccaaacuauuaaauaccguucauuaggauuuguaaaaaggcagcuaguagaaacgagacaagugaucaaacuaacggccaacauacuuggauccauguaucaagaagcuggcacugacaucaucgaaacaagagcaggcuuaacaaaacaacuaagagaagaguucgacuugccaaaagucagagaaguuaaugauuaccaccacgcaguagacgcauacuuaacaacauuugcuggacaauaccuaaaccguagauauccgaaauugcgauccuucuuuguauauggagaauauaugaaauuuaaacauggaagcgaccuaaaacuaagaaacuuuaacuuuuuccaugaauuaauggaaggcgauaaaucacaagggaagguaguugaccaacagacaggugaauuaauuaccacuagagaugaaguugcagauuauuuugauuggguacaagaccuaaaauugauguuaguaacaaaagaacuuaaaagauccaacggaaaguuauucgaugcuaccauacaaaaugcuaacuauacaaaauuaaaugaacgaaagaaaguauuuguuccccuaaagaaagaacuagauaaaacauuauauggaucuuauagcggaauacagaguagcuauaugacaaucguaaagaaauuugauaagaaagggucaacuuacgcagugcaaagaauaccaguaauguacucaaaacuauuggaacuugaaaaagaacaauccaaacucaacagauuaguccaaagcauagugacaagugauccacaagcccccaauaauuuugaaguguuaaugccauguguucugagcggccaacugguaauagacaacggccgaaaauuuacacugacaucauacagauaccaauguaguacagcacagcucuuuuuaccaaagaaagaccugaaauauauacaaaacaauuucaaagaacuuaagaaaacgcccgauaaacaagauaaaauauuugaaacuauauaugacgauaucuuaaaacaaguagauaaauauuucagcuuauaugacauuaacaaauuucgauccaaacuccaugaugguaaagacaaauuucuagcacucgaaaacuucggagaaaaagaaagcaaagauaaagucauaacaaaaauucuuagaggccuacaugcuaacgcagaaagaacaucccuaaaagaaauagggcugagcacuccacuaggucaauuucaaaguggcgaagggggaauuacucucagcgacaacaccaaaauaauauaccaaaguccuaccggucuuuuugaacgccaugucuaccuaaaagaccuauga

SEQ ID NO: 5491 - RNA, 4128 nt, Artificial Sequence
  Cas9 variant
augagaaagaaucaggaaccauauaauauaggauuagauauaggaaccaguucaauaggauggucaauuaugaaugauaacuucgaucucaugagaguuaaaggcaaaaaaggcauuggaguccgucuauauaaugaagggcaaucggcggcggagagaaggaugcaccgaacagccagacgaagauaugggcgaagaaaauggcgacuaagauuacuugaagacuuuuuugaugaacacauggccgaaguagacgacacauuuuucgcgcgacuaaaagauucaaauauaaguccgaaggacgauaaaaaauacagaaaaagucuuuuauuuccgaaaucaaaagguguaacguaucaagaugauggcgaauuuuauaaaaaauauccuaccauguaccauuuacgguacgccuugaugacugaacaucguaaauuugacuugcgagagauauacuuagcauuccaucauaugguaaaauauagaggaaauuuucuauaugacacaagcgucgacucguucgaggcaaagaaucucgauauaaaaggaaaauucgaugaaauaaaugacuuacucucaucauacacagacuuuuauguagauaacucaaacgcugcacuugucgagucaauccuguuagaaaaaaacacaacaagaaaagauaaaucaaaaaaaaucgcuaaauuauuacacguagaagauaaagaaaaaggcaaaaacaaaaaagcaaaagacuuagccacucaaauaucgaaugcaguauuagguuuaaaaugcaacuuccaccuaaucuucgaguuacaacaaaaauacucauuugauuuaugcucagaaaaaacggaagaaaacaucgcuaaauuaagugaagugcuagacgaaaaccaaaagaugcuacucaugauacuaaaagaaguccaggaucaaguaaugcuuaaugcauucguaccuaguggaaugagucuuagcgaagcuaugaugcaaaaauaugaugauuacggugaacaacuuaaaauauaccacgaacuagaacacaguguaagcgaugacagcgcagccaaacuaagaggcgcauauagagauuauaaugacaacauaauaaaacgcaucgauggagacaacaaaaaagacacuuucuacaaaagaguuaaaaauauucuaacaaaaauauccaaggaguauguagaccaagauguauuagaaucaugugguaaauuaaaaaaacuaauagaugaaaacaaacuauuuaucagacaaagaacagcggcaaacggcguucuaccccaccaauuacaucaaauugaaaugagaaaaauuauugauaaucaaaaagaguauuauccuugguuagcggaaccaaacccaaacgaaaaacgucgcguauauaguaaauauaaaguagaagaguuaauagcuuuuagaauccccuauuauguaggaccauuaguggauccaaacaacgcagacaaaaacaaagaagcacgauuuuccuggaugguaaggaagaaagauggagagauaacuccauggaauuuuuaugacaaaguugauugggcagaauccgcgaacaacuucauagaaagaaugaaaucaaaagauaccuacuuacuaggggaagacgugguacccaaagaaucaaugcuguaccaaaaauaugaaguacuaaaugaacuaaauaauuuaagaauaaaugacucaggguuaucagacaguuuugaagacguaaaacucaaacaagcaauauacaacgaucuauucaaaaaacagaaaauuguaaagauuaccgauuuacaaaauuacuuaguccagaaccacaaauauuuaguuaaaccaaagauaagugggcuagcagacgaaaacagauucuuaucaagccuauccacauacagugaucuaaaaaccaucuuuggggauaaaguagaugaccgaacuuauuuuaaugacuucgaaaaaaugguagaauacagcacaguauuugaagacggacaugauuacaaccaaaaacuugaugaauacacauggcuuacaaaagaagaaaaauacaaaaucggaaaaaaacgauauagagguuggggcaaauuaaguaaaaaauuauuaacgggacuaagggauaaaaacaaucauacaauaauggacaaccuaugggaaacaaaucgaaacuucaugcaaauacaaacugcagaugaauuuaguaaacaaauagcagaagagaacgagagacacuuaaaaggaucaguuagugacgcaauaaaugacauguacacauccccugcaaacaaaaaagcaauaagacaaguucuucgaguaguggaugauauacaaaaagcaaugggcuacgcaccaucuaguauauccuuggaauuugcaagagaagauggcccaucaguacgaaccguuucacgggccaauagaaugaagucuauuuacgaaaaauacgcuagugaagucagugaggaaguaaugaaagaucucgauggaguaauaaaggauaaaaaggguuuaaaugaucgacuuuaccucuauuuugaacaacaaggaaaagacauguacucgggucacccguuagacuucgacaagguaauauccggccaagaauacgauauagaucacauuuuaccccaagcaguaaucaaagaugauucacuagacaacagaguucugacgacuaaagcccuaaacaaugacguaaaaucuaaaggaguaccaugcagaauguuuaaugguaugcacucuuuuuggaaaaaccuauaugacaaaggauucaucagcagaagaaaauuuaauaauuuaacaacaaauccagaaaacauagauaaauacaaaaugaaaggauuuguuaaccgacaacugguagaaacucgccaaauuauaaaauuaguugcaaauguacuaaaugacaaauaucaaaacgaugacgucgacaucauagaggugcgugcggaacugacacacgacgucagaaagcauuucaaguucuauaaaaaccgcaacguaaaugauuaccaccacgcauuugaugcauaucuaaccucauucauaggacacuaccucuucaaaaaauauccaaaccugcgaccgcuuuucgacuacaacgauuuuaugaaggugagugacaacguauuuaaacaacuccgagguaauaauuuccuaggcgaauuucucaacaaaacaggcgauauaauuagcacagacggaaauuucguauuaaacaaagaagagaugauaaauaaauugaacaaagcguaugccuuuaaaaaaauauuaguuacuaaagaaguaggccaacgaacuggagcaauguucaacgaaacacguuacccugcaccaaacaguaggaaagcagccuuaaaauauagacgcaugccgaaaccagacucacuuauaucaguaaaagacuauaaaaauaccgauauauauggaggauauucaggaaaaaaugaugcauauauggucauuguagacaugggaaaacaauacaugguaguagggguacccguuagauacacugaaaaacuggauaaacuuagaauaaagcauucagaacuauacagagaugaguugcgaaaaguacuuucaagagauaagacauuauuagacucaaaagggaacguuaaaagauuugauauaguucuagaccgcguccuauacggacaauuaauugaagacggaaaugaauuauucacauuagguagcaguaaauauaaaagaaauuucagacagcuauuuuuggacaagcaguguauagaaauacuugacuccuccgcaacaccucaaccuacggacgaagaacucauauggguauaugaccagauacuagauaaaguugacaaguacuucgaacuauaugauauuaacagacaacgggaaacgcucagaaaaggacgagcugcauuuuguucacucccaaacauaucaaugaaaaaagaugacguuacaaaaaagaaaauacuaaacgagauacuagucgcauuacacgcaaaugaaucagaauccaacugugaaaaaaucgguaaaaaagucuucggacguuugcaaguaccaggugggauaaaacuuucaaaagaagccaaacuuauauaccaaucaccaacaggcuuauuugaacgaguuguauacuugaaagaccuuuga

SEQ ID NO: 5492 - RNA, 4128 nt, Artificial Sequence
  Cas9 variant
auggaaaacaagaaauauagcauaggucuugacauaggaaccagcaguaucggauuugccguaguagaugaaaacaauagaguaaugcgugucaaagguaaaaacgcaaucggaguaagacucuucucggagggacaaccugcggcugaucguagaaguuuucgaacaacaagaaggagauugucucgacgaagauggagauuacgacuacuucgagaaauauucgaaccuuacaucaaccccguagaugaagcauucuuuaugagacucaaagaaagcaacuuaucaccuaaagaugcaaacaaacauuauucuggagacauuuuauuuaauaaucaaaccgaccaagauuuuuacgaaaaauacccaacgaucuaccauuugagacacgccuuaaugacagaacacagaaaauucgauguaagagaaauuuacuuagcaauccaucauaucguaaaauucagaggacacuucuuaaaugccgccagugcuucaaacuucacugucggaaaacuaaacuuagaaggaaaauuugaugcacugaaugaaauauaucagagaguccuuacugaugacccauucgcauugagaacagauaacuuagaccacauaaaagaaauucucauugauaacaaaaggagucaagcagaccgccaaagaacauuaacuggagacgucuaccaguccuccgaagaaaaagaaauagaaaagaggaacaaagccauagcaacagaaauacuuaaagcagcagucggaaacaaagcaaaacuuaauguaauaacgaacguagaaguggauaaagaagcagcuaaagauuggucacuaaccuucgauagugagaccaucgaugaugaauuagccaagguugacggccaaaugacugaugacggacgcgaaauaauagagauauuacgaucacuauacagugguauaacacuagccgcaauuguccccgagaaucauacucuuucucaaaguaugguggaaaaauacaacucacacaaagcacaucucaaacuccuaaaagauuuaauaaauaacaugacagacacuaaaaaggcuaaaaaucucagggcagcauacgauggcuauauagaugguguaaaaggaaaaguacuuacaagagaugacuucuacaaacaaauucaaggaaauuuagacgauucugcagaagcacagaaaauccaagauguuauggaccaagacgaauuuaugccaaaacaaagaacaaaagccaacgggucaauaccccaccaacuacaacaacaagaauuagaccaaauaguagagaaucaaaaagaauacuacccauggcuagcugaagaaaacccaaaugaaacaagacgugguguugcuaaauacaaguuagaugaacuuguaaccuucagagucccauauuacguaggaccgaugauaacugccgaagaccaagaaaaacaaucaggagcguccuuugcuuggaugaaaagaaaagaaccagguaacaucaccccauggaacuuugaucaaaaaguugacagaauggcgucugccaaucaauucauaaaacgaaugacaacaaccgauacguaccuacuaggagaagacgucuuaccggcacaaucacuuuuauaucaaagauuugaaguacuaaaugagcuaaacaaaauucgcauagaucgcaaaccuauaucgauagagcuaaaacagcaaaucuuuaacgaucuauuuaagaaauucaaaaacguaaccauaaaacauuuacaagaauaucuuguugcuacuggaggauaugauaaaaggccuagaauugauggcuuagccgacgagaaacgauuuaacucaggguuaucagccuaucacgacuuacauggaauuuuaggagcagaaguaguagaugcaaaugacaaacaagaugaucuugagaaaauuauagaauggagcacaaucuuugaagauaagaaaauuuacagagcuaaauuggacgaacuuacauggcuaaccgauucccagaaagagaaauuggcaacaaaacguuaccaaggauggggaaggcuaagcaagaaauuacuaucugguuuacgcaauucugaucauagaucaauacuugauauacuuuggaucacgaacgaaaacuuuaugcaaauacaagcagauccagauuuugcagaauuggucaaaaacgcuaaccaaggaaugcugggcaaaaauaacucucaagacguaauaaacgauuuauacacaucaccucaaaauaagaaagcaauaagacaaauauuauuaguaguacaugauauucagaaugcuaugcacggacaggcaccggccaaaauucauguagaauuugcccguggagaagaaagaaauccaaggagaucaauucaacgacaacaucagauagaagcagcguacgacaaaguaacaucugaucuauuaguggacgcaggaguacgucaagaacugaaagaugcgauaaacgacaaaagagacuuuaaagaucgcuuauuccuauacuuuaugcagggaggaagagacaucuacaauggagagcccaucaauauagacagauuaucaucauaugauauagaccauauucucccacaggcauucgucaaagacgauucacugaacaaccgcguccuuacagacgcugaaggaaauagaaggaaaucggacgcagucccgagugagcucuuuggagcaaaaaugagguccacaugggaacuaaugcgggaacaaggcuuaauaagcaaagcaaaauaucgcaacuuaacaaugaacccagaaaacauaaacgcgcauaccgagaacggcuuuauaaacaggcaauuaguugaaacacgacaaguuauaaaacuagcaguaaacauucuagcagacgaauauaccgaagacacccaaauuguaagugucaaagcugacuuaagccaucaaaugagagaagauuucgaauuacuuaaaaauagagauguaaaugacuaucaccaugcuuucgaugcuuaucuugcagcuuucauaggaaauuaccuacuugaacgauacccuaaauugcaaucauacuuuguauacggagauuuuaagaaauuuagccaaaaagacaccaaaaugagaagauucaauuucauuuacgaucuaaaacauucagaucaaauagcagauaaaaauggaaagaaaauauggcauaaaacaaacgaucuagacuacauacgacaucuguuugcuuauaagaaaaucuuaauaucucaugaaguuagugaaagacgaggagcgcuauauaaccaaacuguguauaaagcaucggaugacaaggcuucaggucagggcaguaagaaacucaucccgauaaaagcuaacaaaccaacugaaauauauggcggauauacaggaaaaacccuagcuuauauggcaauaguaaaaguuaucaaaggaaagaaaaucgcguauaaagugguggguguucccacguccgcacuuguacaauuagcugggauagaacacggcucccaagaagaacucaacagauuauacgacguuuuaaaaccucaguucacucaauuaaagaaaaacaacaaaacaggagaaauaagcgaaacgguauccaaauuugaaauugugauccccagaguaaaauaccaacaauuaguagaagacgaugauaaacuauuuaugauaggaagcgacaccuauccauacaacgcacaacaacugguccuaucagaaggggcauugaaagucauuaacaauguguacaggaaaggagaaaauucagauaaacaagaauccuauaaacucgacgacguauaugacgaaauaauaauugcaaugaagaaauacuuuccauuauacgacaacagaggauuuagggaaaaaguggccgaaggaaaauccacuuucgagaaucuacccauaucaaacgaauuuaaaaacggaaaauuaacgaaaauaggaaagaaagaaguuaucaauagaauguuacaaggacuacacgcgaaugccaccaugacagaucuaaaaauacuaggaauaaaaaguccuuucgguuuuaugcaacaaccaacuggaauagccuuaucugaaaaugcacagcucauuuaucagaguccaacggauuuauuugaaagaagaguccaacuaaauaaaauuaaauga

SEQ ID NO: 5493 - RNA, 4128 nt, Artificial Sequence
  Cas9 variant
augaagaaaauucucggcuuagaccugggcacaacaagcaucggcugggcccucguauaugaaagugaaaacacggacgaaaaaucgagcauuguacgacuuggaguacgagucaacccccuuucagucgacgaaaaaggaaauuucgaaaaaggaaaagcgauaaccaccaacgcugaccgccaacaaacacauggagcaagaaucaauuuacaaagauacaaauuaagacgcgaaaaccugaaagauugucugcaaaaacaaggauggaucgguacagaagcccuaugugaagaaggaaaaacgaguacauuugaaacauauaugcuacgagccaaagcagccgaagaagaaaucagucuacaugaauuaugccgaguacucuucaugaugaauaagaaacgaggcuacaaaucuaaucggaaagcaaacaacaaagaagauggaaaacucuucgacgggaugacaguggccaagaaacuguaugaagaacaucucacaccagcggaauauaguuuccaacuauuaucaagcggaaagaaauuuaaacaagaauauuaucgaagugaccugaaagaagaguuugaccgcaucuggaacgaacaacaaaaauauuauccagaaaucuuaacggaugauuuuaaacaacaacuacaaggaaaaaguaaaggaaacacgucaaaaauuuucuugggaaaauauggaauauacucagcagaucucaaaggacuagaccguaaacuacagccacuaaaauggcguguagaggcuuuaaaacaacaaguagauaaagaaguauuagcauuuguuauaagugaccucaacggucaaauagcaucuacaucaggacuccuaggagccauaucugauagaaguaaagaacuauacuuuaacaaacaaacaguuggacaauaccuauggacuucauuaaaagaaacaccccauguaucaauuaaaaacaaaccuuuuuacaggcaagauuaccuugacgaguuugagaaaauaugggaaacucaagcaacauaucacaaagaauuaacucccgaauuaaaacaagaaauacgagauauaauaauauucuaucaacgaccauuaaaauccaagaaaggcuugauaucaguaugcgagcuagaacaaagaaaagucaaaguuaccauugauggaaaagaaaaagaaauaaguauuggcccaaaaguagcaccgaaaucaucccccauguuucaagaauuucguauauggcaaaauuuaaacaauauacucuuaauagauaaagguaacaauucaauacacccacuauaugaagaagagaaaaacuugcuauacgaagaacuaagcguaaaggagaaguuaaguaaagcagaagcccuaaaagucuugaauaaaaacagcaaacaaugggaucuaaauuacaaagaaauagaagguaaccgcacccaagcaguccuuuacgauuguuacaauagaaucauuguaaugacaggacaugaagaguacaauuucaagaaauuaaaagcaagcgaaauaagaagcuaugugaaaacgacauuuaccgguuuagguuuuaacacggacauccuagaauuugauaguucacuuacaggucaugaacuagagaaacaacccauguaucaacuauggcacuuacucuauuccuaugaauccgauaacagcaggacaggcaaugaugcccuauuacgaaaacuagaaacggcauucggcuuuccuaaagaauaugcagcuguacucagugacguuguuuuugaagauucauacggaaaucuaucaguuaaagccaugaggaaaauuuuaccucauuuacaagcaggauugaacuacucacaagccugugaagaagcaggauacaaacacucaaggagaaguuuaaccaaaaaugagcuugaccaaaaagaauauaaagaaaaacuagaacuucuuccgaaaaauucacuacacaacccagucgucgagaaaauccucaaccaaaugauaaacguuauaaacgcggugauagacgaauauggaaaaccagaugaaauaagaauagaauuggcaagagaauuaaagaucggagccgcagaaagagaaaauaugaccagaucaaucaaccaaggaaaugcagaaaacaaaagaauacgcgaaauacuagaaaaagaguucgcauuaaguuacauaaguagaaacgacauaauaaaauacaaauuauacgaagaauuaaaaucuaacggauuuaaaaccuuauacucagauacuuacauaucaaaagauaaacucuucaguaaagacuuugacaucgaacacaucauacccaaagcgcgccuauuugacgauagcuuaagcaauaaaacuauagaagcaagagauguuaacaucgccaaaucaaauaaaacagcauuugacuuuauaucagaaaaauacgaucaacaaggaaucgaggcuuacaaaaagaaauuagauauacuccugcaggauggcucuauaucuaaagccaaauacaauaggcuauuaaugaaagaagcagacauaccaucagguuuuauagaucgugaucuccgcgacacacaguacauagcgaaaaaggcauacgagauacuuuccgaccugguaagaaauguaacacccaccaccggcgcggucacuagcagauuaagagaagacuggcagcuaguagacguuaugaaagaacuuaacuucgaaaaauaucaaaaacuaggauuaguagaagucauagaagaucgugacggaagaaaaaucaaacgaauaaaagauuggacaaaaagaaacgaucauaggcaucacgcaauggaugcacuaacaaucgcauucacaaagccuaguuauauacaauauuuaaacaacuuaaaugcacggucagacaaaaacagcucaauauauggaauagaaaauaaagagcuacacagagaagauaauaaacuucgauuuaacgcaccauuacccaucaacgaguucagagcggaagcaagaagacaccuuaaaucaauacucguuagcguuaaagcuaagaauaaagucaugacacaaaauguaaauguaauaaaaacuaaacacggaguaauaaagaaaguacaacuaacaccaagaggagaauuacauaaugccacauuuuaugguacuaagaaaagaccuauaauaaaaaugguaaaagugggugccgcuuuagacgaaguaacaauaaagaaaguauccaguaguuuuaucagagaggcuuuacuggaccgucuucaugaauauaacggcgaugccaagaaagccuucacagguagaaacuccauagacaaaaaucccauauauaucgacgaagaacauaagaaaacaguaccagcuuuaguuaaaaccaucgaaugggaaauguaccaccccacuagaaaacucauuucaccagauuuaaaaauugacaaaguaaucgauaaaggcauaagggaaauacuuaaaacccgacuggcuaaauucaacggcgacgcacaaaaagcguuuuccaaucuagacgaaaacccaaucuauaaagacgaagcgaagaaaauaaccuuaaaaagaguuucacucgaaggaguauccucaguaauaccacuacacacacucaaagauagggaaggaaaacugguaguagguaaagaugggaaaccaguacucggggacuauguacaaacauccaauaaccaccauauagcauucuauauggacgaaaacggaaacuuacaagacaacguuguauccuucuuugaagcagcagaacgaaaaucccaaggaguaccaguaauagauaaaaauuauaaccacgacaaaggguggaacuuucuauuuacaaugaaacaaaaugaauauuuuguuuucccaaacgaagugacgggcuuuaaucccagcgaaguagaccugauggaugaagcaaacuacucaauaaucagcccaaacuuauauagaguacagaaaaugucaaaagcaucaggaagagacuauugguuuaggcaucaucuggaagcuaugcuuaacgacgacccaaaacuaaggaacucaauguuuaaaagaauaacaagccuaaaagcucuagaaggaauaguaaaaguacgaauaaacuguauagguaaaauaguagcuguaggggaauacgacuga

SEQ ID NO: 5494 - RNA, 4128 nt, Artificial Sequence
  Cas9 variant
augucaaacaaaucauacagcauaggacucgauauaggaacaaauucagucggaugggcaguaauaacagaugauuauaaagugccgucaaagaaaaugaaagucuuaggaaauaccgacaaacauuuuaucaagaaaaaucuaauaggagcauuacuauuugacgaagguaccacagcagaagacagacgccucaaacgcacggcacgaagacguuacaccagaaggaaaaauagacuaagauaccuacaagaaauauuuucacaagaaauaucuaaaguagacuccuccuuuuuccauagacuagacgauuucuucuuaguaccggaagacaaacgcggauccaaauacccuauuuucgcaacauuagucgaagaaaaagaauaucacaagaaauuucccacuauauaucacuuacgcaaacaccuugcagacucuaaagagaaaacugaucuacgauuaauauaucuagcccucgcacauaugauaaaauauagaggccacuuucucuacgaagagagcuucgacaucaaaaauaaugauauccagaaaauauucucagaauuuaucagcauauacgacaacacguuugaagguaaaaguuuauccggacaaaacgcucaagucgaagcaauauucacugauaaaauuucaaaaucgacaaaaagagaacgaguuuuaaaauuauucccagaugagaaaaguacaggacuauucagcgaauuucugaaacuaauugucgguaaucaagcugacuucaagaaacauuuugacuuagaagaaaaagcuccacuacaauuuucgaaagacacauaugacgaagaccuggaaaacuuacucggucaaauaggggacgauuuugcagacuuauucuuaguugccaagaaacuauaugacgcaauacuacuaucuggcauauuaacggugaaagaucuaagcacaaaagcuccauuaagugcuucaaugaucgaacguuaugaaaaucaccaaaaagaccuagcggccuuaaaacaauuuauccaaaacaaccuccaagaaaaauacgaugaaguauucagcgaccagucgaaagauggauaugcaggauacauagauggaaaaacaacgcaagaggcuuucuauaaauauaucaaaaaccuuuugucuaaauuugaaggagcagacuacuuccuagauaaaauagaacgugaagacuuuuugaagaaacaaagaacauuugacaacggaucaaucccgcaccaaauacaccuacaggaaaugaacgcaauaauaagaagacaaggggaacauuacccauucuuacaggaaaacaaagagaaaaucgagaaaauccuaaccuuuaggauacccuacuacgucggcccccuagccagaggaaacggagauuucgcauggcuaacucgcaacucggaccaagccauaagaccauggaacuucgaagaaauaguagaucaagcaagcagugcagaagacuucaucaauaaaaugacaaauuacgacuuauaucuccccgaagaaaaaguacugccgaaacauagccuacucuaugaaacuuuugcuguauacaacgaacuaacaaaagucaaauuuauagcagaaggacuaacaagauaucaguuuuuagacaagaaacaaaagaaagauauauuugacacauucuucaaagcugaaaacaaacgaaaaguaacugaaaaagacauaauccacuaucuacacaacguugacggcuaugacggaauagaacucaaaggcaucgaaaaacaguuuaacgcaucauuaucaacuuaccacgaucugcuuaaaauaauuaaagauaaagccuuuauggaugauucuaaaaaugaagaaauacuggaaaacauaauccacacgcuaacaaucuucgaagauagagaaaugauuaaacaacgguuagcucaauacgauucauuauucgacgaaaaagucauuaaagcucugacuagaagacacuauaccggauggggaaaacucagcgcaaaauuaauaaacggcauuagggacaagaaauccggcaaaacaauccuagacuauuuaauugaugauggggaaauaaacagaaacuucaugcaacucauacacgacgacggcuuaucuuucaaagaaauaauacaaaaagcacaagucuucgguaaaacuaacgaugugaaacaaguuguccaagaacuuccaggaucuccagccaucaagaaagggauacuacaaucaauuaaaaucguagaugaauuagugaaaguuaugggccaugccccagaaagcaucguuauugaaauggcuagagaaaaucaaacuacggcccgaggcaagaaaaauucacaacaacgguauaaaagaauagaagauagccuuaaaaauuuagccucuggucuagacucuaacauucuuaaagaaaaccccacagacaauauucaacuucaaaacgacagauuauucuuauauuaucuucaaaacggcagagacauguacacaggaaaaccgcuagaaaucaaucaauuaucaaacuacgauaucgaccacauaaucccccaagcauucauaaaagaugauucacucgacaaccguguuuuaaccucaagcaaagauaauagaggaaaaucugacaacguaccaucacuagaagucgucgagaaaaugaaagcauucuggcaacaacuccuagacucaaaauuaauuucagaaagaaaauucaacaaccucacaaaagccgaacgagaaagaggcggccuaaaugaacuugauaaaguaggcuucaucaaaagacaauuaguagaaacacgccagauaacaaaacacguagcgcaauucuuagacgcaagauucaauaaagaaguuacagaaaaagacaagaaaaauagaaacguaaaaauaauaacacugaaaucaaauuuagugucaaauuuuagaaaagaauuuggacucuauaaaguuagggaaauaaaugacuaccaucaugcacacgaugccuaccuaaacgcaguacuagcgaaagcaauacuaaagaaauaucccaaacuggaaccagaguucgucuauggcgauuaucagaaauaugaucuacaaagauauauuucaaaaagucgagaaccaaaagaaguggaaaaagcaacccagaaauacuuuuucuauucaaauuuacuuaauuucuuuaaagaagaagugcacuacgcagauggaaccauaguaaaaagagaaaacaucgaauacucaaaagauacaggagaaauagccuggaacaaagaaaaagacuucgcuacaguaaagaaagucuuaagccuaccacaagucaacauagugaagaaaaccgaaguucaaacggguggauucagcaaagaaucaauccuaccgaaaggaaauucagauaaacuaauaccucgcaaaacaaaagaaauccucugggauacaacaaaauauggaggcuucgauucaccaguaauagcauacucuauccuauuaauugccgauauagaaaaaggcaaagcuaagaaauuaaaaacugucaaaacuuuaguuggcauuacaauaauggaaaaagcaaccuuugagaaaaacccaauaacuuuccuugaaaauaaaggauaucauaauguaagaaaagaaaauauacugugccuaccuaaauacaguuuauucgaacucgaaucuggccgccgacgaaugcuagcuucugcgaaagaacuucaaaaaggaaacgaaauaguguugcccguuuaccuaacuacccuauuguaccauaguaaaaauguucacaaauuagacgaaccagaacacuuagaauauauacaaaaacacagauacgaauuuaaagaucuccugaacuuaguaagcgaauuuucucagaaauacguucuggcagacgcaaaccuagagaaaaucaaaaaccuguaugcagacaaugaacaagccgacauagaaauauuagcaaacaguuucauaaaucuacugacuuuuacagccuugggcgccccagcagccuuuaaguucuuaggaaaagacguagauagaaaacgcuacaccacagucagcgaaauucucaacgccacacucauacaccaaucaauaacuggauuauaugaaacgagaauagaucuuucuaaacuuggagaagauuga

SEQ ID NO: 5495 - RNA, 4128 nt, Artificial Sequence
  Cas9 variant
auggaaaagaaauacuccauaggauuagauauaggaacaaauagcguaggaugggcaguuauuacagaugauuacaaaguuccgagcaagaaauuuaaaguucuuggaaacacaaaucgcaaaucaauaaagaaaaaucuuaugggcgcauuauuauuugauuccggagaaacagcagaagcaacacgacuaaaacgaacggcuagaagaagauauacaagacgcaaaaaccgaauuagauauuugcaagaaauuuucgcaaacgaaauggcaaaacuagacgacucuuucuuucaaagguuagaagagucauuccuaguagaagaagacaagaaaaacgaacgccacccaauauuugguaacuuagcagacgaaguagcauaccaccguaacuaucccacaauauaucauuuaaggaagaaauuagcagauagccccgaaaaagcugaccuaagauuaauauacuuagccuuggcacacaucauaaaauuuagagggcacuuccuuauugaagguaaacuaaacgcagaaaauucagacguugccaaauuauucuaucaacuaauccaaacauauaaccaauuguucgaagaaucaccuuuagaugagauagaaguugaugcgaaaggaauacuuagcgcuagauuaucaaaaagcaaacgauuagaaaaacuuauagcuguauuuccaaaugaaaagaaaaauggucuauucgggaacauaauagcccuagcuuuagguuugacuccaaacuuuaaaucgaacuuugauuuaacagaagaugccaaacuucaauuauccaaagauacauaugacgaugaccuagacgaacuccuaggucaaauaggugaucaauacgccgauuuauuuagugcggccaaaaauuuauccgaugcuauacuauuaagugacauacuacguagcaacucugaaguaacaaaagccccguuauccgccaguauggugaaaagguacgaugaacaucaucaagaucuagcacuucuaaaaaccuuaguuagacaacaauucccagaaaaauaugcagaaauuuucaaagacgauaccaaaaacggguacgcaggguacguuggaauuggaauaaaacauagaaaacgaacaacaaaacuugccacccaagaggaauuuuauaaauuuauuaaaccaauacuugagaaaauggacggcgcagaagaacuauuagccaaauuaaaucgagaugaccuguuaaggaaacaaagaacauucgacaaugggagcauuccacaccaaauccaccuaaaagaacuccacgcaauacuacgcagacaagaggaguucuacccauucuuaaaagaaaacagagagaaaauagagaaaauauuaacauuccgaauccccuacuacgucgggccauuagccagaggcaauagucgauucgcauggcucacaagaaaaucagaggaagcaauaacaccuuggaacuuugaagaggucguagacaaaggagcaagcgcucaaucguuuauagaacguaugacuaauuucgacgaacagcuuccuaauaagaaaguauuaccgaaacauucacuauuauaugaauacuuuacaguauacaaugagcuuacuaaagucaaauacguaacugaaaggaugagaaaaccagaauuucuuucaggcgaacagaagaaagccauuguagaccuauuauucaaaacaaaucgaaaagugacuguaaaacaacuuaaagaagacuauuuuaagaaaauugaaugcuuugacucuguagaaauaauaggcguggaggauagguucaaugccagcuuaggaacauaucaugauuuauuaaaaauaaucaaagacaaagauuuucucgacaaugaagaaaaugaagacauccuggaagauauaguauuaaccuuaacucuguuugaagaccgggagaugauagaagaaagauuaaaaacuuacgcccauuuauucgacgacaaagugaugaaacaacuaaaacguagacauuacacaggauggggucgucuaucgcgaaaaaugaucaacggaauaagagauaaacaaucuggaaaaacaaucuuagauuuccuuaaaucagauggauucucaaaucguaacuuuaugcaacuuauacacgaugacagccuaacauucaaagaagaaauugaaaaagcacaaguaaguggccaaggcgauucuuuacacgaacaaaucgcggaucucgcaggaaguccggcuaucaagaaagggauauuacaaacaguaaaaauagucgacgaacugguaaaaguuaugggacacaaaccagagaacaucgucauugaaauggcaagggaaaaccaaacgaccacaaaaggcuuacaacaaucacgagagcgaaagaaacguauagaagaaggaauaaaagaauuagaaucccaaauuuuaaaagaaaacccaguagaaaauacacaacugcaaaaugaaaaacuauaucuauauuaucuacaaaacggaagagauauguauguagaccaagaacuagacauaaauagauuauccgauuacgacguggaucauaucgucccacaaucguucauaaaagaugacagcauagacaauaaaguauugacaagaagugucgaaaaucgaggcaaaucagauaaugucccaagugaagaaguagucaagaaaaugaaaaacuauuggcgacaacucuuaaaugccaaauugaucacacaaagaaaguuugauaaccucacgaaagcagaaagaggagggcuaucagaagcagacaaagcuggauucaucaaaagacaauuaguggaaacacgacaaauuacaaaacacguggcuagaauccuugacucccgcaugaacacuaaacgcgacaaaaacgauaaaccgauuagagaagucaaaguaauaacacuuaaaucaaaacucguaucagacuuuagaaaagauuuccaacuauauaaagugcgagauauaaauaauuaucaucacgcccacgacgcauaucuaaaugcuguaguuggaacugcccuuauaaagaaauauccaaaauuagaaucagaauuuguguauggagacuauaaaguauaugacguacgaaaaaugauagcgaaaagugaacaggagauagggaaagcaaccgccaaacgcuuuuucuauucaaauauaaugaacuucuuuaaaacagaaguuaaguuagcgaacggagagauuagaaaacgaccacuuauagaaacaaacggugaaacaggagaagugguauggaauaaagaaaaagacuucgcaacaguacgaaaaguacuagccaugccacaaguaaacauagucaagaaaacugagguacaaacaggcggauuuucaaaggaauccaucuuaagcaaacgagagagugcgaaacugaucccuagaaagaaagggugggauacacguaaauaugguggguuugguaguccaaccguugccuacaguauauuaguaguagcuaaaguggaaaaaggaaaagccaagaaauuaaaauccguuaaaguuuugguagguauaacuaucauggaaaaaggaucauacgagaaagacccuauaggcuuuuuagaagcaaaaggauauaaagacaucaagaaagaacucaucuuuaaauuaccaaaauauucccuguucgaacuagagaacggacgaagaagaaugcuagcuagcgccacagaacugcaaaaagcaaaugaauuaguuuuaccacaacauuuaguaagacuacuauauuauacucaaaauauuagcgcaacaacaggaucgaacaacuuaggauauaucgaacagcauagagaagaauuuaaagaaauuuuugagaaaauaauugacuucagugaaaaauauauccugaaaaacaaagugaauaguaaucuaaaaucgucuuuugacgaacaauucgcagugucugauagcauacuacuuagcaauaguuuugucaguuuacuuaaauauacuagcuucggagcgagcgggggauuuacauuccuggacuuagacgucaaacaaggaagauuaagauaccagacuguuacagaaguacuugaugcaacuuuaaucuaucaaucuauaaccggcuuauacgaaacuaggacagaccugucccaacuaggcggagauuga

SEQ ID NO: 5496 - RNA, 4128 nt, Artificial Sequence
  Cas9 variant
augaagaaaauucuaggacuagacuuaggaacgacaucaauaggaugggcucuugucaacgaaagugaaaacaaagaugaacaauccucaauaguacgauuaggaguaagagugaucccccuaacaguugacgaaaaagguaacuucgaaaaagguaaagcaauaacaacaaaugcugacaggcaacaaguacaugcagcaagaaucaaucuccaaagauacaaauuacgucgugagaacuuacgagacugucuccaaaaacaaggauggauagguagcgagccaaugugugaagacggaaaaucaucaacauuugaaaccuauaaauugagagcaaaagcugccgucgaagaggucaguuuacaugaguucgcccgaguccuauucauguugaacaagaaaagaggcuauaaaagcaacagaaaagccaacgauaaagaagaaggaaaauuauuugauggaaugacaauugcuaagaaacucuacgaagaacaucuaacucccgcagaauacucacuacaacuucuuaacacugguaggaaauuuacgccggaauauuaccgcucggaccuaauagaagaauuugagaaaaucuggaaugaacaacaaaaauauuaucccgaaauacuaacagaugaauuuaaacaacaauuagaaggaaaagcuaaaucuaacacaucaaaacucuuccuaggaaaauaugguauauacucagcagauacuaaaggacuagauagaagguuacaaccacuuaaauggagagucgaagccaugaaacaacaaguugacaaagacguccuagcauucgucaucagcgaucuuaaaggacagauagcaaauacaucuggacuauuaggagcaaucucugaccgaagcaaagaacucuacuucaguaaacaaacgauaggacaauauuuaugggcgucacuacaggaaaauccacacauaagcauaaagaaucaaccauucuaucgacaagacuaccuugacgaauuugagaaaauaugggaaacacaagcuacauaucacaaagaauuaacgucagaacugaaacaagaaauaagggauauaauuauauuuuaucagaggccauugaaaucaaagaaaaauuugauugcaguaugcgaacuagagcaaagaaaaguuaaaguaaccguggacggaaaagaaaaagaaauaaccaucggacccaaaauugcccccaaaucuagcccuauguuccaagaguuccgaauuuggcaaaaucucaacaacaucuuacuguuagaucacgaaaccaacucaaaaagaccucuauaugaagaagaacggaauuuacucuaugaagaacuaaguguaaaagaaaaacucucuaaaacagaagcucuaaaaguauugggaaagaaauccaaacagugggacuuaaacuacaaagaauuagaaggcaaucgcacccaggcaguucuguaugauuguuacaaucguauaauaguaaugaguggacaugaagaauguaauuuuaagaaauuaaaagcguccgauauacgucacuacgugaaaaugauauuuaaaaauuuagccuucaauacggacaucuuaugcuucgacagcucuuuaaaaggucaugaacuagaaaggcaacccaugugucagcuauggcacuuauuauacuccuaugaaggagauaauucucgaacaggaaaugaugcacuguuaagaaaauuagaaacuucauuuggauucccgaaagaguaugcugcaguauuggcugacguaauuuuugaagauaguuacggaaaucucagugucaaagcaaugcgaaacauacuaccccaccuacaagcaggcaaagauuauucacaagcaugugaagaagcaggauauaaacacagcagacgaucauuaacaaaagaagaauuaaaucaaaaaguuuacaaggaaaaacuagaacuacugccuaaaaauucauugcauaacccaguaguugagaaaauacuuaaccaaauggucaacgugauuaaugcuguaauagaagaauauggcaaaccggaugaaauucggauugaauuagcaagagacuuaaaaauaggagcagccgaaagggaaaauaugacaaggaguauaaaccagggaaacgccgaaaacaaacgaauaagggaaauauuagaaaaggaauuugcacuuucauauuuaucgcguaaugauauuauaaaauacaaacuauacgaagaacuaaagaguaauggauuuaagacacucuacagugauacauauaucucaaaagacaaacucuucucaaaagacuucgacauagaacacauaauaccaaaagcuagacuauucgacgauagcuuauccaacaaaacaauagaagcaagggauguuaauauagcaaaaagcaacaagacagcuuuugauuucauacuggaacgcuauggggaacagggcguaaaaacuuauaaaacgaaguuacuuagacuauuggaagacggggcaaucagcaauaaaaaguauaauaauuuauugaaaacagaagcagauauaccaucuggcuucaucgaccgagauuuaagaaacacccaauauaucgcaaagaaagcauacgaaauacuaucagaauuaguaaaaauaguaacuccuaccacuggaucuguuacaaauagacuaagggaggauuggcagcuaguugauguaaugaaagaacuaaacuucgaaaaauaccaaaaacuaggccuugcggaugucauagaagacagagauggacgaaaaguuaaaagaauaaaagacuggacaaaacgaaacgaccauagacaccacgcgauggaugcccuaacaauugcauucacaaaaccaucauauauacaauacuuaaacaaucucaaugcaagaagcgacaaaucaucguccauauacggaaucgagguaaaagaauuacaccgagaagaaggaaaauucagauuuaacgcaccauuaccaaucaaugaauuucgagccgaagcaaaacgacacuuaaaaucuguauuagucucaauaaaagcuaagaagaaaguuaugacucaaaacguaaacaaaauaaaaacaaaacacgguauaauuaagaaaguacaacuaaccccacgaggggaacuccacaacgcuacuuacuacggaacgaagaaacgaccccuaguccgaauggucaaaguuggagcugcacuagaugaagcuacaauaaaaagagucuguucuccagcaauacgggcagcacuacuuaaaagguuaaaugcuuacaauggagacgcgaaagaagcauucacuggucgaaacagcaucgacaaaaauccaauuuaucuagacauagaacagacgaaauuaguaccagugcuaguaaaaacaauagaauggggaauguaccacccaauacgcaaaaggauuacuccagaucuaaaaauagacaaaguaaucgacaaaggaauacgugagaaacuaaaagccagacuggcagaauuuaacggagaugcucaaaaggcuuuuuccaaccuugacgaaaacccaauauauauggacgaagcuaaaagaauaacuuugaaaagagucaguauagaaggaguauuaucggcuaucccacuccacaccuugaaagacaaagcagggaaaccaguuauagguagcgauggcaaacccguauuuggagauuacgugcaaacaagcaacaaccaccacauagcuuucuauauagaugacaaaggaaaccugcaagacaaccccgucagcuucuucgaagccgcagaacgaaaaucacaaggcguacccgugaucgauagaagauacaacugcgauaagggcuggcauuucgucuuuacaaugaaacaaaacgaauacuucguauuucccaacgaagcaaccggcuucauuccaagugaaguugaucuacuagaugaagcuaacuauugcaucauaucaccgaaucucuauagaguucaaaaacugagcaaggcuuccggucgugacuacugguuuagacaccaucuugaaacaauguuaaacgaugaucuacgacucaaaaacaguacauucaaacgaauacaaagucuaaagggacuagaagacauuguuaaaguccgaauuaauagcauugguaaaaucguagcuguggggaaauacgauuga

SEQ ID NO: 5497 - RNA, 4128 nt, Artificial Sequence
  Cas9 variant
auggaaacuaaauucacauauuaucuuggauuagacauggguacagacagucuaggaugggcaguaacagacucaucauaucauauacuaagagcaaaaggaaaagauuuauggggggucagauuauuuccggcagcagaaacaucaguggauaggagaacguauagagugaaucgucgacgaaggcaaagagaaguugcuaggauaggagcauuaaaagaacuauuugcagacgaaauagaaaaaguagauccaggguuuuuuguccguuuagacgaaaguaaguuucacauggaagauagaucagaaaauaacaaacaaaaauauggacuauuugccgacaagcucuucagcgaugccgaauauuauaaaaaauaccccacaauauuucacuuaagaaaagaacuauuagaaucagaagaaccacaugauguccgucucguauaccuagcacuauuaaauauguucaagcauagaggacauuuuuuaaauagcagucuacaaauagaaggagaaaauaguaacauagcagaaucauaucaaauguuuguggauacuuuaaaggaugaagaauuagacuucccugaacaaguaucaggagaaagacuacaagaaauuuucagaaguucugacuccagaaaaaaaaaaguagaaaaccucuuggcagaaaugaauuuaucaaaaaaacagaaaagagaaauucaauucguaaauuuaauauguggauuaaaaggaaaauuauccgaauuauuucccgauaaagaauaugaugaggaacaaaaaaaaauagcuuucagcuuucaggacucagacuaugaagauaaagaaaacacaauccaagaacuauuagaugaaagugaaaugaauaugauuuacgcgguuaaagcaguccaugacucagggguacugucaggaaucaugaauggcgaacgauaccugaguguagcucgaguugcuagcuacgaaaaacauaaaaaagauuuacaaauauugaaagauauacuaaaaaaauacgauacaaaggaauauuuugaaauguucaggaaugaaucagaaaaaagugaaaacuauucagcauacgugggcucuguaaaguaccacgguacguuuagaagaggucucucaggaggaaaacaggaagaccuauauaaacauaucaagaagguacuaggaaaauuuccacaggaugaugaaggaguaaccuauguccuagaggagauagaaacagaaagcuuccuaccuaaacaacuaacugcaagcaacgggguaauacccaaccaaguacaugcgagagaaaugcuagcaauacuaaaacacgcagaguuguaucuaccuuucuuacaagaaaaagacgauacaggucuaagcguaucagaaaagauauuaaaauuauuuauguuucagauaccuuacuacguaggaccccucggacaagaauauaaagacaaaaaaggcuacaauguaugggcggaaagaaaagaaccagggaaaauuuacccauggaauuucgaagaaaagauugauguuaaaaaauccgcagaaaaauucauuggcaggaugguacgaagauguacguacuuguccggcgaacaagcauuaccaaaacaaagcuuacuauacgaaaaauuccaaguacucaacgaacugaacaaucugagaauacgaggugaaaaaauacccgucucuuuaaaacaagagauuuaccacgauuuguucggagacggaaagaaagucagcaugacaagauuaaccaacuaucuguuacaaaacgggguaauaucauccgaagaaaaagacaguuguauaucaggaaucgaugguggauuucacaacucacugucaagcguuggaaaauucaaaggggucuuuggcgauaccguacauaccgacgaacaucguaaaaugauugaagacauuauauuuuggggcacaguauucggcgacggaaagaaacuuuuaaaagaaaaaguggaggaaguauacgguaaucaacuaacagaagcacaaaaaaaaagaauauucggauucaaauucuccggauggggacgcuuaaguaaagcguucuuaacaauggagggugccucaaaagauaauggugaaauaaagggguuaauccaagcuaugugggauacaaauuguaacuugauggaauuacuuagcgaaagauuuacguauaaagacaaacuaaacgaaaugguaacaacagcagaaaaaccgcuaugcgaauggaaaauugaagaccuagaugagauguacuuaagcgcaccuguaaaaagaaugguauggcaaacuauuagagucguugacgaaguccaacagauaaugggaugcccaccaaaaagaauauucguagaaaugacuagaucugacggggagaaagggaaaagaacagugagcaggcagaaaaaacuaguagaccuauauaaagcccuaggaaaggaaggcaaaaucugguccgaagaacuaaauaacacaccagaagggcaauucagaauaaaaaaacucuaucuauacuaccuacaaaugggaaaauguauguacacaggugaaaguauugaguuagaaccacuaaugaaugacaaccaucuauaugacaucgaucacaucuauccccgacauuucaucaaagaugacaauauaucaaauaaccuagucuuaguaaaaaaagaaagaaacgcccauaaaucagauucauuuccaauagaaccagaaauaagaaauaaaaugaugccuuucuggaagucgcuccgaaagaaaggauuuuuaacagaagagaaauacaauaggcuaacucgaaugucagcauuuacugacgaagagaaagcggcuuuuaucucuagacaauuaguagaaaccagccaagguacaaaggcuauuacacaaauauuuaaacaagcguuugccgacucugaaaucguauucaguaaagccagcguaguaucagcguuuagacaaaaauuugacugcuauaaaguuagauguguaaaugauuaccaccacgcccaugaugcguaccucaacauaguugcagguaauacguaucgagugaaguucacuaguaauccuuugaauuuuauuaaagaagcgaaaaagaaccccaauagcagggaaaaucgcuauaacauggauaaaacauuugaaugggauguuacaagaaauggagaaacagcuuggguagcacaaaguaaugagaauccagggaccauacaacuuguuaaaaaauauuugaauaaaaauagcccgcuaaucacaaaaaugguauaugaaaaacacggaggaauaacacaaaaagccacaaucuggagugcaaaaaaagccgagaguggcaacacagaugcauauauaccagugaaaaugaaugacccaagauuagcagauguaacaaaauauggaggaguuaccacaauugcuguugccggauacacccuauuagaauauaaagccggcgggaaaaccgugagaucuuuagaggcuuuaccuauauauuuaggaggaucaaaaaaccuuacagaagaacaaaugguagaauacuuuaguaauauacuucaacaagagaacaaagaaaaaguaguaagcgacguaauaauaagaaaaaaaaugauacccucaggaagccuuauaaaauacaauggauucuauuauuauuuggcagguaaaacugguaauaggauuguacuaauuagugcaguacagcuauguuuaccaauggacaccauguuauauaucaaaaaaauugaaaaagcauguucgaccggaaauuucgaagaaaaagauaaaaacgggaaacaaguauuaaguaaacaacaaaacgaauucguauacgaacuaauuauagaaaaauaucaacaaucuauauuuaaaaaaaagguaggcgcaauaggugauacaaucauugaaaaaagggaaaaauucgcagagauaagucuagaagaacaauguaaaguccugaugcaaauauucuugaacuuucaaaguggaauagguguagaucucacuagcguagauggaucaaauaaaucagguguaaccuaucuaaauaaaaaaauaaugaacgcacaagaacucaaacugauagaucaaagcguaacgggcguuuucucaagagaaauugaccuguuaacaauauga

SEQ ID NO: 5498 - RNA, 4128 nt, Artificial Sequence
  Cas9 variant
augaguaauaaaucauacaguaucgguuuagacauagggacaaacagcguuggaugggcaguaauaacagacgacuacaagguaccuucaaagaaaaugaaagucuuaggaaacacagauaaacacuuuauaaagaaaaaccuaauaggcgcacuacuauucgacgaaggaacaacagcagaagauagaagauuaaaacgaacugcacgcagacgauacacacgacgcaaaaaccgacuucgauaucugcaagaaauauuuucagaagaaaugucuaaagucgauucaucauuuuuccaucguuuagacgauagcuuucuugucccugaagauaaacgaggcucuaaauauccgauuuucgcaaccuuagccgaagaaaaagaauaccacaaaaaguuuccuacaauuuaucaucuacgcaaacaccucgccgacucaaaagagaaaacugaucuaagacuaauauacuuagcucuggcucauaugauaaaauaccgagggcacuuccuauacgaagaaucauucgacauuaaaaacaacgauauacagaaaauauucagcgaguucaucaguauuuaugauaacacuuuugaagaaaguucuuuaauaggccaaaacgcacaaguagaagcaauauucacagacaaaauaagcaagucagcaaaacgugaaagagucuuaaagcuauuuccagaucaaaaaucaacuggccucuucucugaguuuuuaaaacuaauauuaggaaaucaagcagacuucaagaaacauuucgaccuagaagaaaaagcaccacuacaauucagcaaagacaccuacgacgaagacuuggaaaaccuucuaggacaaauccgagacgacuucgcagauuuauuuuuaguugccaagaaacuuuacgacgcuauacugcuauccggcauucucacagucaaagauuuaucuacaaaagcaccccucuccgccuccaugauagaacauuacgagaaucaucaaaaagaccucgccgcacuuaaacaauuuauccaaaacaaccuacaagaaaaauaugacgaaguguuuucagaccaauccaaagacggauaugcaggauacauaaacgguaaaacaacacaagaagccuucuacaaauauauuaaaaacuugcuuucuaaauucgaaggugcagacuacuuccuagacaaaauagaaagagaggauuucuuaagaaaacaaagaacauuugauaacggaucuauaccacaccagauacaccuacaagaaaugaacgcaauucugcaucgccaaggagaacacuauccauucuuaaaagaaaacaaagaaaagauagagaaaauauuaaucuucagaauaccuuauuaugucggaccccuugccagaggaaacagagacuucgcuuggcuaacacgcaacucagaugaagcaauuagaccauggaauuuugaagaaauaguagauaaggcaucaagcgcagaagauuuuauaaacaagaugacaaauuacgaccuuuaccuaccagaagagaaaguucucccaaaacacucgcuccuauacgaaacauucgccguauacaacgaacuaacaaaagucaaauucauagccgaagguuugacgcgauaccaauuucucgacaagaaacaaaagaaagacauauuuuacacuuucuucaaagcagaagauaaacgcaaaguuacagaaaaagacauuauacacuaccuacauaccguagauggauacgauggaauagaacuagagggaauugaaaaacaauuuaacgccucacuuucgacauaccacgauuuacuuaaaauaauaaaagacaaagaauuuauggaugacgauaaaaaugaagccauacuagaaaacauuguacacacccuuaccauauucgaagaucgcgaaaugauaaagcaacgacuugcccaauacaacucccuauuugacgaaaaaguuauaaaggcuuuaacacgaagacauuacacuggcuggggaaaauuauccgcaaaauuaaucaaugggauucgcgacaagaaaaguggaaaaacaauuuuagacuacuuaauagaugacggagaaauuaacagaaauuuuaugcaauuaauacaugaugacggacuaucauucaaagaaauaauacaaaaagcacaaguauucggaaaaacuaaugauguaaaacaaguuguacaugaacucccaggaucuccagccauaaagaaaggaauacuacaauccaucaaaauaguagacgaacucguuaaaguuaugggacacgcuccugaaucaaucguaaucgaaauggcgagagaaaaucaaaccacagcgagaggcaagaaaaauucgcaacaaagauauaaaagaaucgaagauucucucaaaaaucuugcguccggcuuagacuccaacauacucaaagaaaauccaacagauaauguccaauuacaaaacgacaggcuauuucuauauuaccuacagaacggacgagauauguacacaggaaaaccauuagaaaucaaccaacucucaaauuacgacauagaccauauuauuccccaagcguucauaaaagaugauagcuuagacaacagaguacucacaucuuccaaagacaaucggggaaaauccgacaauguuccaucacuagaaguugucgagaaaaugaaagccuuuuggcaacaacugcuagauaguaaacucaucuccgaaaggaaauucaacaaucuaacuaaagccgaaagagagaggggcggacuaaacgaacuugacaaaguuggguucauaaaaagacaauuaguagaaacccgacaaauuacaaaacacguagcacaaauauuagauacaagauuuaacaaagaaguuacugaaaaagacaaaaagaacagaaaugugaaaauaauaacacucaaauccaaucuggucaguaauuuccgaaaggaguucggacuauauaaggucagagaaaucaacgacuaccaucaugcacaugacgcuuaccucaaugccguuguagccaaagcuauucucaagaaauacccaaaacuggaaccagaauuuguuuauggagaauaccaaaaauacgacuuaaaaagauauaucaguagaucaaaagacccaaaggauauagaaaaagcaaccgaaaaauacuucuucuacucaaauuuauuaaauuucuucaaggaggaaguacaauaugccgauggcaccauugcaaaaagggaaaauauugaauacaguaaggacacgggugaaauugcauggaacaaagagaaagacuucgcaaccguaaagaaaguauuaucacucccacaagugaacauugugaagaaaagagagguucagacagguggauucaguaaagaauccauacuuccaaaaggcaauucagacaaacuaauaccaagaaagacaaaggacaucuuaugggaaacuaccaaauaugggggauuugacucuccugucauagcauacagcauccucuuaauugcagauauagagaaaggaaaaucaaaagaauuaaagacaguaaaaacgcugguuggcauaacuaucauggaaaaagcaacauucgaagaaaacccaauuacuuuucuagaaaacaaaggauaucacaauguuaggaaagagaacauacucugccuuccuaaguacucucuauucgaacucgagaauggaagacgaagacuacuagcuagugcaaaagaacuccaaaagggaaacgaaauaguacuaccaguauaucuaacuacauuacuauaccauuccaaaaacuuacacaaauuagacgaaccaggacaccuugaauacauacagaaacaucggaacgaauuuaaggaccugcuaaaucucgugucagaguucucccaaaaauacauccucgcagaugcaaaccuggaaaagauacaaaauuuauaugcagacaacgaacaagccgacaucgaaauucuggcuaacaguuucauaaacuuacuaacauucacaacgcuaggugccccagcagcauucaaauuuuucggaaaagacauagauagaaaacgcuacacuacagucucagaaauucuaaaugcuacacucauacaccaaucaauaacaggucucuacgaaacaagaauugauuuaucuaaacuaggagaagacuga

SEQ ID NO: 5499 - RNA, 4128 nt, Artificial Sequence
  Cas9 variant
auggaaaaauccuauagcauagggcuagauauaggaacaaauucaguaggaugggcaguaauaacagaugauuauaaagugccagccaagaaaaugaaaguauuaggaaauacagauaagaaauauaucaagaaaaauuuauuaggggcucuauuauucgacuccggugaaacagcagaagucacaagauuaaaaagaacagcacgaagacgauauacaagaaggaaaaacagacuucgauaccuacaagaaauauucgcuaaagaaaugacuaaagucgacgaauccuucuuccagagacuagaagaaucauuccucacugacgaugauaagaccuuugacucacacccaaucuucggaaauaaagcagaagaagacgcauaucaucaaaaauuuccaaccauauaucaucuuagaaaauacuuagcugauucccaagaaaaagcugacuuaaggcugguuuacuuagcauuagcacacaugauaaaauacagaggucacuucuugauagaaggagaauuaaacgcggaaaauacagaugugcaaaaacuuuuuaauguauuugucgaaacauacgacaaaaucgucgaugaaucucauuugagcgaaauagaaguagacgcgucaucaauacucacugaaaaagucucaaaauccagaagauuggaaaaccugauaaaacaauauccaacagagaagaaaaauacacuauucggaaauuuaauagcauuagcccuuggacugcaaccuaauuuuaaaacaaacuucaaacucucagaagacgcgaaacuacaguuuucaaaagacacauacgaagaagacuuagaagaacuucuggguaaaguaggugaugacuacgccgauuuauuuaucucagcuaaaaaucuauaugaugcaauacuauuaaguggaauuuuaaccguugacgauaauucaacaaaagcaccacucucagcuucgaugauuaaaagauauguugaacaccacgaagaucuagaaaaauuaaaagaauuuauaaaaauaaacaaauuaaaacuguaccaugacauauucaaagacaaaaccaaaaacggauaugcaggguauauagacaacggcgucaaacaggacgaauuuuacaaauacuugaaaacgauucuuaccaaaauagacgacucagauuauuuucuugauaaaauagaaagagaugauuuucuaagaaaacaacgaacauucgacaacggaucaauuccacaucaaauacacuuacaagaaaugcauucaauacuacgacgacaaggagauuacuauccauuccuuaaagaaaaccaagccaaaaucgagaaaauuuuaacuuucaggauaccauauuacguuggcccacucgcaagaaaagauucgagauucgcaugggcaaauuaucacucagaugaaccaauaaccccguggaauuuugacgaaguuguagauaaagaaaaaucagcagaaaaauucauaacacguaugacuuuaaacgacuuauaccuaccagaagaaaaaguucuuccaaaacacucacauguuuaugaaacuuuuacaguauacaaugaauuaacaaaaauaaaauacguaaaugaacaaggagaaucauucuucuuugaugcaaacaugaaacaagaaauauucgaccacgucuucaaagaaaacagaaaagugacaaaagcaaaacuucucuccuaccugaacaaugaauuugaagaauuuagaauaaaugaucuuauaggauuagacaaagacucaaaaaguuuuaaugcaucucuagguaccuaccaugaucuuaagaaaauauuagauaaaucauuucuagacgauaaaacgaacgggcaaauaaucgaagacauuguucuuacacuuacuuuauuugaagacagagauaugauucacgaaagacugcagaaauauucggacuucuuuacaagucaacaacuaaagaaacuagaacgccgacauuauacaggauggggaagauuaucguauaaacuuauaaacgguauuagaaauaaagaaaacaacaaaacaauacuagauuuucuaauugaugacggacacgcaaacagaaacuucaugcaacuuauaaaugacgagagcuuaucguucaaaacaauaauucaggaggcccagguaguaggcgaugucgacgacaucgaagcugucguacaugacuugccaggcuccccagcgaucaagaaagggauacuccagucuguaaaaauuguugacgaacucgucaaaguaaugggagacaauccggacaauauaguaauagaaauggcaagagaaaaccaaaccacaggcuacggcaggaauaaaucaaaccaaagauuaaaacgucuacaagacucccuaaaagaauuuggaagcgauauucucagcaaaaagaaaccaucuuacgucgauagcaaaguagaaaacagccacuuacaaaacgacagauuauuccuauacuacauucaaaacggcaaagacauguauacaggagaagaauuagacauagauagacuaagcgauuacgauaucgaucacauaaucccccaagcguucauuaaagauaacagcauagauaacaaaguacuaaccucauccgcuaaaaaucguggaaaaucugaugaugucccaucaauagaaauaguccgaaauagaagaucauacugguauaaacucuacaaauccggacuuauaucaaagcgaaaguucgacaaccuuacuaaagcugagcgaggaggguugacggaagcagauaaagcaggguuuauaaaacgacagcuaguagagacccggcaaauaacaaaacauguugcucaaauauuagaugcacgauuuaacacaaagagggacgaaaaugacaaaguaauaagagauguaaaaguaaucacuuugaaaagcaaucuugugagucaauuucgcaaagaauuuaaauucuacaaagugagagagauaaacgacuaucaccacgcccaugaugcuuaccucaacgcaguaguaggaacugcacuacucaagaaauaccccaaacuaacaccggaauuuguauauggagaauauaagaaauaugauguucgaaaacuuauagcgaaaagcagcgaugauuacagugaaaugggaaaggccacugcaaaauacuucuuuuauaguaacuuaaugaacuucuucaaaacagaaguuaaauaugcugaugguagaguauucgaaaggccugauauagaaacaaacgcagauggagaagugguauggaauaaacaaaaagacuucgauaucguccgaaaaguccucucguauccccaaguaaacauagucaagaaaguugaagcccaaacaggugguuuuucuaaagaauccauccuuucaaagggagacagugauaaacuaauacccagaaaaaccaagaagguauacuggaacacgaagaaauacggaggcuuugacucuccaaccguagcauacuccguauuagucguagcagacauugaaaaagguaaagccaagaaacuaaaaacuguaaaagaauuaguggggauaucaauuauggagcgauccuuuuucgaagaaaacccaguaaguuuccuagaaaagaaaggcuaccacaauguacaagaagauaaauuaauaaaacuaccaaaauauucuuuauucgaauuugaaggaggaagaagaagauugcucgcuagugcgacagagcuucaaaagggaaaugaaguaaugcucccagcacauuugguagaacuauuauaucaugcccaucgaaucgacucauuuaauucaacagaacaucucaaauacguaucagaacacaagaaagaauuugaaaaaguacuaucauguguagaaaacuucucaaaccuguauguagauguggagaaaaaucuuucuaaaguuagagcagcagcagaaaguaugaccaacuuuucauuggaagagaucagcgccucauucauaaacuuacuaacacuaaccgcucuuggggccccagcugauuucaauuuccuuggagagaaaauacccagaaaaagguacaccucuaccaaagaauguuuaucagcgacauuaauacaucaauccguaacggguuuauaugaaacccgaaucgauuuaucaaaacuuggcgaggaguga

SEQ ID NO: 5500 - RNA, 4128 nt, Artificial Sequence
  Cas9 variant
augacaaagauaaaagacgacuauauaguuggacuagauauaggaacagauucaugcggcuggguagcaaugaauucgaacaacgacauauuaaaauuacagggaaaaaccgcgauaggaaguagacuauucgaaggaggcaaaucagcagcagagagacgccuguuucguacaacccauagacguaucaagagaaggagauggagauugaaauuacuagaggaguuuuucgauccauauauggcagaagucgauccauacuuuuuugcuagacugaaagaaucaggauuauccccauuggauaaacgcaaaacaguaucaagcaucguauuuccaacaucugcggaagacaagaaauucuaugaugacuacccaacaauauaucaccuaagguacaaacucaugacagaagacgaaaaguucgaccuacgagaaguauaccuagcuauacaucauauaauaaaguauagaggaaauuuccucuacaauacaucuguaaaagacuuuaaagcaucaaaaauagacguuaaaucaagcaucgaaaaacuuaaugaauuauacgagaaucugggccuagaccuuaacguagaauuuaacauuagcaacacagcagaaauagaaaaaguguuaaaagauaaacagauauuuaaaagagacaaaguaaaaaagauagccgaacuauuugccauaaaaaccgacaauaaggaacaaagcaaaagaauuaaagauauaucaaaacaagucgcaaaugcgguuuuaggauacaaaacaagauuugacacaauagcacucaaagaaauuucgaaagaugaguuaagcgauuggaacuucaaauuaucagauauagaugcagacagcaaauuugaagcacugaugggaaaccuggaugaaaacgaacaggcaauauuacucacaauaaaagaauuauucaacgaagugacccugaacggaauagucgaagacggaaacacauuaucagaaucuaugauaaacaaauacaacgaucaccgagaugaucugaaauugcucaaagaaguuauagaaaaccauauagaccgcaaaaaggcuaaagaauuggcacuagcauaugaccucuauguaaauaauaggcacggacaacuauuacaagcaaagaaaaaacuagguaaaaucaagcccagaaguaaagaagacuuuuacaaaguuguaaauaaaaaccucgaugauucacgagcgucuaaagaaauaaaaaaaaaaauagaacuagacuccuucaugccaaaacaacgaacuaacgcaaaugggguaauccccuaucaacuacaacaauuggaacuugauaaaaucauagaaaaccaaucaaaauacuacccauuccuaaaagaaauaaaucccguaucaucucacuuaaaagaagcaccauacaaauuagacgaauuaauaagauucagaguaccauacuauguaggaccacugauuaguccaaacgaaucaaccaaagauauccaaaccaagaaaaaucaaaauuuugcguggaugauaagaaaagaagaaggaagaaucacacccuggaauuucgaccaaaaagucgauaggauugagagcgccaacaaauuuauuaaaagaaugacaaccaaggacacguacuuauucggagaagacgucuuaccugcaaauagcuugcuuuaccagaaauucacagucuuaaacgaguuaaauaacauacgaauaaacggaaaaagaaucucugucgaccucaaacaagaaauauaugaaaaccucuucaaaaaacacaccacuguaacaguaaaaaaacucgaaaacuacuuaaaagaaaaccacaacuuagucaaaguagaaauuaaaggauuagcagacgaaaagaaauucaacucagguuuaacaacauacaacagauuuaaaaaccucaauauauucgacaaucaaaucgaugauuuaaaauacaggaaugacuuugaaaaaaucaucgaaugguccacaauauuugaagauaaaucuaucuacaaagaaaaacugaggagcauugauuggcuaaaugaaaaacaaauuaaugcauuaaguaauaucagacuccaaggauggggaagauuaagcaaaaaacucuuagcccaacuucacgaccacaacggucaaacaauaauagaacaauuaugggacucccaaaauaacuucaugcaaaucguuacacaagcugacuuuaaagacgcgauagcaaaagccaaucaaaaccuacuaguagcuacaucaguagaagacaucuuaaauaaugccuauacauccccugcuaauaaaaaagcuauucgacaaguaauuaaggucguugaugauaucgucaaagcggcaucaggcaaaguacccaaacaaauagccauagaauuuacaagagaugccgaugaaaacccaaagcgaucccaaacacgcggaucaaaacuacaaaaaguuuacaaagaccuauccacagaacuagcaaguaaaacaauugcagaagaacuaaaugaagcaaucaaagacaaaaaauuaguucaagauaaauacuaccuuuauuucaugcaauuaggaagagacgcauauacuggagaaccaaucaauauagacgaaauacaaaaauaugacauagaccauauccucccacaaaguuucaucaaagaugaugcucuagauaaccgcguacuaguaucuagagcaguaaacaacggaaaaucagacaauguucccguuaaauuauuuggcaacgaaauggccgccaaucuaggcaugacaauaagaaaaaugugggaagaauggaaaaauaucggacuaauaagcaaaacuaaauacaauaacuuacuaaccgaucccgaucacauaaauaaauacaaaucagcuggauucauaaggcgccaauuaguggaaaccucacaaauuauaaaacuaguauccacaauacuucaaagccgcuaccccaacacagaaauaauaacuguaaaagcaaaauacaaucauuacuuaagagaaaaauuugaccuauauaaaucacgagaaguaaacgacuaccaccacgccauagaugcuuaccuaucugcuaucugcggaaaccuacuauaccaaaacuacccuaaccuacgaccauucuuuguuuacgggcaauauaaaaaauucuccucagacccggacaaagaaaaagccauauucaauaaaacaaggaaguuuagcuuuauuagucaacuacuaaaaaauaaaagcgaaaauaguaaagaaauagccaaaaaacucaaacgugcauaucaauuuaaauauaugcuaguuucuagggaaacagaaacacgcgaucaagaaauguucaaaaugacuguauauccuagauucucacacgacacaguaaaagcuccuaggaacuuaaucccaaaaaaaauggguaugucuccugauauauacggaggauacacaaacaacagcgacgcauauauggugauaguuagaauagauaaaaaaaaaggaacagaauauaaaauauuagguauuccuacacgagaacuuguaaacuuaaaaaaagcagaaaaagaagaucacuacaaaucauacuugaaagaaauuuuaacaccuagaaucuuauacaauaaaaacgguaaaagagacaaaaaaaucacaucauucgaaauuguaaaaucaaaaauaccguauaagcaaguaauucaggacggagauaagaaauucaugcucggauccaguacauaugucuauaaugcuaaacaacucacgcucucaacagaaaguaugaaagcaauaacaaauaauuuugacaaagacagcgaugaaaaugaugcucucauaaaagccuacgacgagauacucgacaaggucgauaaauaucugccacuauuugauaucaauaaguuccgagaaaaacuacacaguggacgggaaaaauucauaaaacuaucauuagaagacaaaaaagauaccauucuuaaaguauuagaaggacugcacgacaacgcaguuaugacgaaaauuccaacuauaggacucuccacgccauuaggauucaugcaauucccuaaugguguaauacuaagugaaaacgcaaaacuuaucuaucagucacccaccggccuauuuaaaaagagcguaaaaauuucggaucucuga

SEQ ID NO: 5501 - RNA, 4131 nt, Artificial Sequence
  Cas9 variant
augucuaauuuugacaaccacaaagacucaaucugcaaacacaaaggacuaaagaaagggaacuauuauauuggauuagauaucggaacaaacucaguuggaugggcagcaacaaaugaacaauaugaauuacucaaauucaagucacacaaaauguggggaucaagacuuuuugcugaagcgcaaacagcaguugacacgcgaaugaaaagaucggcaagaagaagauuacaaagacgcaaauuucgauuaauauuacuugaaucccuauuuucaaaagaaauaaaugccguagaugaaacauucuucaugagauuacacgaaucgaacuaucacguugaagacaaaacaaaucuuguuaaauacacccuuuucauagacaaaaauuacacagauguagacuacuauaaagaguucccgacgauuuaccaucuacgccaccaccuaaugacagaaggaacaaaagauauccgacuucuuuucuuagcaauacaccacauucugaaauauagaggaaacuuucuauacggaaagaaagaauuuucaguagacggagaaauguauucaguacucaggucuacacuagaagaacucggauuuggaaguuacguagaagaugaaaacguacuucaaucaauagcaaaucuaguacuagaucgaggaauugcccguucugaaaaagucaaacaaauugagccacuaauugcgcaaggcaagaaacuaagcucuguagagaaaaaucgauuaaaagcaugggcuuaccucauaaugggcuuaaaagcgaacuugguuaacuuauuuacagacgaagacguugaaguaguauuaccagaagagaaagaauuuaaaucaaucaauuuacaugagggaauauacgaagauguacgagacgcuuacgaagaugcuuggggcgaccgauuugccauugucgaccaauguaaaguccuacacgacaucauuguuauaucgagcauuauuaaaccagggcaaucccuaagcgaagcaaaaaucgaaucauacaaccaacauaaagaagacuuaguacuacuuaaaagcguacuaaaagaagauaagaaacuauaugacgauauguuuguuguagauauagauaaaggaacuaacuacgugaaauacaucaaacaaggagucaacgguaacacaucuaccacucaagaagcguuuuauaaauauguaagaaaaguagucucaguucucccagaaaccgaaaauacucgcuguauaguccaaaaauuagaggaaggaacauuccuuccacuccaacgaauuaguaaaaacggagucguaccuuaccaauuacauaaagaagaacucgucagaauuuuagaaaaagcaaaauuaaacuuccccuuucugaaugagguagaagauggucucacaguagcggacaaaaucauuagcauacucgaguucaaaauacccuauuacguaggaccucuaaacccaacacacuccauagagaauggagguuucgccuggguaguacgaaaagaagcaggucaaguacuuccauggaauuuugaacaaaaaguugauguacaagcaucagccgucaaauuuauagaaaaccugacaaacaaauguacauaucuaaucgaccaagauguccuaccaaaauauagccuccuauaugcggaauuuucucuacuaaacgaguuaaacaauauaaggguaaacgauaaaccuuuaccagcagacgucaaacaggcuuucauaagagaucacuucauaagucuacaagacuccaaaaccgcaaccaagaaaguaguagcuaaauaucuaguagacaacaacuacguaucacaaccgccaauaauaacaggcauggaucaacaaauagcaacaaaacuaacaagccaccgcgauaugacacggauacucggagaacauuuugacuacgcuauggccgaagauauaaucagauacauuacaaucuucggagaauccaaagauauguuaagacaaguccuuaaaaauuauuauggagaucgucuaacaacggaacaaauuaagaaacuagggaaauugacauauacaggcuggggucgacuuagcaagaaauuccuuucugacauauggggcaugaagaaaaaugacgaugacgcugaagcagguacaaucauagagcacaugagagaaggccaagagaaccugaugcaacugcucucaucuaguuauucauucauagauguaguccaggaauacguaaccaacguucuaggggcgaaagagaaaaccgcauuugaaauguuagaagaccuaucacucagcccaaugguuaaaagaucuguuuggcagacauuaagaauacucgaugaaauuguaucaaucagaaaagaacuacccaagaaaaucuuuguagaaguagcaagaacgaacaaagccgauaagaaacgaacccagucucgaaaagcguuacucgaagaacuuuacgaacaaaucaaagacgaagacguucauguauuacaacaagaacucgaaucaaaagaagacucagcucuaaacagcaagaaacuguaccuauauuuuacacaaaugggaagauguauguacucuggacgccguauagauauacacgaacuauucacagacacuuacgacauagaucauauauacccaagaucgcuaacaaaagacgauucauggcauaacauuguacuuguugaaaaacaauugaacgccgagaaaacagaucgauuuccaauauuaagcgcaauacaaucaaaacaaaaaggauucuggaaacuauuaugggauagaggauucauaucagaaaagaaauaugacagacuuguaagaaccacugacuuaaccgacgaagaguuaaaucaauucauaaaucgacaaauagucagcacaaaucagagugucaaagccgugaccacgcucuuacaccagcuuuacccugaaacagagguuguauuuucgaaagcagaaaacauauccgauuuuagaagagacuauggauucguaaaaguacguagcauaaaccaccaucaucaugcgaaagacgccuacuuaaauauaguuguaggaaauguguaucaugaaaaauuuacgaaaaacuuuuugucuuuugcaaaacaaaaaggcacucauagaacguacaauuuaacaaaaauguuugaauaugagauaaaacuaacagaggaaucgaagaaaguaauaugggauccaaauauacauauggacauaguaaagaaaaugaugaaaaguaacgauguuaggguaacacaaagagcaguuccgcaaaaaggcgggcuaagcgacgaaacaauauacaagaaaggcauagcaaaaagaggaguauaucuaccacuaaaaagcucagacgaaagagucagagauguagaaaaguauggagguagaacaucaauaacaauaagcgaauacauuauacuaaacauccgcgauacauccgaccaagauagaauagaaauauuuagccuaccuuuauacauagcaggcaagaaagacauccacaaagccauugaagaagccuaucuaaguacaugcaagaaaccagcaucagucguagacauccaaauacuauauagaggauuguauauaggauccaaagucaacauaaacggauucacauacuauauggguggaaaaacaggaucaaacgucagcguggacucagccguugacguaguaauggauaucacaucaucaguuuacauaaaacuccuugaaaaaguugcaaucaagaaaaucgaaaauucaaaaacauuuaggaucgaaaauauaaaaaccucauacaaccacaaagaagucacugucucuaaggaacaaaauaucgcucuauaccaagaacuccucaagaaauuagacacuccuuuauucucaaaaaugaaagguaacaaacuagaagaguucagaaccguaggcuuugacacauuuauagcacuaucauuagaagaccaagcaucaguccuacuagaaguccuaaacguacuaacaaauuuuaaaacaaaacgagacauuacuaaaauagguaugaccucaucacgaaguacguuggggauuaauauaucuaacacggaacaauucucaguaaucaccacuucaauaacuggacuauaugaacaagaaauaaaaauaaaauga

SEQ ID NO: 5502 - RNA, 4131 nt, Artificial Sequence
  Cas9 variant
augaccacaaaaaacagagaaaaaaauaacaaauuucauaaagcaucccccuuauauacauuaggccuagauauagguacaaccucagucggauucacagcaauagaugaagcccaaagaccaaugagagcuaaaggcaaaaccguuauuggaguacgacucuuccaagaaggacaaucagcgguaggaagaaaaaacuuuagaacuacacgccgacgacuaaaaagacgaagaagacgacugaauuuacucaaacaauuuuucucagccccauuaaggaagauagauccuacauuuuucaaacgacucaaagcaucaucacuaucuccugccgauaaaagaagauaccuugcaccaggacuauucccuaaugguggcgauauuaaauucuaccaaaaauaccccaccauauaucacuuaaggcuagcucugaugacagaaaaaagacccuuugauuuacgcgaagucuaucuagcuauccaccacauaguuaaauauaggggaaacuuucuaaacccacuacccguuucugcauuuagaggacgaaaccaaagauuugaggaccaauucagcgaacuuaaucaacuauauaaaucacucgaaggggaaucacccuuucaauuugaugaaaaaauauucucagaacuagacaaacaacuauuaguaaacgaugguagaaaaauugauaggcaaaaacaacucgcuaaacgcguauuuauaaaaacgaaugaaaagcgcauagauucccaccaucaaaaaauagcuuccgcuuuuucuaaagcagucuuuggauauaaguucagaccagauguacuguuaaacucagaucccaacgaaagcauagaugaauuuaucaaguuuggagaugaagauuucgacgacaaacuaguaauauuacgcgaaucacuaaacgcaacucaaaaagaaauuuuagcagucacacaaagaaucuauucccaaauuauucuuaacgaaauaguuccaucucgcgagacguuaagcgaggcaaugguaucuagauaccaaaaacaccauucagauuuacaacuuuuaaccgaagcauguaaaaagaugacuaaagcaaaagcggccagaauucaagcagcauacacugacuauaucgggaaaggggacggccacaaacugguucacgaucaauuuguagcacucauaaaaaaaaacuuagauccuagugaagaaggaagggauuuagcagaaagguuagcgcaagaugacuucaugcccuuacaacgcacgccccugaacagaguuauaccccaucaacuccaacaagaagaacucgaccgaaucauagaaaaucaaggugaauauuacccauuccuuaaaacacuuaauccaaaccgaucucgagcuggagucgcgaacuaucaacucgacgaacucguaucauuccgaaucccauacuauguugguccacuaaucacggcaacugaccaacuacacacauccggagcaaaauucgcuuggaugacaagacgcgccgcaggugaaaucacccccuggaacuucgaucaaaaaguggaucggcuagcaucagcuaaucaauuuauaagacaaaauaugccaaaagacaaccaucugcuagaagcagauguauuaccggcaaacucccuaacauaucaaagauaucucguccuagacgaguuaaaugcaguuaaaguaaaccacaagucgcucaccgucucgcaaaagcagcgaaucuuuaacgaccuauuuaaacgccaaagaaccguaacaguacucaaccuacaaaacuacuuaaaaucaauagaaaaacuaccaacccucccagucaucacuggagucuccgacucagaaagauuuaaaacuacacuaucaacauaucucgacuucaaaaauaucuucgguggaaaaguugaugacucuagucaaaaggaaaaauucgaaaaaauuaucuuauacgcuacaauauuugaagaucaugcaguauauaaagcaaagcuagaucaaauagacuggcuuggacaacaacaaaaaacugauuuacuaucaaaaaacuaccaagguuggggacaacuauccgaaaaacuacuccuggguuuaaaaaaccaggcagggcaaagcauauuagaugaacuguggcaaacuaauaaaagauucagagaaauaaugaacgaagcacacuuugcuaaacaaauuauggcauccaacgcagcccuauuacguaaaaaagguuuagaugaugucuuaucaacugcauuucuaucaccacagaauaaaaaagcaauaagacaaacuguggaaguugucgacgacauaguaaaagcuauugguuguccaccacagaaaauaucucuccacuucaguaaagccccagccgacgcaauacgccaugagagagauaacgcaaacauaauccuacgaacuuaccgaaacuuaccugccaaaaugguagaugaccaacuuaaggcagaacuacaagcaacagcagaaaaacaucaaguauugucagauaaauuguauuuauauuuuacacagcugggacgagaucuauauacaggagaaaugcuuaaaaugagcgaacuagaaaacgacaugauugaucacaucaugccccaaacauucgcauacgaugacucugucaacaaucgcguacuuguaucgcaaaaucauucuucacaacuaggaaaaacauccggugaaaaaucugacgcuaaaaugauccgauucuggcaaguauuacgcgacaauaaacugaucagugaacagaaauaucaaaaccuuacucucgacagcgaucaccucucaaaaagcaccagggaacaacucuuaaaccgauacuuaguagagaaaaacccaauaacacaaugggucgcaucaguucuuacagaaaaguauggagauaauggcaccaggguauuaaccauaaauccgcgaaugguauaccaaaugagaagacaauucaaucuaguuaaucuuccugagguuaacgacuaugaccauggacucgaugcauacuuagcagcauucaucggaaauuauguagaucgaagauacccuagacucagauccuauuuuguauacggagacuucucaucaucaaaagaaauagucuuucgacucaacagguucaauuucuuauucgaccucgggcaagcagaacccaaugagcuaacggacugggaaacaggggaaaugauaugggacaaagcugcagcaaauucagucuuacgagauguauaccaauacaaauuuaugcugauaucacaagcaguuuacucccgacaaggagcaauguucaaucaaacuauauauccugcuucacaagcugccgggcgucaacuaauucccguaaaaaaaaacagagccacuaaauuguacggcgguuacagcggaaacguagaugccuauuuagcaauuguucgauuagguggaccaaaaucagaccaguaucgcguaguaggaaucccaacaagaaugguaggaagguuacaaucugccaugaagcaaggugcugacacauaugcaaauacauuacacaaaauauugcaaccccaauuuaccaaaaggaaaaaaaaucgccaaacugguuacuaugaagagacaacugagccauucgcaguaaucuuggauaaaguauacuacagacaauuaauaauagacggacagcaaaaauuuauguuaggcaguucuacuuaucaauucaacgcaaagcagcuaguauuaucuucacgcgcaagacaaauacucucaggcgaagaacgguuaacagacgaaaacgggagccaagaccugaucgacguauacgaugagauccuaacgaaaauagacagauacuucgaauuauacgaccaaagacacuuuagacaaucacuccaugauggaagaaaacaguucauaucccucccuauccauaacguuuacagagccaaucgacuuaucgagcacggaaaauacgagacauuaagccaaauccuaaacggacuucaugcaaacaccaugaugacaaauuuaagauaucuuggaauaucgucaccuuuugguaaauuucaaucucccaacggcauaaaacucucaaaagaugccguguuaguauaccaaucaccaucagggcucuucgaaagaagagugagacuaagagacuuauga

SEQ ID NO: 5503 - RNA, 4131 nt, Artificial Sequence
  Cas9 variant
augaacaauaaaccauacucaauaggacuugacauaggaacaaauucagucggaugggcagugauaacggaugacuacaaaguaccaagcaagaaaaugaaaguacuuggaaauaccgacaaacacuucaucaagaaaaacuuauuaggugcacuuuuauuugaugaaggaacaacagccgaagacagacgacuaaaacgaacugcacgaagacgcuacacaagacgcaaaaauagacuccgauaucuacaagaaauuuucacugaagaaaugagcaaaguagauauaucauuuuuccaccgucuagacgauucauuccuggugccagaagauaaaagaggaucgaaauauccaauuuucgcaacccuugaagaagaaaaggaauaccacaaaaauuucccgacgauauaccaucugcgcaagcaccuugcagacucgaaagaaaaagcagacuucagauugauauaccuugcauuagcccauauuauaaaauauaggggacauuuccuuuacgaagaauccuucgacaucaaaaauaacgauauucagaaaauauuuaacgaauuuauaucaauauacgauaauaccuuugaaggauccucacuaaacggccaaaaugcgcaaguugaagccauauucacggauaaaauaucuaaaucagcaaaaagagaacgcguucuuaaacuauuuccagacgaaaaauccacaggccucuuuucugaguucuuaaaacuaauagucggcaaucaagcagauuuuaagaaacauuucgaucuugaagaaaaagcaccccuucaauucucaaaagauacauaugacgaagaccuagaaaaccucuuaguacaaauuggugacgacuuugcggaccuauuucuaguagcuaagaaacuuuacgaugccauacuacuuaguggcauuuuaacaguaacugaucccaguacgaaagccccacuuuccgccaguaugauagacagauaugaaaaucaccaaaaagauuuagcagcucuaaaacaauucauaaaaaccaaccuucccgaaaaauacgaugaaguauucucagaccaaucaaaagacggcuaugcaggauacauugauggaaaaacaacacaagaagcauucuauaaauacauuaaaaacuuauuaucaaaacucgaaggugcagacuauuuucuugacaaaauagaacgagaagacuuccucagaaaacaacgcacauuugacaacgguucaauaccccaucaaauacauuuacaggaaaugaaugcuauaauaagacgacaaggagaacacuaucccuuucuccaagaaaacaaagagaaaauagagaaaauuuuaacauucagaauacccuacuauguaggaccccuagcucgaggaaauagagacuucgcuuggcuuacaagaaauagugaucaagccauuagaccauggaacuucgaagaaauaguggauaaagcaagaucagcagaggauuuuauuaauaaaaugacaaauuaugauuuauaccuaccagaagaaaaaguacuaccaaaacacucacuacuuuaugaaacuuucgcagucuacaaugaacucacgaaaguaaaauuuaucgccgaaggacuuagagacuaucaauuccuugacaguggacaaaaacaacaaauaguuacccaauuauuuaaagagaaacguaaagucacagagaaagacaucauacaauaccugcauaacguugacuccuaugacggaauagaauuaaaaggaaucgaaaaacaauuuaacgcaucgcuaucaacauaccaugaucuacucaaaauaauaaaagacaaagaguucauggaugauuccaaaaacgaagccauccuugaaaauaucguacacacucuaacaauuuucgaagaccgcgaaaugaucaaacaaagauuagcacauuacgcaagcauauucgacgaaaaaguuauaaaagcucucacuagacgacauuauacaggaugggguaaauuaagugccaaacugauuaacggaauauacgauaaacaaagcaagaaaaccauacuagauuaucuaauugacgauggcgaaauaaaccgaaauuucaugcaacuaaucaacgaugauggacuaucauuuaaagaaauaauacagaaagcacaaguaguaggaaaaacuaaugacgucaaacaaguaguccaagagcuuccuggaagcccugcaauaaagaaaggaauccuccaaaguaucaaacucgucgacgaauuagugaaaguaauggggcaugcaccagaaaguauaguaauagaaauggcacgcgaaaaucaaaccacugcgagaggcaagaaaaauagccaacaacguuauaaaagaauagaagacgcccuuaaaaaucuugcacauggccuagacucgaacauccuaaaagaacacccuaccgauaacauucaacuccaaaacgaccgacuuuuucuauacuaccuacagaauggaaaagacauguauacuggaaaaagccucgacauaaaccaauugucuucaugcgauauagaucauaucauuccgcaagcauucauaaaagaugacagccuugacaaccgaguauuaaccucaucaaaagacaauagaggaaaaagugacaauguaccaucacuagaaauuguucaaaaacgaaaagcguuuuggcaacaguuacuagacucaaaauuaauaucagaaagaaaauucaacaauuuaacaaaagcugaaagagguggacucgaugaaagagauaaaguaggauuuauaaaaagacagcuagucgaaacccgacaaauaacgaaacacguagcccaaauacuagacgcacguuucaacaccgaaguaacagaaaaagacaagaaagauagaucagugaaaauaauuacgcuaaaaagcaaucuaguuagcaacuuuaggaaagaguuccgcuuauauaaaguacgagaaauaaaugacuaucaccacgcccaugauccuuacuuaaacgccgucguagccaaagcaauacuaaagaaauacccaaaacucgaacccgaguucguauauggugauuaccagaaauaugacuuaaaacguuauauaucaagaacaaaagaccccaaagaggucgaaaaagcaacagaaaaauauuucuucuacucaaacuuacuaaauuucuucaaagaagaaguucacuacgccgacggaaccaucguaaaaagagaaaacauugaauacagcaaagacacaggagaaauugcauggaauaaagaaaaagacuucgcaaccaucaagaaaguccucucauuaccucaaguaaauauaguuaagaaaacagaagaacaaacaguuggacaaaacgggggcuuauuugacaauaauauaguaagcaaaaagaaagucguugacgcuagcaaacuaaccccaauaaaaaguggacuuuccccagaaaaguacggaggauaugcuagaccuacaaucgcauacuccguacucgugauagccgacaucgaaaaagggaaggccaagaaacugaaaagaaucaaggaaaugguaggaauaacaguacaagauaagaagaaauuugaagcaaacccaauugcauauuuagaagaauguggcuauaaaaacauaaacccgaaccuaaucauuaaacuaccaaaguacagccuuuuugaauuuaauaauggacaaagacggcuucucgcgucauccauugaacugcaaaaaggaaaugaauuaaucguacccuaucacuucacagccuuauuauaucacgcgcaaaggauaaauaaaaucagcgaaccgauucauaagcaauacguggaaacucaucaaagugaguucaaagaauuacuaaccgcaaucauuucccuaagcaagaaauacauucaaaaaccaaacguagaaucacucuuacaacaagccuucgaucaaagugauaaagauauauaccaacuaucugaaucuuuuaucagcuuauuaaaacucaucagcuucggugcacccggcacauucaaauuccucggaguagaaauaagccaaaguaauguucguuaucaaucaguaucuagcuguuuuaacgcaacacuuauacaucaaaguauuacaggacuauaugaaacuagaauagacuuauccaaacuaggagaagauuga

SEQ ID NO: 5504 - RNA, 4131 nt, Artificial Sequence
  Cas9 variant
auggacaagaaauacggaauaggauuagacaucggaaccucguccauaggauggacuguuguagacaaauauggacauaucauaagaguuaaaggccaaacuggaaucggaguacgauuauucagagaaggucaaacugcagcagaaagaagaacauuuagaacaaccagaagacguuuaucuagacguagauggcggcugagacuacuacgagaaauauucgaugaaccaauaucagcuauagacgaaaauuucuuugcucgucaaaaggcuucaucacucgcaccaggugaugcacgauaucaacaagcauuccaacucuuuaaugauagaacugaucaagccuuuuacuguaaauaucccaccauauaccaucucagacaagcacuuaugacugaaaguagacaauuugacaucagggaaauuuacuuagcacuacaccaaauaauaaaguaucgcgggcacuuuuugcuaggaggagcggcaaaagauuuucaaucagacaagcucgauuuagaagcguacuucacaacaaucaacgcucaacuagcagggaucuacucagacgguagcgugcaauuacccacacuagacuggaaccaggccugucaagagcuuacagauacaucaagaacacagucagaccguaaaaauuggcuugucaaagaauuaaagagcuacggagauucacaauuaaaaccgauauacacucaaaucgccaacgcgauacuaggauucaaaacagacuuagccaaaauaaugggcaucaacgacccagaaaaagcacuuaguuuuaaccucgaugcacuagaugaucauagggaugacgucgcggaauuauuaacggaugagcaaauaccucuagugaacuuauuagcuaaacuacauacugcauuggaacuugcagcaauccuaccagacggucaaacacuaagcggaaaaaugguagagauauaugaaacccacagaaaacaauuaaaaacauacaaagccuucauaagacaauuaccggaccgccaacagcgacuagcucuaaaacaggcauaugaccauuauaucgaucaaggucuaaauagagaggcauucuauucugaagucaaagcuauacucgaaaaacaaaaacccuuaaccgcgacaggucaagcaaugaagaaagcuauggaucaaaaugcuuucuuacuaaaacaacgaacaaaaaccaauauagcaaucccuuaucaagugcaacagcaagaaauggaccaaauaaucgcuaaccaaucgaaauacuauccauggcuagcaacaccuaauccuguaaaaucaagaagaguaauagcaccauacaaacucgaugaauuaguaugcuuccgugucaauuacuacguaggaccauuaguacaauccaagccaggagaagcuacaaaagaagcaaaauuugccuggaugacccguaaagauccacaaucaacuguagcgaucacuccuuggaacuuugaucaacaaguggacagacaagcuagcgcaaaugcguucauucaacgaaugaaaacuacagauacauaccuacuuggagaggauguuauccccaaaaacucuuuauuauaccaaaaguaugagguuuuaaaugaacuuaauaauguuagaguuaauggagacugguuagacccccaaagaaagcaauaucuauucaagaaauuauuuauggaucaaccacaaaguguaguuacaguuaaagcauuacaaaagacucuaguaguuauuggagcaugucccacacuaccaacaguagaaggauuagccaacccaaagagauuccuaucccaauugacaacauaccacgauuuuuguaaacuacuaccggacgauauccaaagagcagauagacaagcagauaucgaaaagauaauaaauuggaguacaaucuucgaagauacugcuaucuuuaaagaaaaauuacgagacauaaaaugguuauccgcagaucaaauaagacgauuaaguucgcguccaagauauagagguuggggacgcuucagugcaaaacucuuguguggacuucacgaccgacaagguaauaccguaauggacgaauuauggcagaccucacgaaacuuuaugcaaaucaucagacaauccgacuuucagacagcuauagcagcaguaaaucaacaagacuugggacgacaagaucuccagagaguaauugacgacuuauauaccucaccacaaaauaagaaagcuauaagacaaguccuagccguuguaacagauauccaaaaagcaaugcauggaaaggcaccaucuuggcuauuuguggaaguagccaaaggcgcacagaaaaacccucaaagaacgcaaagccgacaaucuaaacuagcagaagcauaccgagaauccgcucgagagcuaguagaugaagcaguaaaggaacaauuacuaacccuaccagaugaccgccaaacauuuagcgacaggcuaguucuauauuuccaacaaaacggaagagacaucuacaccggagaaccacucgauuucgaacgacucucaaauuaucacauagaccacauuaucccacaagcaguaguaaaggaugauaguuuagacaaccgaguacuuacaaguaaccaagcaaaccuugaaaaaggagcucauguucccacaauauuuagagacaaacaagagccaguguggcaagagcuuuaucgcgucggacucauuagccauagaaaacuucgaaaccuacuaaccacaccagaugacuuagacgauagagggagagcaacgggauucaucgccaggcagcuagucgaaacacgacaagucaucaaguuaguuauggaaguacucucucaauacuaugacacaacggaaacugaauuaauaucaauaaaagcaggacuuucccaucaauuucgacaagaauuaaaccuacccaaacugagagcacuaaaugauuaccaccaugcccaagacgccuaccuagcugcacgcauagguacuuacuuacuucaacgauauccaaauuuaaagcguuucuuuguauacggagauuucaagaaaacccacuuugaucuacaacgaagauuuaacuucauaggagguaugaucucucgcgaaaaacaaccguacaaccuuaucaaaaacccuguaacccaccaaguaauaugggacgaagaaauggagaucggcgauugccaaaagaaaaaucccgaacaaccaaaacacgaugcuacaguaaaaaugaugaaucuaaccaaaauaaugaauuuaaaacacauccucguaacccacgaggucuacgaaaaucauggggcucuuuuuaaucaaaccauauacccugcaagccaagcacacaaaaagaaauuaauaccacagaaaaccgaaaaaccuauagaacuguacggaggacauucaagcgaacaagcaggauauauggcgaucauaaggcuucuuggcaagagaccuggauacaaaguuaugagaguuccaguucgauauguuucacaacuacaacaccaagaugucgcagaacaaaagaaauuacuauacaagauauuugucucagaacuaacaucaagaaauaaaguaaagccuuuugaaguaguuguaccucacgucuguuuaaaccaacccguagaagacaugauaaaaggacaauggcaccgauucgcacuaaggacaaauggauauuaucaaaaccaacaacaacucauacuaagucucguggcucaacgaacacuggcagguuacaaacccaaagacgacgaacuaauggcaguauaucaugaaauuugcaaacaaguaaaauauuauuuuccccuauacaaaaugaauaaauuccaaucgagauuauucgcagcagaagaacuauugcagaaaagaucaaccgucaauucauuuaguauaacgauaggaaagaacggaaaagaaaacaaaacauugaauuuagguaaacgugaacugcuauuaagauuacuugggggcuuacacgcgaacgcaacucgaguagauuugaaagauauaggauguacaggccaauuuggccaacuacaaguaaagaauggcaucaaacuaacagaacaagcagucuuaauacaugagucgccaacagguuuauuccaccggcgaguaagauuaaaugaucuuuga

SEQ ID NO: 5505 - RNA, 4134 nt, Artificial Sequence
  Cas9 variant
augacaaagaaaaacuauuccauaggacucgacauaggaacgaauagcguaggaugggcaguaauuacagaugacuauaaagucccagccaagaaaaugaaaguguuaggcaacaccgauaagaaauacauuaagaaaaaccuauuaggagcacuacuuuuugacucaggcgaaacagcagaagccacacgauuaaaacgaacagcuagaagaagauacacaagacguaaaaauagacuaagauaucuacaagaaauauucgcagaagaaaugacuaaaguugacgagaguuucuuuuacagauuagaugaauccuuccuaacaacagaugaaaaagacuuugaaagacauccaauauucggaaauaaagcggaugagauuaaauaucaucaagaguucccuacuauauaccaucugcguaaacauuuagcugacucauccgaaaaagcagaccuaagauuaguauaccuagcacuagcgcacaugauaaaauuccgagggcacuuucuaauagaaggcgaacugaaugccgaaaacacagauguacagaaaauauucgcagauuucgucggaguauacgaucgaacuuuugaugauucacaccuaagcgaaaucacaguggaugcagcaucaaucuuaacagagaaaauaaguaaaagucgacgacuagaaaaucuaaucaaauauuacccuacagaaaagaaaaacacacucuucgguaauuuaauagcacuagcauuaggacuacaaccaaauuuuaaaaugaacuuuaaauuauccgaagacgccaaauuacaauuuucaaaagauucauacaacgaagaccuggaagaacucuuagggaaaauaggagacgacuaugcagaucucuucaccagugcgaaaaaucuuuacgaugccauauugcucagcggaaucuuaacaguggaugacaacucaacaaaagcaccacucagcgccucaaugauaaaacgauacgccgaacaucacgaagaucucgaaaaauugaaagaguucauaaaagcaaauaaaucugaacucuaccacgauauauuuaaagaugaaaccaaaaauggauaugcaggauacauugaaaacggaguaaaacaagaugaauuuuauaaauaucucaaaaauacccuaaguaaaaucgcuggguccgacuacuuucuagacaaaauugagagggaagacuuccuccgcaaacaaagaacauuugauaauggauccaucccacaccaaauacaccuccaagaaaugcacgcaauacugcgacgccaaggagauuauuauccauuccugaaagaaaaucaagaccgaauagagaaaauccucacguuuagaaucccauacuacguagggccauuagcacgaaaagacaguagguucuccugggcagaauaccacucagacgagaaaauaacuccguggaacuuugauaaaguaaucgacaaagaaaaaucugcagaaaaauucaucacaagaaugacacuuaacgaucuauaccuaccagaagaaaaaguucuaccaaaacacagucacgucuaugaaacguacgcagucuacaacgaauuaacgaaaauaaaauacguaaacgaacaaggaaaagauaguuucuucgauucaaacaugaaacaagaaauauuugaccacgucuuuaaagaaaauagaaaagucacuaaagaaaaacuauuaaauuaccuuaauaaagaguucccagaauauagaauaaaagauuuaaucggacuugacaaagaaaauaaaucuuuuaacgcaucauuaggaacauaccacgaccuaaagaaaauucuagacaaagcauuucuugaugauaaagucaaugaagaagucauagaagauauaauuaaaacuuugacccuauuugaagauaaagauaugauacacgaaagacuacaaaaauauuccgauauauuuacugcagaucaauuaaagaaauuagaacgaagacauuacacugguuggggcagacucagcuauaaacuaauaaacggaauaagaaauaaagaaaauaauaaaacaauacuagauuacuuaauugacgacggaagcgcuaauaggaauuucaugcaacuaaucaaugacgacacauugccauucaaacaaauaauacagaaaucucaaguugucggagacguagacgacauagaagcaguagugcaugaccuaccagguucacccgcaaucaagaaagggauacuucaaaguguaaaaauaguugacgaauuaguaaaagugaugggagacaaucccgacaacauaguuauugaaauggcucgcgaaaaccaaaccacaaaucgugggagaucccaaucacaacaaagacuuaagaaacuacaaaacucauuaaaagaacucggauccaacauucuaaaugaagaaaaaccgaguuacauagaagauaaagucgaaaauagccacuuacaaaacgaccagcucuuucuuuacuacauccaaaacggaaaagauauguauacaggcgaugaacuugacaucgaccaucuaagugauuaugacauagaccacauaaucccacaagccuuuauaaaagacgauucaauagauaacagaguacuaaccaguuccgccaaaaauagaggaaaaucugacgauguccccagucuagauauuguuagggcaagaaaagcagaaugggucaggcuauauaaaagcggauuaaucagcaaaagaaaauuugacaauuuaacuaaagcagaaagaggcggcuuaacagaagcugacaaagcaggauuuauaaaaagacaauuaguugaaaccagacaaauaacaaaacacgucgcccaaauccuugaugcaagguuuaacacugaauccgacgaaaacgauaaaguuauuagagacgucaaaguuauaacauuaaaaucaaaccuagucucccaguucagaaaagacuuugaguucuauaaagucagagaaauaaaugauuaccaucaugcacaugacgcguacuuaaaugcaguaguuggaacggcauuacuaaagaaauaccccaaauuagcaucugaguucgucuauggagaauacaaaaaguaugauguacauaaacuaauugcgaaaagcucugaugaccacucagaaaugggaaaagcuacggcaaaauacuucuuuuacaguaaucuaaugaacuuuuucaaacgaguaauccgauacuccaacggaaaagugaucguaaggccagucguagaauauucaaaagacaccgaggacauagcgugggacaagaaaaguaacuuuaggacaauauguaaaguacucuccuauccucaagucaauauugucaagaaaguugaaacacaaacaggaggcuucagcaaagaaaguauccuaccaaagggggacucagacaaacuaauaccaagaaaaaccaagaaagcauacugggauacaaagaaauauggcggcuuugauucacccacgguugcuuacagcgucuucguagucgccgacguugaaaaagguaaagcaaagaaauuaaaaacggucaaagaacuuguaggcauaucuauuauggagcgaucauuuuucgaagagaacccaguagaguucuuagaaaacaaaggauaucacaacaucagagaagauaaacuaauuaaacucccaaaauauagccuguuugaauuugagggaggaaaaagaagauuauuagcguccgccucggaauuacagaaaggcaaugaaaugguaauaccaggacauuuaguaaaacuucuauaucacgcacaacgaauaaauucuuucaauaguacgaaauauuuagauuacguaucagcacauaagaaagaguucgaaaaaguuuuaaguuguguggaagauuuugcaaaucuauacguagauguagagaaaaacuugaguaaaauacgcgcugucgcagacucgauggauaauuucagcauagaagagauaaguaauucguuuauaaauuuacucacacuaaccgcauuaggagccccagcagauuuuaauuuccuuggugagaaaauuccacgaaaaagauacacauccacaaaagaaugucuuaaugcuacauugauacaccaaucgaucaccggacuauacgaaacuagaaucgaucuaucaaaaauaggugaagaauga

SEQ ID NO: 5506 - RNA, 4134 nt, Artificial Sequence
  Cas9 variant
augaaaaaacccuacucgaucgggcuagacauaggaacaaauucagucggaugggcggucauaaccgaugauuacaaaguaccauccaaaaagaugaaaguccuagguaacacagacaagcacuuuauaaaaaaaaaucugauaggugcacuauuguucgaugaaggaaccacagcggaagacagaagauuaaaaaggacaucucgacgccgauacacgagaagaaaaaacagauuaagauaucuccaagaaauuuucucugaagaaauaucaaaacuagacagcucauucuuccaccgucuugacgauagcuuucucgucccagaagauaaaagggguagcaaauacccaauauucgcaacacuugaagaagaaaaagaauaccacaaaaaguucccaacaaucuaccaucuacgaaaacaccuagcagauucaaaagagaaaaccgaccucagacuaaucuaccucgcucuugcacauaugauaaaauacaggggacauuucuuauaugaagaaucguucgauauaaaaaauaacgacauucaaaaaauauucaacgaauuuauaucaauuuacgauaacacauucgaaggcucaagucucuccggacaaaaugcucaagucgaggcgaucuuuacagacaaaauaucuaaaucaacuaaacgcgaacgcguauuaaaacuuuucagcgaugaaaaaagcacuggccuauucuccgaauuucucaaacuaauaguagguaaucaagcagauuucaaaaaacauuuugaccuagaagaaaaagcacccuuacaauucucuaaagauacuuacgacgaagacuuagaaaaccuccuaggacagaucggugacgguuuugcagaucuauuccucguggcuaagaaacuauacgacgcaauccuauuaaguggcauuuuaaccguaacagacccauccacaaaagcuccucuaucagcaaguaugauagaacgauacgaaaaccaccaagaagaucuugcugcucuaaaacaauucaucaaaaauaauuuaucagaaaaauaugcggaaguuuucagcgaucaaaguaaagaugguuacgcuggcuuuauugacgguaaaacgacacaagaagcguuuuacaaauauauaaaaaaccuacuauccaagcuagaaggagccgauuacuuucucaauaaaauugaacgagaagauuuucuaagaaaacaacgaacauuugauaacggauccaucccacaccaaauacacuuacaagaaaugaaugcaauucucagacgacaaggcgaacacuacuuauuccuaaaagaaaaucgagaaaaaauugaaaaaauucuugcauuuagaauacccuauuauguaggaccuuuagcaagagguaauagagauuucgccuggcuuacaagaaacucagaccaggcuauaagaccuuggaacuucgaagagguaguagauaaggcaucaucagcagaagacuucauaaauaaaaugacuaacuacgaccucuaucuuccggaagagaaagugcugccaaaacauucuuuauuauacgaaaccuucgcuguauauaacgaacuaacaaagguuaaauuuaucgccgaaggucuacgagacuaucaauuucuugacuccggucaaaaaaaacaaauagucaaccagcuauucaaagacaaacguaaaguaacagaaaaggacaucauacauuaucugcauaacguggacggguacgacgguauugaacuuaaagguauagaaaaacaauucaacgcaucucuaagcacuuaucaugauuuauuaaaaauuauaaaagacaaagaauucauggacaauccaaagaacggagaaauacuugaaaacaucauccacacgcuaacaauuuuugaggaucgugaaaugauaaaacagaggcuagcacaauaugauacccuauucgaugaaaaaguaauaaaagcccuaacaagaagacauuauacaggguggggaaaacuaagugcaaaauuaaucaauggaauuagagacaaacagacuggaaaaacuauacucgaauauuuaaucgaugauggugauuguaaccgaaauuuuaugcaacugauaaaugaugacggccuaucauuuaaagaaauuauacaaaaagcacaagucguagguaagaccgaugacgucaaacaaguagugcaagaaauaccugguucacccgccauuaaaaaagggauccuacagagcauaaaaaucguagaugagcuaguuaaagugaugggucacaauccagagucaaucgucauugagauggcuagagaaaaucaaacgacagcaaaaggaaaaaaaaacucacaacaacguuauaaacguauagaagacgcucuaaaaaaccuugcaccagggcucgacuccaauauacuaaaagagaauccaacagacaacauacaacuacaaaacgaccgucucuuccucuacuaccuccaaaacggcaaagacauguacacagguaaagcuauugauaucaaccaacuuucgaacuaugacauagaccacauuauaccacaagcuuuuauaaaagacgauucgcuagacaacaggguauuaacauccucaaaagauaaucguggaaaaucagacaacgucccaucaauagaagugguacaaaaacgcaaagccuucuggcaacaacuuuuagauuccaaauuaauaucagaaagaaaauucaacaacuuaacaaaagcaaagagggggggacuagaugagagagacaaaguaggcuuuauaaaacgacaguuaguagagacgagacaaauaaccaaacauguugcccaauuacucgauacaagauuuaacacagaagucaacgaagaaaaccaaaaaauaaggaccguaaaaauaaucacacuaaaaucuaacuuaguuucuaacuucagaaaagaauucggauuauacaaaguuagagaaaucaaugacuaucaccacgcucacgacgccuacuuaaacgcagucguagcaaaagcaauacuuaaaaaauauccaaagcucgaaccagaauucguauacggcgacuaccaaaaauacgaucuaaaacgauauauauuaaaauccaaagcaucaaacacaaucgauaaggcaaccgaaaaauacuucuucuacuccaaucuacuuaacuuuuucaaagaaaaaguuagauacgcugacggaacgauaaagaaaagagaaaacauagaauauagcaaugauacaggagaaauugccuggaacaaagagaaagacuucgccacaauaaaaaagguacucaguuuaccccaaguaaauaucgucaaaaaaacagaagagcaaacaguaggacaaaacggcggcuuauuugacaauaacauugucaguaagaaaaaaguaguugaugcgucuaaacuaauacccaucaaauccucauuaagcccagaaaaauauggcggcuaugcaagaccuacuaucgcguacucaguauuagucaucgcagacaucgaaaaggggaagggaaaagcaaaaaaauuaaaaagaaucaaggagauaguaggaauaacaauucaggacaaaaaaaaauuugaaucaaaucccguuacauaccucgaggaaugcgguuauaagaauauuaacucaaaucuaauaauuaaacuacccaaauacucauuauuugaauuuaacgacggacagagacgacuacuagccucuucaauugaauuacagaaaggaaaugaacuuauuuugccauaccaccucacagcuuuacucuaucacgcacaaagaauuaauaaaaucucugaaccaauacacaaacaauacgucgaggcacaccaaaacgaguucaaagaacuacugaccacaaucaucagccuaucgaaaaaauacauucagaaacccaauguugaacuucucuuacaacaagcauucgaccaggcagacaaagauauauaccaauuauccgaauccuucauuucacuuuuaaaauuaacaucauuuggugcaccaggagcauucaaauuuuuaggaguagaaauuagucaauccucuguccgcuacaaaccaaacucgcaauuuuuagauaccacacuuauacaccaaucgauuacaggacucuaugaaacgagaaucgaccuaaguaaacucggagaagacuga

SEQ ID NO: 5507 - RNA, 4134 nt, Artificial Sequence
  Cas9 variant
augaauaacaaacccuacuccauaggacucgauauuggaacaaacaguguggguuggagcgucaucacagaugacuacaaaguaccaucuaaaaaaaugaaaguacuugggaacacugacaaaagauucauaaaaaaaaaucucauaggagcccugcuauuugaugaagguacaacggcagaggcaaggagacuaaaacgcacagcacgaagacgcuacacccgcagaaaaaacagacugcgauacuuacaagaaauuuuugcagaggaaaugucaaaaguagacagcuccuuuuuucaucguuuagaugauaguuuucuaauuccggaagauaaaaggggcucgaaauauccuauauucgccacguugguugaagaaaaagaauaccacaaacaauuucccacgauauaccacuuaagaaaacagcuugcagacucaaaagaaaaagcagaucugcgauuaaucuaccuaguauuagcucacaugauuaaauaucgaggacacuuccuauacgaagaagcauuugauauaaaaaauaaugauauccaaaaaaucuucaaugaauucaucucaauauacgacaacacguuugaagguaguucucugagcggacaaaaugcacaaguagaaaccauauuuacggauaaaauauccaaaucagcgaaaagggaacgcgugcuaaaacucuuuccagaugaaaaaucaaccggauuauuuucggaauucuuaaaacuaauuguaggcaaccaagcugauuuuaaaaaacauuucgauuuagaagaaaaagcuccacuacaauuuucaaaagauacauacgaugaagauuuagaaaauuuacucgaacaaauaggugaugacuuugccgacuuauucguagccgccaaaaaacuauaugacgcaauucuauugucaggcauccucacagucacagacccgucuaccaaagcaccauuaucagccucaaugauagaacgcuacgaaaaucaucaaaaagauuuagcuguacuaaaacaguucaucaaaacuaaccuacccgaaaaauaugucgaaguauucucagaccaaucaaaagauggguacgcaggauacaucgacggaaaaacuacacaagaagcguucuacaaauacauaaaaaaccucuuaagcaaauucgacggagcagacuacuuuuuagacaaaaucgaaagagaaguauuucuccguaaacagcguacuuucgauaauggaaguauuccacaccaaauccauuuacaagaaaugaauacuauucuaagacgccaaggagaacauuacccuuuuuuaaaagaaaauaaagaaaaaauugaaaaaauccuuacauuccggaucccauaccauguaggaccacuagcucgugguaaucgagacuucgcaugguuaacaagaaacuccgaucaagcuauuagaccguggaacuuugaagaaauagucgacaaagccaguagugcagaagacuuuaucaacaaaaugacaaauuaugaccuauaucugccggaagaaaaaguacuuccaaaacauagccuacucuacgaaaccuuugcaguauacaacgaguuaacaaaaguuaaguuuauagccgaaggaaugcgggauuaccaauuucuggacucaggccaaaaaaaaaaaauaauaaaucaauuauuuaagaaaaaacgcaaaguaacugaagaugauauaauagacugcuuacaaaaaauugauaauuaugacggaaucgaauuaaaaggaaucgaaaaacaauuuaacgcuucacuuucuaccuaucacgacauccugaaaauaauacgagauaaggaauuuauggaugacccaaaaaacggugacauacuagaaaauguuauccauacacucacaaucuuugaagaccgagaaaugauuaaacaacgauuagcacaauauaacagcauauuugacgaaaaaguaauuaaagcauuaucacgcaaacauuacacaggauggggaaaacuuucagccaaauuaauugauggcauuagagauaaacagacagguaaaacuauccucgauuacuugauggaugaugguaagucaaacagaaacuucaugcaacuaauaaaagaugaugaauuauccuucacagaaauaauccagaaagcucaagucgucggggacacagauaaccucagacaagucguacaaaaccuuccuggcaguccagccauaaaaaaaggaauccuacaaucgauaaaaauagucgaugaacucguuaaagucaugggacacgcaccugaaagcauaguuauugaaauggcaagagaaaaccaaacaacggccaggggcaaaaagaauucucaacaaagauacaaaagaauagaagauucccuuaaaaacuuggcaaguggauuagacucgaacauucuuaaagaaaacccuacggacaauauucagcuucaaaacgaccguuuauuccuauacuaccuucaaaacggaaaagacauguacacaggagaagccuuaaauauaaaccaacuaagcagcuaugauauagaccauaucauaccacaagccuucauaaaggacgauucacuagacaacaggguccuaaccaguucaaaagauaacagaggaaaaucagacaacguaccauccuuagaaguaguagaaaaaaugaaagcauuuuggcaacaauuacuggauagcaaauuaaucucugaaagaaaguauaauaacuugaccaaagcagaaagagaaagaggaggacuaaacgaauuagauaaaguaggauucauaaaacgacaauuaguagaaacacgacaaauaacaaaacacgucgcacaaaucuuagaugcacgcuucaauaaagagguaaccgaaaaaaacaaaaaaaaccguaacgucaaaauuauaacauuaaaaagcaacaugguaucuaacuuccggaaagaauucggacuauacaaaguaagggaaaucaaugauuaucaccacgcgcacgaugcguacuuaaacgcgguuguugcaaaagcaauucuaaaaaaauacccaaaacuagagccagaauuuguguauggggauuaucaaaaauacgaucuaaaacgguauauaaguagaaguaaagauccaaaagaaguagagaaagcuacagaaaaauauuuuuucuauucaaacuuauuaaauuucuucaaagaagaagugcauuaugcagaugguacaauaguaaaacgagaaaacauagaauacagcaaagauacuggugaaaucgcauggaacaaagagaaagauuuugcaaccauaaagaaaguucuaucgcucccccaagucaacaucgugaaaaaaacagaagaacaaacaguaggacaaaacggaggucuauuugacaacaauaucguaaguaagaaaaaaguuguagacgccucaaaacuaauaccuauaaaaagcggauuaucucccgaaaaauacggcggauaugcuagaccaacaauagcauacagcguacuaguaacauacaaacaaaauaauaaaauaaaaaauaccaugguaggcauaccaguguuaacaaaauuagaauuugaacgagauccuaauuuguauuugagaaauuugggaauuaacaacgucagccacguuauaaaacuagucaaauacacaguacucgaauucaaacacaaauauggaacauacagacgauucauaguaucaaaucaagaacucaaacgagcaaaucaaauauuuguaaccacuaagcaaaugaaacuuauaucucaauacaccacauuagauaaaaaugaacaugacucauuacugaagaauaaccaacaacuaauacaaagcauuuggaaccaauuccucgaauucauguuagcuacagaucuuguuaauaaaaaacaguacgacgaauugauacuaacaaacaaucaaacaauagaagaaugccguaacauuaugaacagagugaucacuacacuaagcuucacaaauauaaacgccggacaaaagaagauaaucuuugaugacacacucucccuaccgauaaaacgauggcaauucacugacuccgacaaaauggucaagaaaauaauagaaucaacuuuaauacaccaauccaucacgggccuuuacgaaacccggauagaccuaagcaaacugggagaagauuga

SEQ ID NO: 5508 - RNA, 4134 nt, Artificial Sequence
  Cas9 variant
auggaaaguaaccacgauggagaacaaguaaaauauacauuaggucuagacauagggacaagcucuaucggcuacgcggcgaucgacaaacaucaaaaaccaauaagagcaaaaggaaaacauguaauagguguccgauuauuccaagaaggacaaaccgcagcugacagacgagcuuuucgaacaaccagaagaagacuaaaaagaagaaaauggagacucaacuugcuuaaucgacuuuucgauccauaucuaucagaaguggauccaaacuuuuugccccgacuaaggcaaaguaaucuaaguccaaaagacgacaauaaacauuucaaugggucaacacuuuuuccugauaaaaccgaugcugcauucuauagacaauaucccacaauguaccaccuaagauacgcauuaaugaccgagaaaagaaaauuugacauaagagaaguauacuuagcaauucaccauauuguaaaauacagagguaauuuucucaauagcgcgacuguagacuccuucaaaacaaguaacauagacuucacuucccaauuugacagauuaaacgaacuauauagacaagugauacuugacgaaccuuuccaaauaaacauggaucaaguagacgaaaugacaaauaaauugcucgacaaugacgcccucaaacuugauacccaaaaacaaguagcgaaauuacucccgguaauauacaaugacaaaccaauagauaaacaauauacuagaauugcuacagaguucaguaaagccaucuuaggguauaaaacaaaauuagauguaauucuuaaccucgacacacaaaaugccaaagacuggguaauucgacuagaugacgaagacauagacgacaaauuaccagccuuaguagaaaaccuugacgaaucacgccaggaaauaguaacaauaauacgcgaucuauaugcccaaaucacuuuaaaugcuauaguuccaaaaggaaaaagucucucagaaagcaugguugauaaauacaacgaucauaaagaccaccuggaccuauuaaugggccuaauccacgaacuaggggacgacucggcaaaaggaauaaaacuacgagaagcauauacacaauauguagguaaaucagacgacaaaacacugaaucaagaugauuuuuaugcagcuauuaaaaagaaucuagaugaagacucaaagcgaucuccaaaaauacaacgacucauagaacaagcauccuuuaugccaaaacaaagaaccucugcaaacggaguaauaccacaccaacuccaccaacuagaacucgaucguauaauagaaaaccaaggacgguauuaccccuuucucaagaaaccaaaucccaauacucauaaaccaaacggaggaaaauacaaacuagaugaacucguggcauuucgaauacccuauuacgucgguccacuaauuacaaaacgugaccaagagaaaacauccggagcagacuuugcauggaugauaaggaaaccaggucaagaaggagaaauaacuccguggaauuucgaccaaaagguugaccgaauggccucugcaaaucguuucaucagaagaaugacaacaaaagauucauaucuggucgcagaagacguacucccagacgccuccuuaauauacgaaaaauuuaaagcacuuaaugaauuaaacaugcucaaaguaaacgauucucgauugaguccaucccaaaaacaagaucucuuuaacaaucuauuuaagaaacagaaaaccauaagaacaaagaaauuacaaacauauauaagaacuaauugggaauugccaagugucaugauaucaggacuagccgacccagacaaauuuaauuccagucuaucaacguacauagacuuccgugacauauuuggagaaaaagucgacgauccaaaucgacaagcagacuacgaagaaaucauugaaugguccacuguuuuugaagacagaaaaauauaccaagcaaaacuuaaccaacuagacuggcuaacagaaccucaaagaaaagccuuacuaacaaaaagauacacaggcugggggcgauuaucaaagaaauuacuuacaggucucaaagaucaaaauggugacagcaucuuagaucaauuauggaaaacaaaugauaacuuuaugcaaauccaaucgcgagacgaguucgcaaaacaaauacaugaugaaaacgcaaaacaauuccacgaagccaacaauguagaugauauacuagaugaugccuuuacaucuccacaaaacaagaaagcaaucaggcaagucgacaaagugguacaagacguaguaaaagccguuggauacgccccagacaaaaucgcuauagaguucacaagaucauuggaaaauaauccacaaagaacuguaucgagacaacgacaacuacaagccgcauacaaaaacauaccucgugaaaucaugaaaucagguuuaauggcugaacuaggauccguagcagauucaaagaaaguacuauccgacaaacuauaucuauauuuuacucaaaugggcaaagacauguaugaagauaaaaccauaaacaucgacaaccugccgaauuaugauaucgaccacauacuaccacaagcauuuauaaaagacgauagcauagauaauagaguucuuaucuccaaagaagaaaaugcgagaaaaucaaaccgaguaccauuaaaauucuuuggugcaaaaagaaugggauuuuggaaagauuuacuaaacaauggacucauuucgaaccgcaaauuccaaaaccuaacaaccgacccagagaaaauaucaaaauauagcgcgaaaggauuuauucacagacaauuagucgaaacuucccaaguaauaagauugguggcaaacauacuaggaaaugaauacucacaagccggcacaacaauaauagaaguaagcgcaaaaaugaaccgacaacuaagagaagacuuucauuuaaucaaaaauagaaauguuaaugacuaccaucaugcaauggaugcuuacuuaacagcuuacgucggugauuauuuauaucuaagauauccaaaacuaagaccauacuucguauacggugauuucaagaaagcagaagaccaagaccuuaauauaagaaauuuuaacuucuuacaugaccuuaaagauaaugaaagucucgauaaaauaguugauucugaaacuggugaaauaguuugggaaaaacacggcucaguuaaacaacucaagaaagucuaucacuauaaauucaugcugguuagucaagaaguauauacaagacaagaugcuuuauuuaaucagacaaucuaucccgcaagugaugcagauaaaagaaaauuaaucccuauuaaaaacucaaaaccgguggacguguacggaggguacuccggaaauaucgaugcuuauauggccauuguacguguccacggaaagaaagaagauaacuacaaaguggucggaaucccuaugagagcuguaacgaaacuaaagaaagcagaaaaagaaggucaugauaguuaucugaaugccguacaugaaguacuaaaaccacaauuuaccaaaaagaagaaaaaccguaaaacaggcgaaauuacagaaacaguagaugaguucgauguacuauuagggaaagucuauuacagacaacucaucguagauggaaauaagaaauuuaugcuugguucaucaucuuaucaauauaacgcaaaacagcuaguccuuagugauaaagcgaugcaaguacuaagcaaaaacggcaaaguuaaaucacaagacgaaaaccaaaauuuaauagacguauaugacgaaauauuagaaaaaguagaccaauacuuugaacuauaugaucaacgccacuaucgagaaucacuacacaaaggaaggggaaucuuuguaaauuugccacuaucaaaccaauaugauggaagcaaacuuacaucauaugguaaauacgaaacgauugacgcuauccuaaacggacuacacgcaaaugcaacaaugagcaacuuaagauacuuagggauaucaucuccauuuggaaaaaugcaagccucuaacggauuaacaaucgacccagauaguauaauuuguuaucaauccccuacaggacuguucgaacgacaaauuaaauugucggaccucuga

SEQ ID NO: 5509 - RNA, 4134 nt, Artificial Sequence
  Cas9 variant
augaauaaaccauacucaauaggacuugauaucgguaccaauucagugggaugguccaucauaacagacgauuacaaaguacccgccaaaaaaaugagaguauuaggaaauacagacaaagaguacaucaaaaaaaauuuaaucggugcacuacuauucgacggagggaacacagccgccgaccgaagauuaaaaagaacagcaagacgacgguacacgagacgaagaaaccguauacuauaccuccaagaaauuuucgccgaagaaaugucaaagguagacgauuccuucuuccaucgacuagaagacagcuuuuuagucgaagaagauaaacggggaucaaaauauccaaucuucgcaacaaugcaagaagagaaauacuaccaugaaaaauucccaacaaucuaccaccugcgaaaagaacuagcagacaaaaaagaaaaagcagacuuaagauuaguauaccuugcacuagcccacaucaucaaauucagaggucacuuccuuauagaagacgaccgauuugacgugagaaauacagacauacaaaaacaauaccaggcuuuuuuagaaauauucgauacaaccuucgaaaauaaucaccuauuaucacagaaugucgacguagaagcuauacucacugauaaaauaucgaaaagcgcaaaaaaagauagaauucuagcacaguaucccaaccaaaaaucaacaggaauauuugcagaauucuuaaaacucauaguaggaaaucaagcagauuucaaaaaacacuucaaccuagaagauaaaacaccacuacaauuugcuaaagacuccuacgacgaagacuuagagaaucugcuaggacaaaucggcgaugaauucgcugacuuauucucaguggcaaaaaaacuauacgauaguguacuucugagugguauauuaacagucacugaucuaucuacaaaagcacccuuaagcgccuccaugauacaaagauaugacgagcaccacgaagaucuaaaacacuugaaacaauucguaaaagccagccucccagaaaacuacagagaaguauuugcagacaguaguaaagauggauaugcugguuacauagaaggaaaaacuaaccaagaagcauuuuauaaauaccucuugaaauuauuaacaaagcaagagggcucugaguacuuccuagaaaaaauaaaaaacgaagacuuccugcgaaagcaaagaaccuuugacaacggaucuauuccacaccagguacaccucaccgaauugcgcgcaaucauaagaagacaaagcgaauauuacccuuuccugaaagaaaaccaagaucggauugaaaaaauauugacauuccgcauaccauacuacguaggaccacuugcccgcgaaaaaagcgacuucgcauggaugacacguaaaacugacgacucaauaagaccauggaauuucgaggaccucguagauaaagaaaaaagugccgaagcuuucauucacagaaugacaaacaaugaucucuaucuaccagaagaaaaaguacugccaaaacacucauuaauuuacgaaaaauucacaguuuacaacgaacuaacuaaagucagauuuuuagcagaaggauuuaaagauuuccaauucuuaaaccgcaaacaaaaagaaacaauuuuuaacucgcuauucaaggaaaagagaaaaguuacugaaaaagauauaaucucauuccucaacaaaguagaugguuacgaaggaauagcaauaaaagggauugagaagcaauuuaacgcgucccucucuacguaucaugauuugaaaaaaauacuagguaaagacuuuuuagacaacaccgauaaugaauuaauacuagaggauauaguacaaacacucacuuuauuugaagacagagaaaugaucaaaaagugccuugacauuuacaaagauuucuucacagaaagccaacuaaaaaagcucuauagaagacauuacacaggauggggccgucugagugcuaaauuaauaaaugguauuagaaacaaagaaaaucagaagacgauccuagauuacuuaauagacgaugguagcgccaauagaaauuucaugcaacuaauaaaugacgacgaccuaaguuucaaaccaauaauugacaaagcaagaacaggaucacauucagauaauuuaaaagaagucgucggugaacuagcaggaucaccagcaauaaaaaaaggaauacuacaaucccuuaagauugucgacgaauuaguaaaggugaugggauacgaaccugaacaaauaguaguagaaauggccagggaaaaccaaacuacagcaaaaggccuaucuaggucccgacaacgauugacaacacuuagagaaucuuuagcaaaucuaaagucuaacaucuuagaagaaaaaaaaccaaaauacguaaaagaucaaguugaaaaucaucacuuaucagaugaucgacucuuccuuuacuaccuucaaaauggucgagacauguacacaaaaaaagcacucgacaucgauaaucuaucacaauacgacauagaccacauaauaccacaagcauucauaaaagaugauucaauagacaaccguguacuagucagcucagcaaaaaauagagggaaaucagaugacguaccgucuauagagauaguuaaagcacgcaaaauguucuggaaaaacuuauuagacgcaaaauuaaugucccaacgcaaauacgacaacuuaacaaaagcagaaaggggaggccucacaucagaugacaaggcacgcuuuauacagagacaacuuguagagacgagacaaauaaccaaacauguagcaaggauacuagacgaaagauuuaacaaugaaguagauaacgguaaaaaaauauguaaaguaaaaauaguaacacuaaaauccaauuugguaaguaauuucagaaaagaauuugguuuuuauaaaauuagagagguaaacgacuaucaucaugcacaugaugcauaucuaaacgcaguaguugcaaaagccauacuaaccaaauacccacaacuagaaccagaguuuguguauggaauguaccgacaaaaaaaacuaucaaaaauaguacaugaagacaaagaagagaaauauucagaggcgacaagaaaaauguucuucuauuccaaccugaugaauauguuuaaaagagugguccgauuagcagauggaucaauaguuguacggccaguuauagaaacaggacgauacaugcgaaaaacugccugggacaaaaaaaaacauuucgcgacagucagaaaaguacuauccuauccacaaaacaacauaguaaagaaaacagaaauccaaacaggaggcuuuucaaaagaauccauacuagcacacggaaauucagacaaacucaucccucgaaaaacaaaagacauauaccuagacccuaaaaaguauggaggauucgauucgccaauagucgcauacaguguacucguuguugcagacauaaaaaaaggaaaggcacaaaaauuaaaaacagucacggagcuccuagggauuacaauaauggaaagaaguagauucgaaaaaaacccaucagccuuucuagagaguaagggcuaucucaacauaagggaugauaaauuaaugauauuaccgaaauacaguuuauuugagcucgaaaacgggcgacgaagguuacuagcaagcgcaggagaacugcaaaaagguaaugaacuagcacuaccuacacaguucaugaaauucuuauaucuagccagccgauacaacgaaaguaaaggaaaacccgaagaaaucgaaaaaaaacaagaauuugugaaccaacacguauccuauuucgacgauauacuacaacuaaucaacgauuuuucaaaacgaguaauucuagccgacgcaaacuuagagaaaaucaauaaauuauaccaggacaacaaagagaacauuccuguagacgaauuggccaacaacaucauaaauuuauucacguuuacuucauuaggagcgccggcugcauucaaauuuuucgacaagauaguugauagaaaacgauauacuucaacaaaggaaguauuaaacucuaccuuaauccaucagaguauaacaggauuguaugaaacccguauugacuuaggcaaauuaggggaggauuga

SEQ ID NO: 5510 - RNA, 4134 nt, Artificial Sequence
  Cas9 variant
auggaaaagacauacucaauaggacuagauauaggcaccaauucaguagggugggcagucauaacagacgauuauaaagugccagccaagaaaaugaaaguucuaggaaauacagacaagaaauacaucaagaaaaauuuacucggagcacuauuauuugauucaggcgaaaccgcagaagcaacuagauuaaaaagagcagcucgacgaagauacaccagacggaaaaacagacucagauaucugcaagaaauauuugcaaaagaaauggcaaaaguagacgaaucuuucuuccaaagauuagaagaaucuuucuuaacagaugaugauaaaacauuugacucccaucccauauucggcaacaaagcagaagaagauacguaccaccaagaguucccuaccauauaccaccuacgaaaacacuuagcggauucacccgaaaaagucgaccuuagguuaguauauuuagcacuugcccauaugauaaaauucagaggacauuuccuaauagaaggacaacucaacgcagaaaauaccgacguucagaaaauuuucgcagacuucgucggaguauacgaccgaacuuucgacgauucacacuuauccgaaauaacaguugaugccgccagcauucuuacagaaaagauuuccaaaagcaggagguuagaaaauuuaauuaaacaauacccaaccgaaaagaaaaacacacuuuucggcaaucuuguagcauuagcauuaggcuuacaaccaaauuucaaaacaaacuucaaacuaucagaagaugcaaaauuacaauuuucuaaagacacauacgaugaagaccuggaagaauuauugggcaaaauaggagaugauuaugcagauuuauuuacagcagccaaaaaucuauacgaugcuauccuacucagugggauccuaaccguugaugauaacuccacuaaagcaccucugagugcaucaaugauaaaacguuacgaagaacaucacgaagaucuagaaaaacucaaaacauucauuaaagucaauaacuuugacaaauaccacgaaauauucaaagacaaaagcaaaaauggcuacgcaggguacauagaaaacggaguaaaacaagacauauuuuacaaacaucuaaaaagcaucaucucagagaaaaauggaggacaauacuuuuuggacaaaauagaaagagaagauuucuuacgaaaacaacgaaccuuugauaacggcuccauucccuaucagauacacuuacaagagaugcguacuauacuaagacgccaaggagaauauuauccuuucuuaaaagaaaaccaagcgaaaauagagaaaauacuuacuuuccgcauuccauacuacguaggaccacuagcaaggaaaaauucaagguucgcuugggccaaauaucacagcgacgaaccaauaacacccuggaauuucgaugaaguaguagauaaagaaaaaucagccgaaaaguuuauaacaagaaugacguuaaaugauuuauaucuaccagaagaaaaaguauugccaaaacacucuuacgucuacgaaacauucgcaguauacaaugagcuaacaaagaucaaauaugucaacgaacaaggaaaaucauucuucuuugacgccaacaugaaacaagagauauuugaucauguauuuaaggaaaacagaaaaguuacuaaagcaaaauuacuaucauacuuaaacaaugaguuugaagaauuucgcauuaacgaccucaucggacuagauaaggacaguaaaaguuucaacgcaagccuaggaacauaucacgacuugaagaaaauuuuagauaaaucauuucuagaugacaaaacaaacgaacaaauuauugaagacauaguauugacacucacacuauucgaagauagggacaugauacaugagcguuuacaaaaguacucagauauauucacaucucagcaacuaaagaaauuagaacgacgacacuauacuggaugggggcgacuuuccuacaaacugauaaauggaauaagaaacaaagaaaauaauaaaacuauauuagauuuccuaauagacgauggcgaugcaaacagaaauuucaugcaacuuauaaacgacgauucguuauccuuuaagacaacaauacaagaagcucaggucguaggagacgucgaugacauugaagcaguaguacaugauuuaccaggcucaccagcaaucaagaaaggaauauuacaaagcgucaagauaguagaugaguuagucaaaguuaugggacacaacccacaaaauauaguaauagaaauggcaagagagaaccagauaaccggauauggacgaaaucggucaaaucagagguuaaagcgauuacaagacucccugaaagaauuugguagugauauucucagcaagaagaaaccuagcuauguagauagcaaaguugaaaacucacaccuacaaaaugauagacuguucuuauauuacauccaaaauggaaaagacauguacaccggugaagaacuggacaucgaucacuuaucggacuaugacauagaccauauuauaccacaagccuucaucaaagacaauucuauagauaauagaguucuaacguccucagccaaaaauagagguaaaagugaugauguacccuccaucgaaauaguaaggaaucgcaaaucuuacugguauaaacuauacaaauccggacuaauaucaaaacggaaauucgauaauuuaacgaaagcugaaagaggaggauuaacugagacugauaaagccggauucauaaaacgucaacucguagaaacaagacaaaucacaaaacauguugcgcaaauacuagaugcuagauucaacacaaaaugcgaugaaaacgauaaagucauccgagauguaaaagucauaacauuaaaaucaagccuaguaucucaauuccgaaaagaguucaaguucuauaaaguacgagaaauuaacgauuaccaccaugcccacgacgccuaccucaacgcaguagucggaacagcccugcugaagaaauaccccaaguuagcuccugaauuuguguacggagaauauaagaaauaugacgucagaaaacuugucgcaaaauccagcgauaaccauuccgaauuaggaaaagcaacagcaaaauacuucuuuuauucgaaccuaaugaacuucuucaaaaccgaaguaaaguaugcagaugguaggguauucgaaagaccggacauagaaaccaacgcagacggcgaagucguauggaauaaacaaagggauuuuaauauaguacggaaaguacucucuuacccacaaguaaauauaguaaagaagguagaaguccaaacuggcggcuucagcaaagaauccauccucccgaaaggagauucagauaaauuaauaccccgaaaaacaaagaaacuucaaugggaaacacagaaauauggaggauuugacucaccuacaguagccuacagcguacuuguaguagcagacguagaaaaaggaaaaacaagaaaauuaaaaacaguaaaagagcuaguaggaaucucaauuauggaaagaagcucuuucgaagagaacccagucuccuuccuagaaaagaaaggcuaucacaauguccaagaagacaaacuaauaaaacuuccaaaauauucgcuguucgaguucgaagguggucgucgacgcuuacuugccucugcaacagaauugcaaaaagggaaugaaguaguauuaccccaauacaugguuaaccuuuuauaccauucgcaacauguaaauaauucacauaaaccagaacaucuaaacuacguaaaacagcacaaagacgaauuuaaagauaucuucaaccuaaucauaucuauagcgagaaucaauauauugaaaccuaaagugguagauaaucugauaaaugaguucacagaauacggacaagaagacauuucauccuuaucagaaucauuuaucaaucuucugaaauucauuucauuuggagcuccaggcgccuucaaauuucuaaaauuagauguaaaacaaagcaaucugagauacaaaucaacaacagaagcacuaucugcaacauuaauacaccaaagcgucacaggacucuacgaaacccgaaucgacuuaucaaagcuaggggaagaguga

SEQ ID NO: 5511 - RNA, 4137 nt, Artificial Sequence
  Cas9 variant
augaaaacuuuugcagaagaauacguaauggauaaaucgaaaccuuacggaauuggccucgauauaggaaccaauucugugggauuuguagcaacggaugcugaaggacaccuaauaagauuaaaagguaaaacaguaauuggcgcauaccucuuuaacgcaggaauuucagcagcagaacgacgaggauuuagaacgacaagaagaagauuaaguagaguaaaauggagacuaggacuucuacgcgaaauauuugagacacacuuccaagaaucaaugggagaaaacgaggacaacgacuuuuucuuacgauuuaaguauucaaacaucucgccaaaagauccucaauucagcacugcuaaaggucuauuuaaugaccgaacagauaaagaguucuacgaccaauacccaacaaucuaccauuuaagacgagcacuaaugacagaagaccaucaauucgauauaagagaaaucuauaucgcaaugcaccacaucguaaaauacaggggacauuuccuuaaagaagguagggcaaaagacuuuaaagugggagaucuaagacuauuagauaacuucaaaaugaugaaugaacaaaucgaagaaauuaacccacuauggcagcuuaaacuucccacggacgacgcaaguauaaaaucaauaacagcaauauugcucgauaacacgcaaagccaaaaugauaggcaaaaagcuguaacgaaaguaauauuggcaacuuugguaaaagcaagcgacaaagauauaaaugcugcaagaaaaagauuuguaggggaauuauccaaagcaaugguugguuuaaagaccaaauuauggguuuuagccgauguuagucaaaauggugacugggaaaucaaauacgaaaauuacgcagacuuugcagaaacuauagguuccggagaaagugacacaauacaaucacuauuuaacgaaauaaaugaucuauacggcguaaucacacucgcagguauuauaccaaaggaagcagaaucuuucagcgaugggaugguacgaaaauacgaacaucauaggaaaaaccuugaacuuuuaaaaguguauugcgccgaacaaagugacggaaaaagaggccgccagauucggcaaacuuacgauaaauauauagacggaguagauagcaaacaguuuacacaagaagauuuuuacaaagcauuaagcaaauuuacagccaaggacgaagcgacuagcgaaaaugcgaaacucauagcucaagaaauugcaguaggaacauuuaugcccaaauuaagaacaaaagcaaaugguacaauaccacaucaacuccaccaaaaagaacuggaugcaaucauagaaaaccaaaagaaauacuacccauggcuaggagaaguaaacccaguagaaucacaccgaagggccuuaccauacaaacuagaugaacuugugucuuuucggaucccauacuauguaggacccaugguaacgccaacgaaaggagauccagagaaaaguaaauucgccuggaugguaagaaaagaaccaggaacuauaacaccauggaauuucgaccaaaaaguagacagauccgccucgggugaggcuuucauccaacgcaugaaaacgacagauacauuucucauuggagaagauguacuaccacaacaaagccuauuauaccaaaaauucgaaguacuuaaugaauuaaacaaaauuaugauuaauggcaaaccaaucuguagagaacagaaacagagacuguuuaaacaacucuucaugcaguacaaaacaguaacaguaaagaaaguacaacaaaaucucauugccaauggcgaagaaucggaaaacguaccaauuacaggucuaagcgauccccuuagauucaauuccucauuuaguacauacauagacuacaaagacauucuugggaccgcagcugucaacgauaacgcgaaacaaagcgauaucgaacaaaucauugccuggaguacaauuuuugaagacgcagccauauuuagagaaaaauuaaaugauauaacguggcuaaaugacgaucaaagaaacaaacuaagccauaaaagauaucgcggauggggacggcauucgcgaaaauuauuagcaggauuaagagauggugaaggacaaacuauaauagaacggcucuggaauacaaaugauaauuucaugcaaauacaaaacgacuccgaaauagccagacaaauaacagaggcuaauucaagcaaaauggcaacagcugaagguacagacgaaauaauagacgguuuuuacaccucaccagaaaauaagaaagcccuucgagaagucaugaaaguagucaaagauauucaaagagcacaucauggucaagcgcccgccuggguuuacauagaauccccaagagaaacuccacguccagggcaaagaacugugagcagagaacaacaacuaacagacuuauaugaaggagcagcaaaagaaauaguagaugacgccguauuaaacgaacuaaaagauaagguaaaaucaaaagaaaacuucacagauaaauuaguauuauacuuuuuacagaacggacacgauauauaugcaaacgauucaaucaacauugacaaccucaacgcauaugauauagaucacguacuaccacaaucacuuauaaaagaugauucauuagacaaucgaguauuaacgacccaugaaagaaaucugaagaaaagcaacagauucgcuacagaacuauuugcggaucaaagaaagaaaugggaaaaauggcaucggcuaggacuaaucucaucucgaaaauuaaaacauuuaacuaugcaaccaaauagcguagagaaauucgcacacgguuuuauagcaagacaacuaaccgaaacgagacaaauaauucacuuaacagcuaaugugcucucaaaccuuuaucaagaaaaugacacgaaaaucgucaugaucaaagcuggccuuaauuccgaguuccggagaacauucgacuuuccuaaaaauagaaguguaaacgacuaucaucacgcauucgaugcauuccuaacagcaaaaauaggacgauacuuauuagcaagauacccaaaacuagaaccuuucuuuguguacgguaacuuugucaaaaacccaaaagcgaugaaaaggcuaaguaguuuugacuucauugcacaacuagcugccaaaaccgacgacacgucucacauagaucaaagauccuuaaaacaaguuccagucguaaaugaagaaacgggagaaauugucugggacaaagauauagagcuugcagaauuagacaaaacguauaauuacaaaacgauguuagucaaaagagcacaaacagaaaacaacgcucaaauguucaaacaaacagucuucaaagcaagagacaaucaaaauaaaacccuaauaccagugaaaaaugguuuaucgaccgauguauauggaggacauucgcagcaagcaauaagcuauuuaugcauuguaugggugggacaaaagaagaaauacagaguucucggaauaagcaccgcacaugccgggaucuuaaauaauuucgagaaaaauuacggccguuucgaagcgaaaaagaaauuacaagaaaucguaucaaauacauuggauaaugcagaucgaaaugacuucaaaaucguagcacccaaaguacuauucgaacaagucgucgaagacgacaauaugaaauuuggacuuggaucugcuucagauuacagaaacguccaacaacuauuccuuucacguaaaaaccaacuacuucuagcuaauaugaugacagaucaaauacacgaccaagaccuaguucaccuauucgaugaaauaguaggacaaaugaacgcgcacuuccccauuuuugauagaggaggauauagaagcucgcuaacucagucaagggacaaauuucuaaaacuaccauuuaagaaaaaugaagaucuaauuacaaaacaggaagucauucgacggauccucgacggucuccacgcgaacgcaaacagaaaagaucuaaaaaucauaggaucuaaaggagacuuugguagauuaggaacuaagaaaauauaucuauccaaagacgcaaaauuaauauacacuagcccaaccugccucuuuacucguacaguaccucuuagcucauuauga

SEQ ID NO: 5512 - RNA, 4137 nt, Artificial Sequence
  Cas9 variant
augacaaacgaaaaauauagcauaggcuuagacauuggaacgaguucaaucggauucgccguagugaacgacaacaacagaguaauuagaguaaaaggcaaaaaugcaauagggguuagacuauucgaugagggaaaagcggccgccgaucgaagauccuucagaacaacacgcagaagacucucaagaagacgcuggcggcuaaaauugcucagagaaauauuugacgccuauauaacaccaguugacgaggcuuucuucauacgauuaaaagaaucuaauuuaucgccaaaagauaguaagaaacaauacucaggugacaucuuauuuaacgaccgaagcgauaaagacuuuuaugaaaaauacccgacgauauaucacuuaagaaaugcguuaaugacggaacacagaaaauucgacguacgcgaaauauauuuagcaauccaucacaucaugaaauuccgcggccauuucuuaaacgcaacaccagcuaauaauuuuaaaguaggucgacuaaaccuugaagaaaaauucgaagaauuaaacgacauauaccaacgaguguuccccgaugaaaguauugaguuccgaacagacaacuuagaacaaauaaaagaaguacuucuagauaacaaaagauccagagccgaucgccaaagaacauuagucagugacaucuaccaaucuuccgaagacaaagacauugagaaaagaaacaaagcaguagcaaccgaaauacuaaaagcaucacuaggcaacaaagcaaaacucaaugugaucacaaacguagaagucgacaaagaagcagcuaaagaauggaguaucacauucgacucagaaagcauugacgaugaucuggcaaagaucgaaggacaaaugacagacgauggacaugaaauaauagaaguuuuaaggucauuauauucuggaauuacauuaucagcaaucguacccgaaaaucauacacuuucacaaucgaugguagcaaaauaugauuuacacaaagaucaucucaaacuguucaagaaacuuauaaacgguaugacagacacaaagaaagccaaaaacuuaagggcagcguaugacgguuauaucgacggcgugaaagggaaaguucuuccacaagaagacuuuuauaaacaaguacaaguaaaccuagacgacucggcugaagcaaaugaaauucaaacauacaucgaccaagauauauuuaugccaaaacaaagaacgaaagccaacggcucaaucccgcaccaauuacaacaacaagaacuugaucagauaauugaaaaccagaaggcuuacuauccauggcucgcugaauuaaacccgaauccugacaagaaacgacaacaauuagcaaaauacaaacucgacgaacucguaaccuuuagaguaccguauuacgucggacccaugauaaccgcaaaagaucagaaaaaucaaaguggagcggaauuugcauggaugauaaggaaagaaccagguaauauaacaccauggaauuucgaucaaaaaguagaccgaauggccacagcaaaccaauuuauuaaacgaaugacaacaacagauacguacuuacuaggugaagauguacucccagcccaaucucuauuauaccaaaaauucgaaguucuuaaugaauuaaacaaaauccgaauugaccauaaaccaauuucaauagaacagaaacaacaaauauucaaugauuuauuuaaacaauuuaaaaaugugacuauuaaacaucuacaagauuacuuagugucccaaggccaauacucgaaaagacccuuaaucgaagggcuugcagacgaaaaacgauuuaacucaucacuaagcacauauucugaccuaugcgggauauuuggugccaaauuaguggaagaaaacgauagacaagaagaccuagagaaaauaauagaauggucaacaauuuucgaagauaagaaaauauaccgagcaaaacuaaacgaccuaacaugguugacagaugaucaaaaagaaaaacuggcaacaaaacguuaucaaggaugggguagauuaagccgcaaacuauugguagggcucaaaaauagugaacauagaaauauaauggauauauuauggauuacaaaugaaaauuucaugcagauccaagcagaaccggauuuugcaaaacucgucaccgacgcgaauaaaggcauguuagaaaagacagauucucaagacguuauaaacgaccuauauaccucaccacaaaacaagaaagcuauacggcaaauccuacucguaguacacgauauacaaaacgcuaugcauggccaagcccccgcaaaaauacacguagaauuugcccgaggagaagaaaggaaucccagaagaucaguacaaagacagcggcaaguagaagcugcuuacgaaaaaguaucaaaugaacugguaucugcaaaaguaagacaggaguucaaagaagcaaucaauaauaaacgagacuuuaaagauagacuacuacuuuauuucaugcaaggagggauagauauauacacaggcaaacaacuaaauaucgaucaacuaucaucauaccagauagaccauauccuuccccaggccuuuguaaaagacgacagcuuaacaaaccgaguacuaacaaacgaaaaucaaguaaaagcagacaguguaccaauagauauauucggaaagaaaaugcuaucaguuuggggaagaaugaaagaccaaggguuaaucaguaaaggaaaauacagaaaccuuaccaugaacccagaaaauauaagcgcccacacugaaaaugguuuuauuaaccgacaauuaguggaaacuagacaaguaauuaaacuagcaguaaacauacuggcagaugaauauggagauucaacgcaaauaauauccgugaaagcagaccucagucaucaaaugcgagaagauuucgaauuguuaaagaauagagacgugaacgacuaccaccacgcauuugacgccuauuuagcagcauuuauuggcaauuaucuccuaaaacgauauccaaaacuugaaucguauuuuguauacggagauuucaagaaauuuacucaaaaagaaaccaaaaugcgaagauucaacuuuauuuaugaucuaaaacacugcgaucaagucguaaacaaagaaacaggugaaauauuauggacaaaagaugaagacauuaaauauauacgacaucuauucgcauacaagaaaauauuagugucacaugaagugagggagaaaagaggagcacucuacaaucaaacuauauacaaagcgaaagaugacaaaggaucaggacaaggaucaaagaaacuuauucguauaaaagaugauaaagaaacaaaaauauacggaggauacucaggaaaaagccuagcuuauaugacuaucguccagauuacuaagaaaaacaaaguaucuuauaggguaauagguauacccacacuugcacuagcaagauuaaauaaauuagaaaacgauucaacagaaaauaauggggaauuguauaaaauaauaaaaccucaauuuacccauuauaaaguagauaagaaaaacggagaaauaauagagacgacagacgacuuuaaaauuguaguaucgaaaguaagauuccaacaauugauagacgaugcgggucaauucuuuaugcucgcgagcgacacuuauaaaaacaacgcgcaacagcuaguaauaaguaauaaugcgcuaaaagcgauaaacaauacaaauauaacagacuguccaagagaugaccucgagcgauuagacaaccugagauuagauagugcauuugaugagauagucaagaaaauggacaaauacuucucagcauaugaugcaaauaauuuuagagagaaaauuagaaacucaaaccuaaucuucuaucaacuaccaguagaagaccaaugggaaaauaauaaaaucacagaauuaggaaaaagaaccguacucacaagaaucuugcaaggacuacacgccaacgcaacuacaacggauaugucaauuuucaaaauaaaaacuccauucggucaacuacgacaaagaucaggaauaagucuaucagaaaaugcacaacuuaucuaccaaucaccaacuggauuauuugaaagaagaguacaacuuaauaaaaucaaauga

SEQ ID NO: 5513 - RNA, 4137 nt, Artificial Sequence
  Cas9 variant
augaaaaacaaagacuauucaauaggcuuagauauagguacuuccucaaucggauucgccguaguugaugagaauaaucauguuaugagagucaaaggcaaaaaugccauaggcguaagacuauucgacgaaggaaaaccagcugcagaccgacgugccuuucggaccacacgucggagacugucacgaagaagauggagacucaaauuacuaagggaaauauuugauucauauaucacaccaguggacgaggcuuuuuucauaagguuaaaagaaagcaaucuauccccaaaagacucaaaaaaacaauauaguggagacauacuauuuaacgauagaagcgacaaagacuuuuauaccaaauauccaaccauauaccaucuaagaaaugcauuaaugacggaacaccaacguuucgauaucagagaaauauauuuagcuauccaccacauaguuaaauuccgaggacacuuuuuaaacgcaacaccugcgaauaauuuucaaguaggaaaacuugacuuggaccaaaaauucgaagaccuuaaugauauauaucaaagaguauucccagacgacaguauagaauucagaaucgacaaccucgaacaaauaaaagccguauuauuagacucaaaaaggucacgcagcgacagacaacgcucacuuguagacgacguauaucaaacuucagaagacaaagaaguagagaaacaaaacaaagcaguugcaaccgaagucuugaaagccauacuaggcaacaaagcaaaacuuaacauaauugcaaauguugaaguugacaaagaggcagcaaaagaguggacuauaacauucgacuccgaaucaauagacgacgaccucgcaaaaauagacggucaaaugacagacgacggaagagcuauaguggaaauacucagauccuuauacaguggaauuacccuuucugcaauagugccugaaaaucacacccuuagccaagcaaugguagcaaaauaugaucuacauaaaaagcaucucacauuacucaaaaaauuaaucaauucgaugaccgacacuaaaaaagcuaaaaaccuccgcgcagccuacgacggauacguagauggcguaaaaggaaaaguacuaacucaagaugaauucuauaaacaaauacaauccaauuuggacgaaucaguagaagcauccgaaauacaaacauauauagaucaggacauuuuuaugccuaaacaaagaaccaaagcgaacgguagcauuccacaccaauuacaacagcaagaacuagaccaaauaauagaaaaccaaaaggaauacuaccccugguuagcugaacuaaauccuaacccagacaaaaaaagacaacaauuagcaaaguauaaacuugaugaacucguuaccuucagaguaccguacuauguaggcccaaugauaacagcagaagcacaaaaaaaacaguccggagcagaauucgcauggaugauucgcaaggaaagcggcaacauaacuccuuggaacuuugaccaaaaaguagauagaauggcuacagcaaaucaauuuauaaaaagaaugacgacuaccgacacauauuuauugggagaagacguauuaccaucgcagucucugcuuuaccaaagauucgaaguauuaaacgagcuuaacaaaauccgaauagaucgaaaaccaauauccgucgagcuuaaacaacaaaucuuuaaugacuuauuuaaaaaauucaaaaauguaacaaucaaacaccuacaagacuauuuaguagcucaaggacaauacucaaaacgaccauugauagaagggcucgcagaugaaaaaagguucaacucaggccucucaaccuacaacgacuucugugggauauuuggggcuaaacuggucgaugagaaugacagacaagccgauuuagaaaagauaauugaauggucuacaaucuuugaagacaaaaaaauuuaccgagcaaaacuaaacgaucuagcauggcuaacugaugaacaaaaagauaaacuugcgacaaagagguaucaaggauggggacgacuaucaagcaaauuauuaauaggacuacaaaacagcgaacacagaaacauaauggaccuccuuuggauuggaaacgaaaacuucaugcaaauacaagcagauucugacuuugcgaaauuaauaaaagaugcaaaucaaaacgccuuacaaaacaaugacucucaagacgugaucaaugacuuguauacgaguccgcaaaacaaaaaagcuaucaggcaaauuuuguuagucguacaugacauacaaaacgcuaugcauggucaagccccuaccaaaauacauguugaauuugcaaaaggugaagaaagaaaucccagaagaucaguccaaagacaaaggcaaguagaggcagcuuacgaaaaagcaucaaacgaacuuguaggugcaaacguucgagaagaacuaaaagacgcaauaacuaauaaacgagacuucaaagaucgucuauuccuauacuucaugcaaggcgggguugauauguauagcggagaacccauaaauauagacaauuuauccagauacgauaucgaccauauccuaccacaggcguuuguaaaagaugauuccuuaaauaacagaguauuaaccgaugcagagaaaaauaggagaaaaagugaugcaguucccaaugaauuauuuggagccaaaaugagaguaacaugggaacgcaugaaagaacagggccuaaucucaaaagguaaauaccguaaccucacuaugaauccagaaaauauaaauaaauacaccgaaaacgguuucauaaauaggcaauuaguagaaacgcgacaagucauaaaauuagcaguaaauauacuagccgacgaauauaaggaaaacacccaaauaauauccguaaaggcagauuuaucgcaccaaaugagagaagauuuugaauuauuaaaaaacagagauguuaaugacuaucaucaugcauuugaugcuuauuuagcugcguuuaugggaaacuacuuauuaaaaagauauccaaaacucagauccuacuucguuuauggagacuuuaaaaaauuuacucaaaaggaaauaaaacuaagacguuuuaacuucaucuaugacuuaaaacacgaagaucaaguaaucgacaaagaaaccggagaaauacuuuggaacaagaacgaagacaucgcauauauaaggcaccuauuugccuauaagaaaauauuaauuucacaugaaguuucugaaagaagaggcgcguuguacaaccaaacagucuacaaagcuagugaugacaaggcaucaggacaaggaucaaaaaaauuaauacccauaaagucagauaaaccaacagaaaucuacggaggauacaccggcagaacacuagcuuauaugacaauaguuaagguaacaaagggcaaaaagauauccuauaaaguaguaggagugccgacagcaguauuagcgaaaauggcgggaguacgacagggaucccaagaagaacaagacaaauuauacggggugcuaaagccccaauuuacucaccaaaaagagaacaaaaaaacaggcgaaauaaccgaaacaguagacaaguuugacaucauugucccaaaaguuaaauaucaacaguuaguaaaugacaacggacagcucuucaugauaggaucagauacccucccuuauaaugcagaacaauuggugcuuucaaaagaaucaguccaaaccaucaacaaucccggaauaaaagacgagggaagugaugaagaaagcgaaaacaaaaaauuagacaauguauacgacgaaauaguauuauguaugaacaaguauuuuccuuuauaugacaacagagguuuccgaaacuccaucacaaauggaaaaaacaaauucuuaaaauuaccaauaaagaacauauauaaaaacgguaaacuaauaaauguaggaaaacgcgagguuaucaauagaauucuucaagguuuacacgcaaaugcuagugucacagaccuaucaaauuuagguauuaaaagcccuuuuggcuucuuacaaaagggcgccggucuaagccuaucaggagaagcgcaacugauucaccaauccgcuaccggcuuguucgaacaccgaguacagcuaaauaaaaucaaauga

SEQ ID NO: 5514 - RNA, 4137 nt, Artificial Sequence
  Cas9 variant
augagcaauaaacccuauagcauuggauuagauauagguacaaacucaguaggaugggcaguaaucacagaugacuauaaaguaccauccaagaaaaugaaaguuuuagguaauacagauaaacacuucauuaagaaaaacuugauaggugcacuacuauucgacgaaggaacgacagcagaggguagaaggcuaaaacgaacagcaagacgcagguacaccagaagaaaaaaccgacuaagauaccuccaggaaauauucagugaagagaucucuaaaguugacaguaguuuuuuccacagauuagacgacaguuuccucguuccugaggauaaacgaggaucaaaauauccaauuuuugcaacacucgcagaagaaaaagaauaccauaaaaacuuuccaacuauuuaccaccucagaaaacaauuagcagauucaaaggaaaaagccgauuuaaggcuaaucuaucuugcgcuggcucauaugaugaaauacagaggucacuucuuguaugaagaaagcuuugauauuaaaaacaaugauauacaaaaaauuuucaacgaguucauaucaauauacgacaauaccuucgagggaucgucacuuagcgaacaaaaugugcagguagaagcaauuuuuacagauaaaaucuccaagucggcuaaacgugaaaggguuuuaaaacucuuucccgacgaaaaauccaccggacuuuucucugaauuucuaaaacuaaucguagguaaccaagcagaauucaaaaaacacuuugacuuagaggaaaaagccccuuuacaauuuucaaaagauacauaugaugaggaccuugaaaaccuauuaggccagauaggugacgguuucgcugaucuuuuccuaguagcgaagaaacuguaugaugccauucuacucucugguaucuuaacaguaacggaccccucaacaaaagcgccauuaagcgccucuaugauugaacgauacgaaaaccaucaaaaagaccuagcaucacucaaacaguucauuaaaaauaauuuaccagcagaaaaaugcguagaaguauucucagaccaaucaaaggacggauacgcuggauacauagaugguaaaacuacacaagaagcauucuauaaauauauaaagaaccuccugucaaaauuagaaggagcguacuacuuccuagacaaaauagaaagagaagauuuccuuaggaaacaacgcaccuuugauaauggcagcaucccccaccaaauacacuuacaagaaaugaaugcuauacuacgaagacaaggagaacacuauccauuccuaaaagaaaacagagagaaaauagagaaaauuuuaacauuccgaauaccauaccaugucggaccauuagcacgcggaaacagagacuuugcuuggcucaccagaaauucugacgaagcaauuagaccuuggaauuuugaagagauugucgaucaggcaucauccgcugaagacuuuauaaauaaaaugaccaauuacgaucuguaccuaccagaagagaaaguucugccaaaacauucucuacuauacgaaacuuucgcaguauauaacgaauuaaccaaaguaaaauuuaucgcagaaggauuaacccgcuaucaauuccuagauaaaaaacaaaaaaaagacauauucuauacauuuuuuaaagcagaagacaagaggaaaguaacggaaaaagauauaauacacuauuuacacaauguagacggauacgacgguauagaacuuaaaggaauagaaaaacaauucaacgccagccuaagcacauaccacgaccuccuaaaaauaaucaaagacaaggaauucauggaugaucccaagaacgaagaaauacuugaaaacauuguacacacacuaaccauauuugaagaccgagaaaugaucaaacaaagacuagcccaauaugacucauuauuugacgaaaaagucauaaaagcccuaacccgucggcauuauacagguuggggaaaacuaucagcuaaacuuauaaacgggauaugugacaagcaaacagguaaaacuauacuugauuauuugauagacgacggaaaaauaaauagaaauuucaugcaacuaaucaacgacgacggacucucguuuaaagaaauaauacagaaagcgcaaguaguaggaaaaacguacgacguaaaacaagucguucaggaacuuccaggaucaccagcaaucaaaaaaggaauccuacagucaguaaaauuaguugaugaacuuguuaaaguaaugggacacgcaccggaaucaauaguaauagaaauggcaagggaaaaucaaacaacagccaaagguaaaaagaauucacaacaaagauacaagagaauagaagaugccauuaaaaaucuugcacccggucuagacagcacaaucuugaaagaacacccaaccgauaacauucaacuacaaaaugaccgucuauuccuauauuauuuacaaaacggucgagacauguauacaggaaaaccauuagaaaucaaccaacuaucaaauuaugauauugaccauaucauaccacaggcauuuaucaaagaugacucacuugauaauagaguucuaacaucgucaaaagaaaacagagguaaaagcgacaauguaccaucauuagaaguuguagaaaaaaugaaggcauucuggcaacaacuuuuagacagcaaacuaauaagcgaaagaaaguucaacaaucucacaaaagcagaaagaggaggauuagacgaauuagacaaaguaggauuuauaaaaaggcaguugguugaaacaagacaaauaacaaaacauguugcacaaauccuggacgccagauuuaacaaagaaguaaccgaaaaaaacaagaaaaacagaaauguaaaaaucauuacacugaaaaguaacaugguuucaaauuuccggaaagaguuuggauuguacaaaguacgagaaauaaacgacuaucaccaugcgcacgaugcguaucuaaacgcuguaguugcaaaggcaauccuaaaaaaauaucccaaacuagaaccugaauuuguauacggcgacuaucaaaaauacgaccucaaacgauacaucucaaaaucaaaagauccgaaagaaguugaaaaagcaacagaaaaauauuucuucuauuccaaccuucuaaauuuuuuuaaagaagaaguucauuaugcagauggaacaauaguaaaaagagaaaauauugaguauucuaaagauaccggagaaauagcuuggaacaaagaaaaagacuuugccaccaucaaaaaagugcuaaguuucccacaaguaaacauaguaaaaaaaacagaagaacaaacggucggucaaaacgguggacuauuugacaacaacaucguuagcaaagaaaaaguaguugacgccucuaaacuuauaccuauaaaaagcggucuauccccagaaaaauauggaggauacgcccgaccaaccauagcauauuccgucuuaguaacguauaaacaaaacaacaaaaucaaaaacacaaugguagguauaccggucuuaaccaaacuagaguucgaaagagauccaaaccuauaccuacgcaaucuuggaauaaauaacguaucacauguuauaaaacucguaaaacauacaguacucgaauuuaaacauaaauauggaacuuacagacgcuuuauugucucaaaccaagaacugaaacgagccaaucaaauuuucgucacaacaaaacaaaugaaacuaauaagccaauauacuacccuugauaaaaaugagcacgacucuuuacuaaagaauaaucagcaauuaauucaaucaaucuggaaccaauuccuugaguuuaugcucgccaccgauuuaguuaacaaaaaacaauacgacgaacuuaucuuaacaaauaaccaaaccauagaagaaugcagaaacauaaugaacagagucauuaccacccuuuccuucaccaacauaaacgcaggacaaaaaaaaauuaucuucgacgauacacuuaguuuacccauaaaacgauggcaauucacugacagcgauaagaugguaaagaaaauaauugaauccacguuaauacaccagucaauaacgggacucuacgaaacacgcauagaccuaaacaaguuaggggaagacuga

SEQ ID NO: 5515 - RNA, 4137 nt, Artificial Sequence
  Cas9 variant
augaacaaacccuauucaauagguuuagacaucggaacaaauucaguggguuggucaaucauaaccgacgauuauaaaguaccagccaaaaaaaugaggguauuaggaaacacagacaaggaauacaucaaaaaaaaucuaaucggugcacucuuauuugauggaggaaacacugcagcagaccgacgacuaaaaagaacugcucgaaggcgcuacacacgaaggcgcaaccgaauacuauauuuacaagagauuuuugccgaggaaaugaguaaaguggaugauucauuuuuccauaggcuagaagauaguuucuuaguagaagaagauaaaagagguagcaaauauccgaucuuugcuacgaugcaagaggaaaaauauuaccacgaaaaauuccccaccauauaccaucuccgaaaagaacuagcagacaaaaaagaaaaagcugauuuaagacuuauauaccuagcauuagcacacauaaucaaauucaggggucauuucuuaauagaagacgaucgauuugacgugcgcaacacagauauacaaaaacaauaucaagccuuccuagaaaucuuugauacgacauucgagaauaaugacuugcuuucacaaaauguagauguagaagcaauccucacggacaaaaucaguaagucagcaaaaaaagauagaauccuagccagauacccuaaccaaaaaucaacaggaaucuucgcugaauuucuaaaauuaauagucggaaaccaagccgauuucaaaaaacauuuuaacuuagaagacaaaaccccauuacaauuugcaaaagauucuuacgaugaagaccucgaaaacuuacuaggacaaauaggugacgaauucgcagacuuauuuagcgcagcuaaaaaacuauaugauucuguauuauuguccggaauccuuaccguaauagaccuaagcacgaaggcaccucuaucagcuaguaugauccagcgcuacgacgaacaccaugaagaccuaaaacaccuaaaacaguuugugaaagcgucauugccugaaaacuauagagaaguauuugccgauucaagcaaagacggauacgccggcuacauagaaggaaaaaccucucaagaagcauuuuauaaauauuuacuaaaauuacucacaaaacaagaagguagcgaauaucuauuagaaaaaauaaaaaaugaagacuuccuucgaaaacaaagaaccuucgacaauggauccauaccucaucaaguccaucuuacagaacuacgagcaauuauccguagacaaagugaauacuacccuuuuuuaaaagaaaaccuagaccguauugaaaaaauccuaacauuccgaauaccguacuacgucggcccccuagcccgagaaaagucagauuuugcuuggaugacaagaaaaacagacgauuccauaaggccauggaacuucgaggaccucguggacaaagaaaaaucagccgaagcuuuuauucauagaaugacaaacaacgauuuauaucuaccagaagaaaaaguccuacccaaacauucccuaaucuaugaaaaauuuacugucuauaaugaacucacaaagguacgcuuccuagcagaagguuuuaaagauuuccaauuccucaaucgaaaacaaaaagaaacaauuuucaauucccuuuucaaggaaaaaagaaagguuacagaaaaggacauuauaucauuucucaauaaaguugauggcuacgaagguauugccauaaaagguauagaaaaacaauucaaugccucucuaucuacauaccaugaucucaaaaaaauauuaggaaaagacuucuuagauaacacagauaacgaacuaauacuugaagacaucauccaaacacuaacacuauuugaagaucgagaaaugauaaaaaaacgauuggacauauacaaagacuucuuuaccgaaucacaacuuaaaaaacucuauagacgccacuacacuggcugggguagacuuucugcaaaacuaauaaaugguauaagaaauaaagagaaccagaaaacgauccuugacuauuuaauugacgacggaucugccaaccgaaauuucaugcaguuaauaaaagacgcaggauuaucauucaaaccaauaaucgacaaagcuagaacagguagucacagcgacaacuuaaaggaagucguuggugaacuugccggcagcccggcaauaaaaaaaggaauccuacaaucacuaaaaauagucgacgaacuugucaagguaaugggguaugaaccugaacaaauaguaguagaaauggcaagagaaaaccaaacaacugcaaagggauugucaagguccagacaaagacuaacaacauuacgcgaaagcuuaggaaaccuaaaaucuaacauacuagaagagaaaaaacccaaauacguuaaagaucaaguagagaaucaccaccuuucagacgaccggcuauuccucuacuauuuacaaaauggaaaagacauguauaccgacgacgaauuagacauagacaacuuaucucaauaugauauagaccauauaauaccacaagcauucauaaaagacgacaguaucgacaaucgaguauuagugucaagugccaaaaacagaggaaaauccgacgacguaccuagcauagaaauugucaaagcgagaaaaauguuuuggaaaaacuuacuagacgcaaaacugaugucacagaggaaauaugauaaccuaacaaaagcagaacgaggugggcuaaccagugaugacaaagcacguuucauacaacgucaacuggucgagacaagacaaauaacuaaacacguugccagaauccucgacgaaagauucaauaaugaauuagacuccaaaggaagaagaauaagaaaaguaaaaaucgugacgcuuaaaucgaaccuaguaaguaauuuucgaaaagaauucggauucuacaaaaucagagaaguaaauaacuaucaucaugcacacgaugcauaccuaaacgcagucguagcaaaggccauuuuaacgaaauauccucaauuagaacccgaauuuguauauggccuauaccgucgaaaaaaacuuagcaaaauaguaagagaagauaaagaagaaaaauacuccgaagcaacucgaaaaauguucuuuuacucuaacuuaaugaauauguuuaagcgagucguacgucucgcagacggaagcauuguaguuagaccagucauagagacugguagauacaugggaaaaacagcaugggauaaaaaaaaacacuuugcaacgguacgcaaagucuuaagcuacccccaaaacaacauagucaagaaaacggaaauucaaacaggagguuucagcaaagaaagcaucuuagcacacgguaauucagauaaauuaaucccccgaaaaacaaaagauauauacuuagauccgaaaaaauacggcggauucgauucaccaaucguugccuauaguguccuaguuguggcugacaucaaaaaaggcaaggcccaaaaguuaaaaacagugaccgaauugcuaggcauaacaauaauggaaagaagucgauuugaaaaaaacacauccgcauuucuagagucuaaaggguaccuaaauauaagagaugauaaacuaaugaucuuaccaaaauauucauuauuugaauuagaaaauggcagaagaagacuucucgccagcgcaggcgaauuacaaaaaggcaaugagcucgcauuaccuacccaauuuaugaaauuuuuauaccucgcuucaagauacaacgaaucaaaggguaaaccagaagaaauagaaaaaaagcaagaauuuguaaaccaacauguaucauauuuugacgauauauuacaauuaauaaacgacuucucaaacagaguaauauuagcagaugcaaaccuugaaaaaauaaacaaacuauaucaagacaacaaagagaauauaccuguagacgaacuagcaaacaacaucauuaaucuauuuacauucacaucacuaggugcucccgcagccuuuaaauucuucgauaaaauagucgaucguaaaagauacacauccacuaaagagguucuaaacaguacauuaauacaccaaaguauaacaggacuauacgaaacccgcauagaucuaggaaaacuaggagaagguuga

SEQ ID NO: 5516 - RNA, 4137 nt, Artificial Sequence
  Cas9 variant
augacaaaugaaaaauauaguauuggccucgacauaggaacgagcucuauagguuucgcaguaguaaacgacaauaaccggguaauuaggguaaaagguaaaaacgcaauaggaguuagauuauuugacgaagggaaagcagcggcagauagaagaaguuucagaacgacacguagacgacuauccaggagaagauggcgccucaaacuacuacgagaaauuuucgacgcauauauaacacccguagacgaagcauucuuuauacgcuuaaaagaaaguaaccugaguccaaaagauagcaagaaacaauacucaggagauauauuauuuaaugacagguccgauaaagauuucuaugaaaaauaccccacaauauaccaccuaaggaaugcccuuaugaccgaacaucgaaaauuugaugugagagaaaucuacuuagcuauacaucauaucaugaaauuuagaggacacuuccuaaacgcuacacccgccaacaacuucaaaguaggcagguuaaacuuagaagaaaaauucgaagaacuuaaugauauuuaucaacgggucuucccagacgaaucaauugaguuccgaacagauaaccucgaacaaauaaaagaaguccuauuagauaauaaacgaucacgugccgaccgacaaagaacauugguaagugauauauaucaaagcagcgaagauaaagacaucgaaaaacgaaacaaagcgguagcaacugaaauuuuaaaggcaucccuaggaaauaaagccaaacuaaaugucauaacaaacguagaaguagacaaagaagcugcuaaagaaugguccauaacauucgacucugaaucaauagacgacgauuuggccaaaauugaaggacaaaugaccgaugacggacaugaaauaauagagguccuuagaucauuauacaguggaauaacuuuaucagccauagucccagaaaaucauacauugagccaaaguaugguagccaaauacgaccuucauaaagaucaccuaaaauuauucaagaaacugauuaaugggaugaccgauacaaagaaagcgaaaaaucuucgagcagcauacgaugguuauaucgacgguguaaaagguaaagugcuaccucaagaagacuucuauaaacaaguacaaguaaaccuugaugacagcgcagaagcaaacgagauccagacuuauauagaccaagacauauuuaugccaaaacaacgaacaaaagcaaacgggagcauuccacaucaacuacagcaacaagaauuagaccaaauuauugaaaaucaaaaagcauacuaucccuggcuagccgaguuaaacccaaauccagacaagaaaagacaacaacuugcaaaauacaaauuagaugaauuaguaacauuccgcgugccauauuauguaggacccaugauuaccgcuaaagaucagaaaaaucaaagcggggcagaguucgccuggaugauaagaaaagaaccaggaaauauuacaccuuggaacuucgaucaaaaagucgacagaauggcgaccgcaaaccaauuuauaaaaagaaugacuacuaccgauacauaucuacuaggggaagauguucuaccggcucaaucacuccuuuaucagaaauucgaaguucuaaaugaauuaaauaaaauacgcaucgaucauaaaccaaucagcauagaacaaaaacaacaaauauuuaacgaccuauucaaacaguuuaagaacguaacuauaaaacaucuacaagauuaccucguuucucaaggucaauacucuaaacgcccgcuaauugaaggauuagcggaugaaaaacgauucaacagcaguuuguccacuuacucagaccuauguggaauauuuggagcaaaauuaguugaagaaaacgauagacaagaagacuuagaaaagauaauugaauggaguacuauauucgaagacaagaaaauauaccgagcaaaacuaaaugaucuuacuuggcucacagacgaccaaaaagaaaaacucgcuaccaaaagauaucagggauggggaagacuaucuagaaaauuauuaguaggguuaaagaacucugaacaucgaaacauaauggauauacuuuggauaacaaaugaaaauuuuaugcagauacaagcagaaccagacuucgcuaaacugguuacagacgccaacaaaggaaugcuagaaaagaccgauucacaagacgucauaaacgaccuauauacuagcccacaaaacaagaaagcaauaagacaaauacuauuagucguacaugacauacaaaaugcaaugcacggacaagcaccagcaaaaauacauguagaguucgcucguggugaagaaagaaaucccagaagaagcgugcaaagacaacggcaagucgaggcagcauacgaaaaaguaucaaaugagcuagucagugccaaaguaagacaagaguucaaagaagcaaucaacaacaaaagagauuucaaagauagacuauucuuauacuucaugcaaggaggaauagacauauauacaggaaaacaacuaaacauagaccaauuaucuagcuaccaaauagaucacauauuaccccaggcauucgucaaagacgacagcuuaacaaaucgagucuuaacaaacgaaaaccaaguaaaagcggauuccguaccaauugauaucuuuggaaagaaaauguuaucaguauggggccggaugaaagaccaaggacugauaucaaaagguaaauacaggaaccugacaaugaacccagaaaauauaagugcacacacagaaaacggcuuuauaaauagacaauugguagaaacaaggcaaguaauaaaacuggcaguaaauauacuagcagacgaauauggagauucuacacaaauuaucucuguuaaagcagaccuaucgcaucaaaugcgagaagacuucgaauuacuuaaaaauagagaugucaacgauuaucaccacgcuuuugacgcauaucuagccgcauuuauuggaaauuaccuacuaaaaagauacccaaaauuagaaucuuauuuuguguauggagacuucaagaaauuuacucaaaaagaaacaaaaaugcgcagguuuaauuuuauauacgauuuaaaacauugugaccaaguaguaaacaaagaaacuggcgaaaucuuauggacaaaagaugaagauauaaaauacauacgacauagcuucgcauacaagaaaauacuuguaucucacgaagucagagagaaaagaggagcucucuacaaucaaacaaucuauaaagcaaaagacgacaaaggcucaggacagggcaguaagaaacuaauacggauuaaagacgacaaagaaacaaaaauauacggaggauacagcggaaaaaguuuagcguauaugacgauaguacaaauaacuaagaaaaacaaaguuagcuacagagucauaggcauacccacauuagcccuagcuagauuaaacaaauuagaaaaugauagcacagaaaauaacggugaacuauacaaaauaauaaaaccacaauucacccacuacaaaguagauaagaaaaauggggaaauaaucgaaacgacugacgacuucaaaauagucgucucuaaaguaagauuccaacaauuaauugacgaugccggacaauucuuuaugcuggcaucagauacauauaaaaauaaugcucaacagcuaguaaucaguaacaacgcauuaaaagcaaucaacaauacuaauauaacagauugcccaagggacgaucuugaaagacucgauaaccuucgucuugauuccgccuucgacgaaauuguuaagaaaauggacaaauauuucagugccuacgacgccaacaauuucagagagaaaaucagaaacagcaacuuaauauucuaucaacuaccuguagaagaucaaugggaaaauaauaaaauaacugaacuaggaaaacgaaccguacuuacaagaauuuuacaaggccuucaugcgaacgcaacaaccacagauaugucaaucuucaaaaucaaaacuccuuuuggccaacuacgccaaagaagugguauuucgcuguccgaaaacgcacaacuaauauaucaaucaccaacagguuuauuugaacgacgaguucaacuaaacaaaauaaaauga

SEQ ID NO: 5517 - RNA, 4137 nt, Artificial Sequence
  Cas9 variant
augacaaacgaaaaauacucaaucggauuagauaucggaacaucgucgauuggauucgcggucgucaaugacaauaaucgaguaauacgagucaaaggcaaaaacgcaauagggguacgauuauucgacgaaggcaaagcagccgcagaccgacgcaguuuucgaacaacaagacgacgacuaucaagacgaagauggagguuaaaauuguuaagagaaauauucgacgcauacaucacuccaguggacgaagcauucuuuauccgucuaaaagaaucaaauuuaucuccaaaagacagcaagaaacaauacucaggggacauauuauuuaaugaucgaucagacaaagacuucuacgaaaaauauccuacaauuuaucacuuacgcaaugcacuaaugacagaacauagaaaauucgacguaagagaaauuuaucuagcuauccaccacauaaugaaauucagaggccacuuucuaaaugcuacaccagcaaauaauuuuaaaguaggaagauuaaaccucgaagaaaaauucgaagaacuaaacgacauauaccaacggguauucccagaugaaucuauagaauuuagaacagauaauuuagaacaaauuaaagaaguacuauuagacaauaaacggucacgagcagaucgacaaagaaccuuagugucagacauauaccaaucuucagaagacaaagacauagaaaaacguaauaaagccguagcaacugaaauauuaaaagcaucacuaggaaacaaagcaaaauuaaaugucauuacuaauguagaagucgacaaagaagcagcaaaagaauggaguaucacauucgacagcgaaaguaucgaugaugacuuagcaaaaaucgaaggacagaugacggacgauggacacgaaaucaucgaaguucugagaucucuauacuccggaauaacucuuucagcgauaguaccagaaaaucauacacugucacaaucgaugguagcaaaauacgacuugcacaaagaccacuuaaaauuauuuaagaaauuaauuaacggaaugacagacaccaagaaagccaaaaacuugcgcgcagcuuaugacggcuacauagacggcguuaaaggaaaaguacucccucaagaagacuucuauaaacaaguacaaguaaacuuagacgauucagcagaagcaaaugaaauacaaacauacauagaccaagauauauucaugccaaaacaaagaacaaaagcaaacggaagcaucccccaccaacuucaacaacaagaacucgaccaaauaauagaaaaccaaaaagcguacuauccuuggcuagcugaauuaaacccgaauccagacaagaaacgacaacaauuagcaaaauacaaacuagaugagcuaguaacauucagaguaccauacuacguaggucccaugauaacagcaaaagaucagaaaaaucagaguggagcagaauuugcuuggaugauaagaaaagaaccagguaauaucacucccuggaacuucgaucaaaaagucgacaggauggcgacagccaaucaauucauaaaacgaaugacgacaacagauacauaccuauuaggagaagauguacuaccugcccaauccuuauuauaucaaaaauuugaaguacuuaacgaacuuaauaaaauucgcaucgaccacaaaccaauaucaauugaacaaaaacaacagauauucaacgaccuauuuaaacaauuuaaaaacgugacaauuaaacauuugcaagacuaccuuguaagucagggacaauauaguaaaagaccccuaaucgaaggguuagcagaugaaaaacgcuuuaauagcagucucaguacauauucugauuuauguggaauauuuggagcgaaauugguagaagaaaacgauagacaagaagaccuugagaaaauuauugaauggaguacaauuuucgaagauaagaaaauuuacagggcgaaauuaaacgauuuaacaugguugacagaugaucaaaaagaaaaacucgcaaccaaacguuaccaaggcuggggaagacuuucuaggaaacuccuaguaggucucaaaaauucagagcaccgcaauauaauggacauucuauggauaacuaaugaaaauuucaugcagauccaggccgaaccagauuucgcaaagcuaguaacagacgccaacaaaggcaugcuagagaaaacagauucacaagaugucauuaaugaucuuuacacgaguccacaaaauaagaaagccauacgccaaauacuucucguaguucacgauauacaaaacgcaaugcacggacaagcgccagcaaaaauacauguugaauuugcaagaggagaagaaagaaauccacgaagauccguacaaagacagcgccaaguagaagcagcguaugaaaaggucagcaaugagcuaguaagugcuaaaguaagacaagaauuuaaagaagcaaucaacaauaaacgagacuuuaaagauagauuauuuuuauacuuuaugcaaggaggaauugauaucuauaccgguaagcaacuaaauaucgaucaauuguccucauaccaaauagaucauaucuuaccacaagcauucguuaaagaugauagccuaacaaacagaguacucacaaacgagaaccagguaaaagcagauucuguaccaauugauauauuuggcaagaaaaugcugagcguuugggggcguaugaaggaucaaggccugaucucaaagggaaaauauaggaaccuaaccaugaaccccgaaaauauaucugcacacaccgaaaacggguucauuaauagacaacucguagaaacacgacaagucaucaagcuagccgucaacauauuggcagaugaauacggagacaguacacaaauuauaucaguuaaagcagauuuaucacaucaaaugagagaagauuucgaacuacuaaagaaccgcgacgucaaugauuaucaccaugcauucgacgcauauuuagcagcguuuaucggcaauuaucuuuugaaaagauauccaaaacucgaaagcuacuuuguuuauggagauuucaagaaauucacgcaaaaagaaacuaaaaugaggcgcuucaauuuuauauacgaucucaaacacugcgaccaaguaguaaauaaagaaacaggugaaaucuuauggacaaaagacgaagacaucaaauauauaaggcacuuauuugcuuauaagaaaauccucguaucgcacgaaguaagagagaaaaggggagcauuauacaaucaaacgauuuacaaagcaaaggacgacaaaggaagcggacaaggcagcaagaaauuaauucgaauaaaagacgacaaagagacaaaaaucuacggaggauauaguggaaaauccuuggcauauaugacgaucguccaaauaaccaagaaaaauaaaguauccuacaggguaauaggaauacccacgcucgcccuugcccgacuaaacaaacucgaaaaugauaguacagaaaauaauggagaacuauauaaaauaauaaaaccacaauucacacacuacaaaguagacaagaaaaauggagaaauuauugaaacaacagaugacuucaaaauugucguguccaagguaagguuccaacaauuaauagacgacgccggacaauuuuucaugcuagccucagauacauauaaaaacaaugcacaacaguuaguuaucucaaauaaugcguuaaaagcaauaaacaauaccaauaucacagauuguccacgagaugaccuagaaagacuagauaaccuacgucuugacucagccuucgaugaaauagucaagaaaauggauaaauauuucucagcuuacgacgcuaacaauuucagagagaaaauacguaauaguaaccuaauauuuuaucaacuaccaguagaggaccaaugggaaaacaacaaaauaacagaacucggcaaacgcacugucuuaacucgcauucuucaggggcuucacgcaaacgcaaccacaacugacaugucuauuuuuaaaauuaaaacuccauuuggacaauuaagacaacgaucaggaauaagccuuucugaaaaugcucaauuaauauaccaaucuccaacaggauuauuugaaagaagaguccaauuaaauaagauuaaauga

SEQ ID NO: 5518 - RNA, 4140 nt, Artificial Sequence
  Cas9 variant
augaaacaaauauuaggccucgaucuaggaacaacuucaauaggaugggcauugguucgugaagcugaaaacaaagaugaacaaucaucaauaguaaggauugggguucgaguaaauccgcugacaucagaugaacaaaaaaauuucgaacaaggaaaaagcauaacaacaaaugcugacagaacacuuaaacguaguaugagaagaaacuuacaacgauacaaacuaagacgugaucaucuaaaagauugccuacaaaaaaaugggauaauaaccgauaaagcaguauuaucagagaacggaaacuacacaacguuccaaaccuacuauuuaagagcaaaagccguaaacgaaaaaauaucauuagaagaauuugcacgaguucuacuaaugcucaacaagaaaagaggauacaagagcucaagaaaaaugaaaucugcagacgagggucaauuaauagacggcaugucuguagccaaaagacuuuacaaugacaauauuacgccaggucaauauguacugucucuacucgaagaagguagaaaauacauaccggauuucuacaggucagaucucuuagacgaacuugauaaaauauggacguuucagcaaugcuuuuacccagaaauauuaaccccugaguguagaaaacuuauagcagguaaagguaaacaagcaacagcaaaaauuuucuugggaaaauauaaaauauauacugcagacaacaaauccaaagacaaacgauuacaagcuuaccaauggaggguagaagcacucucaggacaacuuccaauagaaguaguagcauuugucgugugcgagauaaacggggcuauccaagcauccagcgguuaccuaggagcaauuucugacagaagcaaagagcuauauuuugaaggacucacaguaggacaauaccuagucaaacagcuugaaaaaaaucccgacacuucacucaaaaauaaagucuucuaccggcaagauuaucuaaaugaauucgaaaaaauaugggaaaaacaagcagaauaccacacagaacugacaccgcaacuaaaaaaagaaguaagagauauaauaauuuuuuaucaaagaacgcuuaaaucacaaaaaggucucguagguuucugugaauuugaaagccgccaaauagaggugaugauagauggaaaacuuaagaaaaagacaguuggcugcagaguaugcccuaaaucaucaccuuuauuccaagaauauaagauauggcauaaccuaaauaaccuuaaaauaguagaaaaagaacuugggaaaucuagauuccucaaucaagacgaaaaagaaucacuauuccaagaacuaaacauaaaggaaaaauuauccaaaacagacauacuaaaacuccuauguuuaaaagcaaaagaauucgauuuaaacuuugagaaaguagaagggaaucgaacucaagcagaauuauucagagccuaccaggcuauaauagaaaugucagguaacggcgauuacgacuucucaaaaaugacgucaagcgagauccaagauacagucacagguguuuucagaggauuaggauacaauacagacauacuauccuuugacgcagaaaaagaagagaaaacauuugacaaacaaccgauguauuuauuguggcaccuacuauacucauacgagggagauucaucagauacaggcaacaaagcccuaaucacuaaaauuaaaaaauuauguggauuugaaagugaggaauaugcaagaauacuuacugacguuacauuccaaucggaauauggaaacuuaaguaccaaagccaucagaagaauacuuccuuucaugaaaaaaggaagugaauauagcgaagcaugccgacaugcaggauaccgucauucagaaagaagccuaacaaaagaagaguuagacaaaaagguuuacaaagaccaccuagaauuguuaccaagaaacucacuacgaaauccaguaguagagaaaauucuaaaccaaaugauacacguagucaauacaguaguggauacuuauggcaaaccagacgaaauucggauugaauuagcacgugaacuaaaaaaaucagcaaaggagagagacgaaaugacagcauccauaaacaaaacagcagcagaacacaaaaaauacugugaagugcuccaaaaagaauucggauucacgcacgugaguagaaacgauauuauaagguauaaacuauaucuagaacuugaaaauaacggauauaaaacacuauacucagauaccuauaucccacgagaaaaauuauucucuaaggaauucgauauagaacauauaauaccacaaucaaaguuauucgacgacuccuucucaaacaaaacguuagaaugucgauccguaaauauagaaaaaaguaaugauacugcauaugauuacguacuuaacaaauauggugaacaaggaauauuagauuauaaaaacaggaucgaaaauuuauauaaggacucuaagauuaguagaaccaaauaccaaaaauuaaugaugaaaaacagugauaucuccggaaauuucauagaaagagaauuaagagauagccaauauauagcaaaaaaagcaagggaaauuuuagaagaauuagugaaauucguaguuccaaccacaggcucaguaacagcaagauuacgagaagacuggcaacuagucgacguaaugcaagaacuuaauuggaagaaauacgacaaauuagggcuaacagacguacguuaugacaaagauggcagagagaucagauacauaaaagacuggucaaaaagaaaugaccaucggcaccacgcaauggacgccuuaacaauugcauuuaccaagagaagcaucauccaauaccuaaauaacuuaaaugcaaaaagugacaaaucugguucaauauaugcgauagaacaaaaagaacuuuuucgcgacaaaaggggcaagcuuaaauuuauaccucccaugccauguaauauauuuagagcagaagcgaaaagacaucuugagaauguuuugguaucugugaaagcaaaaaacaaagucguuacaccaaauaucaaccgaagcaaaggaaaaaacggaaucaauaagaaaauucaacuaacaccacguggacaguuacacaacgagacaaucuacggcucgaugaagagauacgaaacgaagugggaaaaaaucggaaguggguucgaugagcgacaaauugcuaaaguagcuaacaaaaaauuuagagaagcauuauuaucaagacuagcagaauucggcaaugacccacaaaaagcuuuuaccggaaaaaacagucuggagaagaauccauuguaugucgaugaguuacacacucagaaaguuccggaaaaagucaaaauaguaacucuagaaaacuuauacacaauacgcaaggaaauuacaccagaccugaagaucgauaaaguaguggaugcaggggucagacgaguacuacaagaaagacuagacgaauucgacgacgauucaaaaaaagcauuuucuaaucuagacgaaaacccaauaugguuaaacggaaaaaagaugaaacggguaacaauaaugggcguauccaacgcaguaccuuugcacgacaaaaaagauuacaaaggcaauuuaguauucgauagcaaagggaggaagcaaccaguagauuuuguaaauaccggaaguaaccaccauguugccauauaccgagaugaaucaggagaacuacaagacauuguaguaagcuucuaugaagccacaacacgaucgacuuuagggauccccguaauagauaaagaauacaaaaaagcagaaggauggaacuuucuuuucucaaugaaacaaaaugaauacuucguauuuccgaaugaggaaacagguuuuaauccuaaagaaauagauuuaaugaauccagauaacuauacuacaauaucuccgaaccuuuaucgaguccaaaaauuuuccaaauguauguauggaaauagcagugugcgagaauacgucuuuagacaucaccuagaaacaagcgugaaugacaguaaaggauuaaaaaacauugcauacaaaaauguaaaaaguuuaguauaccucgaaggaauagucaaaguaaggauuaaccauauaggacaaauagugagcguaggagaguacuga

SEQ ID NO: 5519 - RNA, 4140 nt, Artificial Sequence
  Cas9 variant
augcgaauagauaacggacucgaagaauuaaaaguaaacaacagaaucuauaauaucggcuuagauaucgguacaucuucagucggauucgcuguaacagacgcccaggauaaauuaguuagagucaaaggaaagacugcuauaggcguacggcucuuugaagaaggccauaccgccgcagaacggagaggcuucagaacaacacgaagaagauuaucacgcagaaaauggagaauaaacuuacucaaucaaauauucgaaccauacauaagcgaaauugacccuacuuucuuugccagauugaaaaauagcagcuuagccgguaaagauaagaaauuugaaggaucucucuuauucccggaucgaacagauuaucaauucuauaaagacaacccgaccauguaccauuuacgcaaacacuuaauggaaaaagacagacaauuugaucugcgagaaauauaccucgccaugcaccauauuauaaaauacaggggaaauuuccuaaauacaacaccaaugaaccacuuuaaaaaugaagaaaucgacuuuagcgccuuauuuucuagacuaaaugaacuuuaccaagaaaucgacgacgaaaauaucuuugaacucaauauagagaauguugaugaaauuaagaaaauauuauuaaaccacgaccuguucaaaauggaaaaacagaaacaaguugcgaaacuuuuaaauguugacaccgaugacaaacaacuaaagaaagaaaauacugcguuagcaagcaauuucagcaaagcaauucuaggauacaaauucaacuuagcucuaguaacaaaaauaccugaucaagacaagaaagaauggacaauuucacuaggagacgaagacuucgaugacagauuagacaacguaccaguagcacucaccgaaucacaacuagaagucguagagguauuacauucgauauucaacucaauaucacucaaugaaauagucgaaaacggagaaacacucuccagugcaaugguaagaaaauacaacgaucauaaacaugacuuaaaacuucugaaaaauguaaugacgacucucgaagauagaaagaaagcuaagaaaauacaagguauauacaacguuuuuguugguaaagauacugaccuaaucucggauaaagacaaaaacaaauacaaagacaaagaugaguucuauaaagaaauacagaaaaacuuagacaauuccagcgacgccgaagaaauuauaaaaagaauaaaacaagaccaauucuuacccaaacaacgaaccagcaaaaauggaguaauaccccaccaacuccaucaaagagaacuagauuuaauuaucgaaaaccaagcaaaauacuacccuuuucucaaagaagcaaacccuaacaagaaacgacuuaaacaagccaaauacaaacuggaugaacuuaucgcauuuaaaaucccauauuauauuggcccaaccaguggagcugaaaauucggauuuuucauggcucaaacggaagaaagacgggcaaauuacaccauggaauuuugaugaaaaaguagaccgaaucgaaucagccaaccgauucaucagacgaaugacgacuaaagacaccuaccuucucgcagaagacguacuuccauuagaauccuugaucuacgagaaauacucaguccucaaugaguuaaauaacguccgaaucaauagacaaaaacuaucaguaaacgauaaacaagauauuuacaaugaacuauucaaaaacucuaaaacaguaacacuaaaacaauuacaaaaauacuucgaagucacaaagaaauuaaaaacggucgucgucgaaggcuuagcagacccgaagaaauuucugaguaacuuagguacauaucaugacuuuaaauuaauauuuggagacaucgucgacgaccccgaauaucaaacagaccuagaaaacaucauagaauggagcacuauuuuugaagauagaggaauauuuaauaguaaauuaaacgaaauaacuugguuaacagacgaacaaaggaagaaaguucuaucaaaaagauaucaagguuggggcagauucagcaagaaacuauuaguuggacuuaaaaacucucaaggcaacucaauacuggacgaauuauggaacacaaaucucaacuuuaugcaauuacaaagccaagacgacuuugcugaauuaauccacgcagaaaaugcuaaacaauuuaaagcaaacgaucccgacaacccauggaacggaauagacgcuauacuaaaugaugcauacaccaguccacaaaacaagaaagcgauaaggcaaguagucaaaguaguacaagauauagaaaaagcuaugggaaauaaaccacagaaaauagcaauagaguucacccgaagcgccgacaaaaauccuagacguaccgauagcagaauaaaaagauuaucagauauuuacaaagaagcagcagaaaaaguaguaggagaaucgcuaaaauuagaauuaaacgaauaucuaaccucuaaaaagaaaaugacagacaaaauguaccuauauuucacccaacucggaaccgauaucuauaccgguaagaaaauagauaucgaucaacuaaacaauuaugauauagaucacguauuaccccagagcuuucuaaaagaugauuccuuagacaaucgaguccuuaccaacagauccgauaauagcgaaaaaucagacacagucccuuuacacaaauuuggcgcaaaaaugggcaacuucuggagacaacucgcugacgaaggauuaaucacaaaaaggaaauacaaaaaucuuacuaccgaccccgcuacaauugacaaauauacuauacaaggauuuauucgacgacaacuuguugaaaccagccaagucaucaaauuaacagcgaauauauuaggcggccuuuacccagaagaaacagaaauucucgaaauucccgcaaaacuaaaccaccaauuuagagauauguucgaccucguaaaagugcgugaagugaaugauuaccaccaugcauuugacgcuuacaucacaguuuuuguaggaaauuuucuauaccgaagguaccccaaauuaagaaguuacuuuguauacggagacuuuaagaaacuuaauaaaaccgacgacgauauuagaaaauucaauuuccucaacuuauuuaacaaagauaaaguugaagauaaugaaacagaugaaaucuuauggagcaaagccgaaucaauucgagacauuaaaaacauauauaauuauaaauuuaugcucguaucacgcgaaguauauacacgacacggugcuauguucaaucaaacuauuuacccagccucuaaaaaugauucaaagaaacuaaucccaauuaagaaaggaaaagacacugcaauauacggaggauauagcgguaacaccgacgcauacauggccauaguagcaguagaagacaagaaaggagaaaaauuuaaagucgucgguguaccaacuagagcaguaagcagacuugaacaacuagcugcagacgaucaugaccaauaccuaacagcacugcacgacguucuaaaaccaaauuucaccaaaaucaaaacaaauaggaaaacaaaagccaaagaagaagucacuacaccuuuccgaauacuuguaggaaaagugggauaccgacaacuaauacaagacggccaaguaaaaaugauguuagggaguucugccuauaaauacaacgccaaacaauuaguacuaagugagaaaucauuaaaaguuaucaaaaacaauaagaaauauaacccugaugaugaaaaucaagaccuaauagacguauaugaugaaauauuagguguagucaacagggccuucaaucucuacgacacaaacggauuuagaaagaaacucaaugauaaccgagucaaauuuguugaacucccaauuaauaacauauuugacggaacaaaauuaguacaaaugggaaaaagagcaguauuaacacaaauucuuaacggacuucacgccaaugcagcauuaggugacuuaaaagcguuaggaaucagcacaccauucggcaaaaugcaaaguaaauccggaaucccacuauccauggaugcaagccuaguauaccaaagcccaacuggccuauucgaaagaaaacuaaaccuuagugaccuauga

SEQ ID NO: 5520 - RNA, 4140 nt, Artificial Sequence
  Cas9 variant
augacuaagaaaaauuacuccauaggauuagauauuggaacaaacaguguuggaugggcuguaauaacagacgacuacaaagugccagccaagaaaaugaaaguacuagggaauacagauaagaaauauaucaagaaaaauuuacuaggagcacuucuguuugacucaggagaaacagcugaagcaacaagacuuaaaagaacugcucgucguagauauacgcgaaggaaaaaccgacuuagauauuuacaagaaaucuuugcagaugaaauggcaaaagucgaugagagcuucuuucaaagauuagacgaauccuuccuucgaugggacgacgauaauaagaaauugggacgauaucccaucuuugguaauaaagccgauguuguuaaauaccaccaagaauuucccaccaucuaucaucuaaggaaacauuuagcugacagcagcgaaaaagccgaccuacgucuaguauauuuagcauuagcgcacaugauaaaauuccgaggacauuuccuaauagaaggagaacuaaacgcugaaaacacagacguacagaaaauuuucagugacuucgucagaguauacgauagaacguucgaugacucucauuugucagaaauuacagucgacgcagcaucaauacuaacagagaaaauaucaaaaaguagaaggcuagagaacuuaauuaaauacuauccaacugaaaagaaaaacacacuauucggaaacuuaauagcacuagcucuaggccuccaacccaacuucaaaaugaacuucaaacucagcgaagaugcuaaacuacaauucucuaaagacuccuauaacgaagacuuagaagaacuauugggaaaaauaggugaugauuaugcagaucuauucacgagcgcgaaaaaucuauacgacgcuauauuacuaucaggcauacuaacugucgacgauaacagcacaaaagcgccccucagugcaagcaugauuaaaagauacgcugaacaucacgaagaucuggaaaaauuaaaagaauuuauuaaagcaaacaaaagcgaacuauaccaugauauuuucaaagaugaaaccaaaaacggcuacgcaggauauauagaaaacggcgucaaacaagacgaauuuuauaaauaucucaaaaacacguuaucuaaaauagcaggaagugauuacuucuuagauaaaauagaacgugaagauuuucuaagaaaacaaagaacauucgauaacggcucuauaccacaucaaauacaccuccaagaaaugcacgcaauccuuagaagacaaggcgacuacuacccguuuuuaaaagaaaaccaagauagaauugagaaaauacucacuuuccgaauaccuuacuaugucggaccauuagcaagaaaagauagcagauuuucgugggccgaauaucauucagacgagaaaauuaccccauggaauuucgauaaaguuaucgacaaagaaaaaucggcagaaaaauuuauaacaagaaugacacuaaacgauuuauaccuuccggaagaaaaaguacuuccaaaacacucacacguuuacgaaaccuacgcaguauauaacgaacucacaaaaauaaaauauguaaacgaacaaggcaaagauagcuucuuugacagcaauaugaaacaagaaauuuucgaccacgucuucaaagaaaacagaaaaguaacaaaagaaaaacucuuaaauuacuugaacaaagaguucccagaauacagaauuaaagaccucauaggacuagacaaagaaaauaaaucauuuaacgcaagccuaggaaccuaucacgaucuuaagaaaauacuagauaaagcguuucuagacgacaaagucaacgaagaaguaauagaagauauaauaaaaacuuuaaccuuauucgaagauaaagauaugauacacgaacgacugcaaaaauauucagacauauucaccgcugaccaacuaaagaaacuagaaagaagacauuacacaggauggggacguuuaucguauaaacugauaaacggaauaaggaacaaagaaaacaacaaaacuaucuuagauuaucuaauugacgacggcucagcuaauagaaauuuuaugcagcuaauaaacgacgacacauuacccuucaaacagauaauccaaaaaucacaaguaguaggagacguugaugacaucgaagcgguagugcaugaccuucccgguucaccggcaaucaagaaaggcauucuucaaucuguaaaaaucguugaugaauuaguaaaaguuaugggugauaauccugauaacauaguaauagaaauggcgcgugaaaaccaaaccacaaauagagguagaagucaaagccaacaaagacuaaagaaauuacagaacucacucaaagaacuuggaucuaauauacucaacgaagaaaaacccucuuauauugaagauaaaguugaaaacucacauuuacagaaugaucaacucuuccuauauuacauacaaaacgguaaagauauguacacgggagaugaacuagauaucgaucaucugucagauuaugacauagaucacauaauaccacaagcauuuaucaaagacgacuccauagauaauagaguacucacaaguagcgcuaaaaacagagggaaaagugacgacgucccaaguuuagauauaguacgagcccgaaaagccgaauggguaagacuuuacaaaucaggcuuaauaaguaaaagaaaauuugauaauuuaacgaaagccgaaaggggagguuuaacagaagcggauaaagcgggcuuuaucaaacgacagcuagucgaaacuagacaaauaacaaaacauguugcacaaauucuagaugcaagguucaauacggaauccgaugaaaacgauaaaguaauuagagauguaaaaguaaucacauuaaaaagcaaccuaguaucacaauuucguaaagacuucgaauuuuacaaaguaagagaaauaaacgauuaccaucacgcacacgacgcauauuuaaacgcgguaguaggcaccgcauuacucaagaaauauccaaaacucgcgagugaauuuguauacggugaauauaagaaauacgauguacacaaauuaauagcaaaaaguucagacgaucauuccgaaaugggaaaagcaacagcaaaauacuuuuucuacagcaaccucaugaacuuuuucaaaagaguaauccgauacucaaacgguaaagucaucguacgaccaguuguggaauacucaaaagacacagaagauauugcaugggauaagaaaucaaacuucaggacaauauguaaaguauuaucuuacccacaaguaaauauugucaaaaagguagaaacacaaacuggcggauucucaaaagaaagcauacuuccuaaaggggauucagacaaacucaucccacguaagaccaagaaagcauacugggacacuaaaaaguauggagguuuugacaguccaacaguagcauacaguguauuuguaguagcagauguagaaaaaggaaaagccaagaaacuaaaaacaguaaaagaacucguaggaauuuccauaauggagagaucuuucuuugaagaaaauccaguagaguuccuggaaaauaaagguuaccauaauauaagagaagauaagcuaauuaaacuaccaaaauacucucuauucgaguucgagggaggcaaacguagacuauuagcaagugcaucagaauuacagaaaggaaacgaaaugguuauacccggacaccucgucaaacuacuauaucacgcacaaagaauuaauucauucaauaguacaaaauauuuagacuacguuucugcccacaagaaagaauuugaaaaaguauuaucauguguggaagacuucgcgaaucuguaugucgauguggagaaaaaccucagcaaaauccgagcuguagcugauucaauggacaauuuuuccauugaagaaauaucaaacaguuucauuaaucuauuaaccuuaacagcgcugggagcccccgccgacuuuaacuuccuaggagagaaaauccccagaaaaagauauacgaguacgaaagagugccuuaaugcuacauuaauacaccaaucaauaacgggauuauaugaaacuagaaucgaccucucuaaaauaggagaagaauga

SEQ ID NO: 5521 - RNA, 4143 nt, Artificial Sequence
  Cas9 variant
augggaaaauacaaccuuggacucgacauaggcacuaauucaguaggcugggccguagucgacgaaaacaaccaaauagugaaaaaaggaggaaaagcccucuggggggucagaauguuugacgaagcgcaaucagcuaaagaaacacgaauauacaggaacagucgacgaagaaucguccgacgaaaucaaagacuacucuuauuacaaaaagaauucuacgacgaaauaauaaaaguagaccaaaccuucuuucaacgccuaaaagacagcuucuuuaaaaaagaagacaaauuaaacaaaaauaauuauaccuucuuugaugaugacauuacagauagagaauacuucaaaaaauuccccacaauauaucaccuaagaucacauuuacuauacaaugacgaaaagaucgacauuagaauguuauaucuagcccuccaucacaucgucaaauaccguggacacuuccucgacuccggcgaggucaaugaaucaaacuucagcaagauaaaagacguccuagauacauuuaauaauaaaaugagcgaaaugucacucgaauuugaagacaacgaagacuacuucuguaaaauagaauucgacgaaaauuuugagaacaaauuaaaagauaucaugcucucgcaacucagcaaaaaagaaaaacgacaagaacuaaucgauuuauuuaaaguagacaaaaagucauuagucaacgaacuacuaaucgaacuccuagucaacaaaaaaguaaaacuaaacuccuuaaguaucaccaacgguaaaaaauacgaaguaugugaaauagacuucgaaaaagaagaacucuucgaaaaauuagaagaugcgaagaaaauaauaaccgaauuauucgacauccucgacgaaauuguuaauauaaaaaaaauaguugacuauuauuauguacucaaaauaauaggagacaacgaauacuuauccgaagcaaugguaaaaaaauaugacaaacacgacaaagacuuaagagaacucaaaagcuucaucaaaaccuacugccccaauaaauacuaugaauguuucagaaaaacgucuaaccccaaucuuugcaauuaccccaaguaugucggaauaaacucugucaacaaaaaaauagaacguuucgcacacuguaaaaaagaagaauuuuauaaauaucuuaaaucuuuguucaauacaauaaaagaugagaacgcaaaauuaaaaaucgacuuauuccaaaaagauauggaaaaugacgauuuccuaaauaggcaaaacagcaaccacaacagcagcaucccaaugcaacuaaacuuuugugaacuuaaaaaaauacuagaaaaccaaucuaaauauuacccauuuuuaaugcuaaaaaacuccgacggcuacuccacauccgacagaauaaucgcaaucuucaaauacaagauaccauacuaugucggaccccuuaacaagaacuccaaauacagcuggcuuguaaaaaaaaguaacgaaaacauaaccccuuggaacuacgaaaagguaauagauuuagaugcguccgcaaaagaguucauacaaagaaugcaaaacaaaugcacauaccuuaaaggggaaaaugacuacugucuucccaaaaaaucaauacuauuuucagaauacaacugccugcaauacuuaaauagacuaauaauaaacggggcacucaucgaaaacaaacuaaaaaacgagauauaugaaaacaucuuccucuguuauaaaaagccaacaaaaaagagcauaguugaauaccugaaaaccaauuacaacuaugacgaaaccaccuugaaaagcaauauacucgaagugaauugugacaugucgaguuauauccaauuuaaagaaaucuacggugaggacuucgaacaaaaccuaaacauagucgaagacaucaucaaagacauaacuauauuugaagacaaaaaaauauuagaaaagagacuacgagaaauauaucaucuauccgaagacaagguacaaaagauaaaagggcucaacuacaaaggcuacgcuacccuaucaaaacacuuuuugaauaauuucuacuccguaaacgaagagaccggagagauuuacggaccaaucauacaaauaaugcgagacacaaacuauaaucugcaacaaguaauuuacaacgaccgauauaauuucaugaaagcaauagacaaauacaauaaaaaaaacuuagacacagaaaaaaaacucaacgugucugauuuuauagacgaguauauauauguaucuccgauaaugaaaagaagucucauacaauccuacaacaucauacaagaacuggaaaaaauccuaggcgagucuauuagcaaauacuacauagaaugugcaagagugcgcagcaacucuaaggacguuaucaauagcagauaucgacaacuauccgaacuauacaaagacugugaacaccaaguaucugacauaagcaagaauuacauuaacauaaauaaauuaaaaaaacaacuagaagacaauaagaacgaacuaagggcagacaaacuuuaccucuacuucacacaauucgggaaaugcauguacacacuaaaagacaucgaccucgacgacgucuucuugggcaaauaugacauagaccacauauacccccaaagcuuaauaaaagaugacucacuuaacaacagaguucuugcaagcaaagaaaaaaacggaaaaaaagacaaucaauuuauauuuaacaucccagaauuccuucccaaaaaugcagagcucuucuauaagaaacuccuugaaugcaaguuaauaacuaaagaaaaguaucgcagacuaaccaugaaaaaaauagacgacgaugaacuagacauauucguaaauagacaacuaguagcaacgaaccaaucagucaaaggauuaguggacguacuaaaaauauacaaaggaguaaagccaacuaauauagucuauucgaaagcugucaacauauccgacuucagaaauaauuauaaccuauauaaaucaagaacagcaaacaauuaucaucaugcucaugaugcguauuuaaacguagucauuggaaaagcccuugacguauacuaucaaugcaacuacuuccaaaauuauaaggacgucaucaaacuaaaagacaggaacauuaccauaaacccagaaauaauacuaucaaaaaauagauacguaaauagaaauggcgagaaaaaaguaauuugggaccucgauaacacacuaaaacuaauaaaaaauaauuuauacaaucguuuugacauaaccgaaacaauuaugacaagaaaaucuaauaaaauguuuucaaaaagcuccaucucaccugcuaaaaauucaaaaaaucuaauuccgauaaaaaccuccgauccccgauguaacgucuuaaaauauggcggaauaaaaucaaauuccuacaacuuuuauugcauaguugagcucuacgacaagaaaggaaagaaaucauacauccuagaagcaaucccaaagacucacucagauaaguuggaagaauauauaaagaauucuauagacgaaaaaaacguaucaaauuucaaaauaauaaacaaaaauauuaaaaguaauauaauaauagaauauaaaaaacugcgcuacguaauaaccggcaaauccggaaaauacuaucuaauuaaaaacuucaaagaccggaauuuuucauauaacgccaucaaaaccauaaaauauauugagaaauacaacuaccaaaaaaaauacgaaauuccauuugaagagacuaaagaaaaaauaauauuagcccccaaaaaaaaagacacgaaagaaauuucacuaacccuagacaacugucaggcacuacucgaugaaauaauuucacuguucaaaaaagacauauauaacuaugacaucauauacaaaaucaccagcaaacuagaagaaaauaaacagaaccuaacgcuuacaaaccuaaucaaaguguuaacugaaauuuuaauacucuuaaaaacaaaugaacgcggaacagcagaccuaacacuuauagacaugagcaaagauacaggaacacuaugcaucuccaaaacauuaaaaccagguaugaaguucauuucagaaucaccaacaggauauuaccguaaaauaauauucgaaguuccaaaugggaucuga

SEQ ID NO: 5522 - RNA, 4143 nt, Artificial Sequence
  Cas9 variant
augaaaagaauacuaggcuuagaccuagguacuaccaguaucgguugggcacuugucaaugaagcugaaaacaauaaugaggcgaguaguauugucaggcuagguguacgcguaaaccccuuaaccgucgaugagaaaagcaacuucgaaaaagguaaagcuauuacaacaaaugcagaucgucaauuaagacacggagcuagaaucaaccuacaaagauauaaauugaggagacagaaccuucaugauugucuacaaaaacaaggaugguuagguacggaagcaauguacgaagaaggaaaagcaaguacguuugaaacauauaaacuacgugccaaagcggccgaagaagagauuagcuuacaugaguucgcacgaguauuauuuauguuaaauaagaaaagaggcuacaaaaguaauagaaaagcuaauaauaaagaagacggacaacuauucgaugggaugacuauagcaaagaaacuuuacgaggaacaccuaacccccgcagaauacucuuuacaauuacuaaacaaaggaaagaaauucacucaggguuauuaccguagcgauuuaaaugccgaacucgaacgcauuugggaugaacagaagaaauauuaccccgaaauacuaacagacgaguucaaacaacaauuagaaggaaaaacaaaaacgaacaccaguaaaaucuucuuagcaaaauauggaauauauagcgcugauuuaaaaggacuggauagaaaauuccaaccauuaaaauggagaguagaagcacuacagcaacaaguagacaaggaagugcucgcuuuugugaucagugaccuaaaaggacaaauagcuaauacgucaggcuuacuuggagcuauaucagacagaaguaaagaacuauacuucaacaagcaaacugugggacaauaucuuugggcaucacuagaagaaaacccgcauauuucaaucaaaaacaaaccguucuacagacaagacuacuuagacgaauuugagaaaauaugggaaacacaagcagcauuucauaaacaacuaacgccggaacuuaaacaagaaauaagagacauaauaauauuuuaccaacgaccguugaaaagcaaaaagagucuaauuucaguaugcgaacuagaacaaagaaaaguaaaggcuaccauagacggcaaagaaaaagagauaacuauaggaccuaaaguagcgccuaaaucauccccaguuuuccaagaguuucgaauauggcaaaauuuaaacaacguccuauuaaucgauaaugauacaaaugagaaaagaccacuagacgaagucgaaagaaaucuacuauacaaagaacuuucaauaaaagccaaacucaguaaaacugaagcacuaaaaauacuaaacaaaaagggcaagcaaugggauuuaaacuacagagaacucgaaggcaauagaacacaagcaauucuuuucgacugcuacaacagaaucauuacacuaacaggucacgaagaaugcgacuuuaagaaaaucaaagcgagcgaaaucagacacuauguaaguacaauuuucaaaaaccuuggcuucaguacagaaauauuagauuucgauccgagcuuaaagaaacaugaacuagaaaaacaaccaauguaucaacuuuggcaccuacuauauucuuacgaaucugauaacucuagaacgggaaaugaaucuuuauuaagaaaauuagaaacaacuuuuggauuuccagaagaauacgcuacaguacugugugauguaguauuugaagaagauuauggaaaucugucugugaaagcaaugcgagaaauacuuccauauuuacaagcagggaacgauuacagucaagcaugugcauacgcaggauacaaucauucgagacauucacuuacaaaagaagaacucgaucaaaaaguauacaaagaacgccuagaacuauuaccuaaaaacucauuaagaaacccaguaguagagaaaauauuaaaucaaaugauaaacguaauuaacgccauaauagaugaauacggaaaaccagacgaaauuagaauugaaauggcucgagaauuaaaaagcucagccgcagacagaaagaaaaccacacaugcgauuucgcaaggaaacgcugaaaaucaacgcaucagagaaauacuagaaaaagaguucucuuugagcuacauaaguaggaaugauaucaucaaauauaaacuuuaugaggaacuagaaccaaacuacuacaaaacacuuuauagcgacaccuacauuacuaaagauaaacucuucucaaaagacuuugacaucgaacauauaauaccgaaagcaagauuauuugacgacuccuucucaaauaaaaccuuagaagcacgcaacauaaauuuagaaaaaucuaauaaaaccgcauuugauuucauaaaagaaaaauacggugaagacggcgcagaagcauauaaaaagaaacuagacaugcuguuagaaaaugaugcuaucagcagacccaaauacaacaauuuauuaagggcagaagcugacauaccuucugauuuuaucaaucgagaccuaagaaacacacaauauaucgccaagaaagcgugcgaaauucuaggugagcuaguuaaaaccgucacuccaacuacaggcaaaauaaccaaucgacuuagagaagacuggcaauuagucgauguaaugaaagaacuuaacuuugaaaaauaugaaaaacucggccugacagaaauagucgaagaccgagauggaaggaaaauaaaaagaauaaaagauuggacaaaaagaaaugaccacaggcaccaugcgauggacgcacucgcaaucgcauucacaaaaccaucauucauucaauacuuaaauaauuuaaaugccagaagcaauaaaggagauaguauauaugccaucgaaaacaaagaacugcauuaugaagaaggaaaacuacgauuuaaugcaccaaucccagucaacgaguuccgagcagaggccaaaaggcaucugagcgcuauucuaguaagcauaaaagccaaaaauaaaguuaugacacaaaaugucaacaaaauaaaaacaaaacacggcauuauaaagaaaauccagcuuaccccgcgcggaccacugcacaacgaaacaauauauggcaccaaaaugcgacccauaaucaaaauggucaaagucggagcagcacuugaugaagcaacaauaaauaaaguaaguucacccgcgauccgagaagcucuguuaaaaagauuaaacgaauacucaggcaacgcuaaaaaggccuuuacagggaaaaacacacuagagaaaaauccuauauaccuaaacgcaggaagaacuaaaacaguacccagucuaguuaaaacuguggaaugggagagcuuccacccaacaagaaaacugauagacaaagacuuaaauguugauaaaguuguagauaaaggaauaagagaaauacuaaaagccagauuagaagaauuuaacggugaugcaaagaaagcauuuaguaaccuugaagaaaaccccauuuaccuagacgaagcuaagaaaauagccuuaaaaagagucucaauagaagggguccucucagcaauaccacuucacaccuugaaaaaucaggccggaaaaccaauaacagguaaagauggaaagccuguauuagguaauuacgugcaaacaucgaauaaccaccacauagcguuuuauuacgacgaagauggaaacuuacaagacaacgccguaucauucuuugaagcugcugaacgaaaaagccaggguaucccgguaaucgauaaagacuauaacagagauaaaggauggagauuucuauuuacaaugaaacaaaacgaauauuucguuuucccgaacgaagccacgggauuuauccccagugaaguggacuuaacagacgaagcaaacuacgggaucauaaguccaaaucuguacagaguucaaaaggugucacgaauagacaaaggaaccucagccucaagagacuacugguuuagacaucaccuagaaacaaucuuaaacgacgacgcaaaauuaaagaaccuagccuuuaaaaggauaagaggcuuacuagaacucaaagacauaaucaaaguacggauuaacagcacaggaaaaaucguggccguuggagaauacgacuga

SEQ ID NO: 5523 - RNA, 4143 nt, Artificial Sequence
  Cas9 variant
augaaaaagauacucgggcuagaccuaggaaccacaucaauaggaugggcccuggucaaugaagcagaaacagaaucggaaaaaucaagcauaaucagacugggaguaagaguaaauccacuuacuauagaugaaaaaggaaauuucgaaaaaggcaaagcuauaacaaccaauagcgaccgucaacaaagacacucagccaggauaaaucuacaacguuacaaacugagaagacagaacuuaugugacugccuccagauaggcggcuuauuaggauccgaaucaauguaugaagaagguaaagaaagcacuuuugaaaccuacaaauuaagagcaaaagcagcgacggagaaaguagcacuccaugaauuugcaagaauacuauuuaugcuaaauaagaaacguggauacaaaaguaacagaaaagcaaauucgaaagaggacggacaagcguuugauggaaugacaauugccaagaaacuauaugaagagaauuuaacacccgcagaauauagucuccaauuacuaaacaaagggaagaaauuuucacccuccuauuaucgaagcgauuuagaauccgaauuaaaccguauuugggaagaacaaaagaaauauuacccagaaauacugacagaugauuuuuaccaacaacuugaaggaaaaacaaaaguuaauacuacgaaaauuuuucucgcuaaauacgguauauacacggcagaccuaaaaggacuagauaagaaaaugcagccauuaaaauggagaauugaagcacuuaacaaacagguugauaaagaaguccuaacauucguaguaucugacuuaaaagggcaaauagaaaagaccagcgggcuuuuaggggaaaucucagacagaucgaaagaacuauauuucaacaaacaaacuguaggacaauauguaugggcauccuuaaaagagaacccccacgugagcauuaaaaauaaacccuucuacagacaagacuaccuagacgaauuugagaaaauaugggaaacacaagcagcauuucacaaagaacuaacaccagaacugaagaaagaaauacgcgacauaauaauauucuaucaaagaccacuaaaaaguaagaaaggauuaauaaguauaugcgaauuagaacagaagaaagaaaaaguaauaauagaggguaaagaaaaagaaauauuaauugguucaaaagucgccccaaaaucgucaccaauguaccaagaguucagaaucuggcaaaacuuaaauaauguacuauuaauagauacagaaauaaacgaaagcagaccgcuagaugaagaagaaaaagcacuacuauacaaugaacuaucaguuagagccaaauuaucagaaacagaagcguuaaaaacaaucaauaagaaaggaaaacauugggaucucaacuuuaaagaacuagaagguaauagaacucaggcaguucuauuugaaugcuacaauagaauaauaacucaaacuggacaugaagaauguaauuuuaagaaaauaucagcagaagacaucagacauuacguagcuacaauuuucaaaaauuuaggauuuaauacugacauauuagacuuuaauccuagcuuggaaaaacacgaauuagaaaaacaaccaauguaucaacucuggcaccuauuauauucauaugaaucagauaaaaguaggacggggaacgaaaguuuacugaacaaauuagaagcaaacuuuggcuucccacaagaauaugcauccguacucgcagaugcgacuuucgaagacgauuacggcaauauaaguguaaaagccauaagaaaaauucuuccacacuuacacgacgguuacgauuauucagaagcgugugaacgagccggauacaaccauagcguacguagucuaacgaaagaagaauuagcccaaaaaguauauaaagacagauuagaucuuuugccuaaaaacucacucagaaacccagucguugagaaaauccuaaaccagaugauaaacguaaucaacgcuauaauuguagaauauggaaagccagacgaaaucagaaucgaaauggcaagagaacuaaaaagcucagcagcaaaaagagaagaaagaacuaaaucaaucaaccaaaacgcagcggaaaacaaacgaaucacagaaauauuacaaaccgaguucggcuuguccuauauuagccgaaaugauauugugaaauauaaauuauaucaagaauuagaagcuaauggauucaaaacucucuacuccaacaccuauauccccaaagaaaaauuauuuucaaaggauuuugacaucgaacacauuguaccaaaagcaagacuauucgacgauucauuugguaauaaaaccauugaggcaagagacguaaaucuugcaaaaucuaacaaaacagcuuucgacuucgugaaagaaaaauauggugaacaagggauugaagaauauaagaagaaacuagacacccuacuaaaagaaaaugcuaucaguucaggaaaauauaagaaauuaaugauguccgaagcagauauaccaucagauuucauuaauagagaccugcgaaacacccaguacaucgcgagaaaagcguacgaaauauuaggagagcuaguaaaaaccaucacaccaacuacaggaaaaauaacugaucguuuaagagaagauuggcaacugauugauguaaugaaagaacugaacuucgaaaaauaugauagauuaggacugacggaagugauagaagacagggacggcagaaaaaucaaaagaauaaaagacuggacaaaaagaaaugaucacagacaccaugcuauggacgcacuuaccauagccuuuacaaaaccauccuacauucaauaccuaaauaaccucaaugccagaucagacaaaagugguagcaucuacgcgauagaaacuaaagaauuacacagagaaaauaacaccuuacgauucaaugcaccaaugccauuaaaugaguucagaaaggaagcuaaacgacaccuaucagcaauacucguauccaucaaagccaaaaauaaaguaaugacccaaaauguaaauaaaauaaaaacaaagaacggcauaauaaagaaaguacaacuaacaccuagaggagcauuacacaaugaaacaauauauggaacaaaaaugcgaccuauaauaaaaaugguuaaaaucggagcagcguuagaugaagcgacaauuaauaaagucaguagcccaacaauaagagaagcauuacuaaaacgucuaaacgaauacaguggagacgcaaagaaagccuuugcugguaaaaaugcgaucaccaaaaauccuauauacuuaaaugcagaacauacaaaaacagcccccgccauggucaaaauagucgaaugggagauguauuauccaauaaggaaacuaaucacuccagaucuaaaaaucgaaaaaguaauagacaacggaauaaaagaaauucuaaagaaacgacuaaaagaguucggaggagacgcaaagaaagcauuuagcaaucucgacgaaugucccauauaucuagaugaagagaaaaauauaacacuaaaaagggucucaaucgaaggagugcuaucugcaauaccaguacacacacucaaaaaccacgcaggaaaagaaaucaaagacgaagacgguaaagccguacuaggcgacuacguccagaccucaaauaaccaccaugucgccaucuaucaagacgcaaagggcaaucuacaagacaauguaauaaguuucuuugaagcagcagaaaggaaaucucagaacguacccauaguagauaaaaaccuaaaccgcgacaaaggguggcacuucuuauacacaaugaaacaaaacgaauacuucgucuucccuaaugaagaaacagguuucguuccuagugaaaucgaccuaauggacgaaaacaacuacgaaaugauaagcccuaaccuuuucagaguccaaacaaugucaagagucgauuauggaaagacaaucauaagagaauauguguucaggaaucaccuagaaacuauauuaaaugacaaucuaaaacuaaaagggcuaguauucaagaaaauuaaaagucugaaggcauuggaaggaauaguaaaagucagaguuaaugccauaggaaaaauaguugcaguuggagaauaugauuga

SEQ ID NO: 5524 - RNA, 4143 nt, Artificial Sequence
  Cas9 variant
augaaaaagaaauaugcgauaggaaucgauauagguacaaacagcguaggcuggagcguuguaacagacgacuauaaagucccaucuaagaaaaugaaaguguucggaaauacagagaaaagauacaucaagaaaaaucuacuaggcaccuuacuauucgacgaaggaaacacagcagaaaaccgacgauuaaaacgaacagcaagaagaagauauacacgaaggagaaacagaauauuauacuuacaggaaaucuucgccgaagaaaucaauaaaauagacgacagcuucuuucaaagauuggacgauucauuucucauaguggaagacaaacaggguagcaaacauccaauauuuggcacacuacaagaagaaaaagaauaccauaaacaauuuccuacuauauaucaucuucgaaaacaacuugcagacucaucacaaaaagcagacauacgacuaauauauuuagcauuagcucauauaauuaaauauagaggacacuuucuauuugaaggagacuuaaaaucggaaaauaaagauguucaacauuuauuuaacgacuucguagaaauguuugauaaaaccgucgaaggcucauaccuaucugaaaaccuccccaacguagcagacguacucguagaaaaagucaguaaaagucgacaccucgaaaauauacugcauuauuuuccaaacgaaaagaaaaauggguuauuuggaaacuuuuuagcguuagccuugggacuacaaccaaacuucaaaaccaauuucgaauuagcagaagacgcaaaaauucaguucucaaaagaaacauacgaagaagauuuggaagaauuacuaggcaaaauaggagaugacuacgcagauuuauuuauagcuacaaagucccucuaugauggcauacuacuggcgggaauacuuucaacaacaaauucaacaacuaaagcaccauuaagcucaagcaugguuaacagauacgaagaacaccaaaaagaccuagcucuacugaaaaacuucauacaccaaaaccuaagcgauagcuauaaagaaguauuuaacgauaaauuaaaagacggauaugcaggauauauagaggguaaaacaacucaagagaauuuuuacagauucauuaagaaagcgauagagaaaauagacgguucuaauuauuucaucgagaaaauagaaagagaagauuuucuaagaaaacagagaaccuuugauaacggaucaauaccucaccaaauucauuuaagagaaaugcaagcaaucauaagaaggcaagcaaaauucuaucccuuuuuagaagaaaaucaggacaaaaucgagaaaauucuuacauucagaaucccauacuacguuggaccucuagcuagaggaaaaucagaauuugcauggcucaacaggaaaucggacgagaaaauaagaccauggaacuucgaugaaaugguugauaaagaaacaucagcggaaaacuucauaacacguaugacaaauuacgaccaauacuugccagaccaaaaagugcucccgaagcacagccuauuauaugaaaaauucgcaguauacaaugaacuaacaaaaguaagauauguaacagaacaaggaaaaucuuucuucuucgacgcuaauaugaagcaggaaaucuuugauagaacauucaaaguauauaggaagguaacaaaagaaaaauuaauggauuuccuuucuaaagaguucgaugaauuuagaauaguagauuuacuaggacucgacaaggacaauaaaucauuuaacgcaucuuuagguacauaccacgaccuuaagaaaauaguuucugaagacuuucuggauaauucagaaaaugaagauauuuuagaaaacguaguguuaacacucacauuauucgaagacagagaaaugauacggaaacgacucgagaaauauaaagacguauuaaccgaggagcaaaggaagaaacuggaacguagacauuauacugguuggggacgacuaucagcgaaacuaaucaacggaaucagagauaaagugacucgaaaaacaauccuagacuaucuuauagaugacggaacaucaaaucgaaauuucaugcaacuaauuaacgaugauacccuuagcuuuguugacgaaauacgacuugcucagggaucgggaaaagcugaagacuaucgggcagaaguccaaaauuuggcaggcucaccggccauuaagaaaggaauauuacaaucacucaaaauuguagaugaauuaauugaaguaaugggauaugacccagaacauauaguaguagaaauggcacgagaaaaucaauucacaaaucaaggaaggagaaauagccaacagcguuauaagaaaauagaaaacgcaauuaagaaucucgauucaaaccuuaauucaaaaauucucaaggaauauccuacuaauaaccaagcacuccaaaaugauagauuauucuuauacuaccuacaaaacggcaaggauauguauacugaugaagaauuagauauugaccaacugucacaguaugauauugaccauauaauaccgcaagcauuuauaaaagaugauagcuuagauaacaaaguacuaacaaaaucagcuaaaaacagaggaaaaucagaugacguaccaucucuugaaauaguauauaagaagaaaaauuucuggaaacaacuauuagacucacaauuaauaucccagagaaaauuugacaaucuaacaaaagcagaaagaggaggacuaaccaaugaagacaaagcacgcuucauacaaagacaauuaguagagacucgacaaauuacaaaacacguagcuagaauauuagauaccagauucaauaccaaacuagacgaagcaggcaacagaauaagagacccaaaaguaaacauuaugacacuuaaaucauccuugguaucacaauuucggaaagacuaccaauuguacaaaguucgagaaauaaacaacuaucaccaugcacacgacgcuuaucuaaacgccguaguagcuacagcccuauuaaagaaauauccccaacuugcgccggaauuuguauacggugacuacccaaaauauaacucauauaaauccagaaaaucagcaaccgaaaaaguacucuucuauagcaacauuaugaacuucuuuaaaagaguccuuguauacagcaaaaccggcgaaguuaggauaagaccggucauagaaguaaacaaagaaaccggcgagauaguaugggauaaaaagagcgauuuuagaacuguaagaaaaguguuaagcuacccacaaguaaauguugugaagaaaacagaaguacaaaaccacggauuggaucgaggaaaacccaaaggauucuauaacgccaaucucucaccgaggccaaaagaagguaguguggaaaaccuaguacccgcaaaacaauccuucgauacaaaaagauauggggguuaugccggcauaucaaauucauacgccgucuuaguaaacgguauaauagaaaaaggaaagaagaaaaguaaagccgaaguuaccgaguuccagggaauuaguauauuagccagaaaagacuucgacaaaaauccaaaacaauauuuacucaaccugggauacaaagauaucaaaagcaucauuaaacugccgaaauacagcuuauucgaauuagaaaaugguucaagaaggauguuggcuaguauuuuaucaacaaauaacaaacgaggcgaaauacauaaagguaaugaaauguaccuaccagauaaauuuguaacucucuuauaccaugccaugcgcguaaacaggacuuuagaaccuggacauaagaaauauguagaagcccacagacauguauucgacgaauuauuaacauauauacuagaauacaaugaaaagaucgucggggccaaagcaaacggcaaacgaauuguagaagcauauucagcacgaaaagacacagacaaccucgaagaacucuguaauucauuuauaaaccuauuaaacuuaacugccuuaggcucagccgucgauuucgaguuccuagguacaaaaauaccuagguaucgagacuacacucccucuagccuccuaaaagcaacuuuaauacaucaaagcguaacaggguuauaugaaacuaggauagaccucagcaaacuaggaggagauuga

SEQ ID NO: 5525 - RNA, 4143 nt, Artificial Sequence
  Cas9 variant
augaaaaagauacuggguuuggacuuaggaacgaccucuauaggaugggcuuuaguauaugaaagcgagaaugcggacgagaaaagcaguauaguaaggcuagguguaagaguaaacccacuuagcguagacgaaaaaggaaauuuugaaaaaggaaaaucaaucacaacuaaugcggacaggcaacaaacgcauggcgcaagaauaaaccuacaacgauauaaguugagaagagaaaaccuuaaagacugucuacaaaaacaagguuggauaggaacagaagcacuauacgaagaaggaaagaccucaaccuuugaaacauauauguuacgagcaaaagccgcugaagaagaaauaaguuuacacgaacuuuguagaguacuuuucaugcucaauaaaaagcgaggauacaaaagcaaucgaaaagcaaacaacaaagaagacgguaaacuuuuugacggaaugacaguugcaaagaaacuuuacgaagaacaucuaaccccagcagaauacuccuuaaaacuccuuucaaguggaaagaaauucaaacaggaauauuauagaucugaccuaaaagaggaguucgaucgcauauggaaugaacaacaaaaauauuacccagaaauauugaccgacgauuucaaacaacaacuacaagguaaaaguaaaggaaacaccuccaaaauauuccuggggaaauaugggaucuacucagccgacuuaaaaggcuuggauagaaaauuacaaccgcuaaaauggagaguagaggcacuaaaacagaaaguagauaaagaaguauuagcauucguaauuagugacuuaaauggucaaauugcuagcaccucagguuugcuuggggcuauaagcgaccgcucaaaagaacucuauuuuaauaaacaaacaguaggccaauaccuauggacaucucuaaaagaaucaccgcacguaagcauuaaaaacaaaccauuuuaucgacaagauuaccuagaugaguucgagaaaauuugggaaacacaagcaaccuaccauaaggaauuaacaccugaacuaaaacaagaaauacgagacauaauaauauucuaccagcgcccuuuaaaaucuaagaaaggacuaauaucaguaugugaauuggaacaaagaaaaguaaaaguaacaauagauggaaaagaaaaagaaauaucgauaggacccaaaguagccccaaaaucaagccccauguuucaagaguucaggauauggcaaaaucuaaauaauauccugcucauagauaaaggaaacaauucaaauagaccauuauacgaagaagaaagaaaucuauuauaugaagaacuaagcguaaaagaaaaacugucaaaggcagaagcacuaaaaguacuaaauaaaaauggcaaacaaugggaucuaaacuauaaagaaaucgaaggaaacagaacccaagcgguacuauaugacugcuauaaucguauuaucggaaugacuggccaugaagaaugcaacuucaaaaaguuaaaagccucagauauuagauacaacguuaaaacaaucuucaaaaacuuaggauuuucaacagauauacuugacuuugacaguagucuacaaggucaugaacucgaaagacaaccauccuaucaauuauggcacuuauuauacagcuacgaaucugacaauagcagaaccggaaaugaugcacuacugcguaaacuggaaacagcuuuuucgaucccaaaagaauaugcggcaguauuauccgacguaguauuugaagacucauacggaaauuuaagcguuaaagcaaugagaaacauauuaccucaucuucaagcggguuuggauuacagucaagcgugcgaaaaggcaggauauaaacacucaagaagaucacuuacaaagaaugaauuagacaagaaagaguacaaagaaaaacuagaacuuuugccaaaaucaucucuacacaauccaguagucgagaaaauauuaaaccaaaugauaaaugucauaaacgcaguaauagacgaauauggaaaaccugacgaaauuagaauagaauuagcuagagaacuuaaaaucggagccgcagagcgcgaaaauaugacaagaaguaucaaccaggguaacgccgaaaacaaacgcaucagagaaaucuuggaaaaagaauuugcacuaucauauauaaguagaaacgacauaauaaaauacaagcuauaugaggaacuaaaaucaaauggauuuaaaacauuauauagugauacuuacaucagcaaagauaaacuuuucaguaaagacuuugacauagaacauauaauaccaaaagcaagguuauucgaugacagucuaagcaacaaaaccaucgaggcucgcgacguaaacauagcaaaaucgaacaaaacagcauuugacuuuaucucagaaaaauacgaccaacaaggaauagaagcguauaaaaagaaacuggacauuuuauuacaggauggcaguaucuccaaagcaaaauauaauagacuuuuaaugaaagaagcugauauaccaaguggguucauagacagagauuugcgugauacucaauacaucgcgaagaaagcauaugaaauacuauccgaucuuguccgcaauguuacaccaacaacaggggcgguaacaucacgacuaagggaagacuggcaauuagucgacguuaugaaagaauuaaacuuugaaaaauaccaaaaacuaggacugguagaaguaauagaagacagagacggucgcaaaauuaaaaggauaaaagacuggacaaaaagaaacgaucacagacaucacgccauggaugccuuaaccauagcauuuacaaaaccgucauacauccaguaccucaacaaccuuaaugcaaggucagauaaaaacaguagcaucuauggaauagagaauaaagaacuccauagagaagacaauaaauuaagauuuaacgccccauuacccauuaacgaauuucgcgcagaagcccgccgucaccucaaaucaaucuuaguaagcgugaaggcgaaaaacaaaguaaugacacaaaacguaaacguuaucaaaaccaaacacgguguaauaaagaaaguucagcuaacaccaagaggggaacuacauaaugccacauucuaugguacaaagaaaagaccgaucauaaaaaugguuaaagucggugccgccuuagacgaaguuacaaucaagaaaguaucaagcuccuuuauaagagaagcacuccucgaccggcuccaugaauacaauggagaugccaaaaaggcuuucacuggaagaaauucaauagacaaaaauccaauauacaucgaugaggaacauaagaaaaccguaccugcucucguaaaaacgauagaaugggagauguaccacccuacccgaaaaaugauuagcccagaccuaaaaauagacaaaguuauagauaaagguauacgggagauacuucgaacgcgucuggccaaauucaacggggacgcacaaaaagcauuuucuaaucuagacgaaaacccaauauauaaagacgaagcuaagaaaauaacauuaaaaaggguaagccuagaaggaguaaguucaguuaucccguugcacaaguuaaaagacaugggagggaaaccuguuguaggcaaagacgguaagccaguauggggugauuacguacaaacaucaaauaaccaccacaucgcuuucuacauggaugaaaacggcaaucuacaagacgauguaguuacauucuuuaaggcagcucgacguaaaagccaagguguacccgugaucgauaaaaacuauaaucacgacaaagguuggcauuuucuuuucacaaugaaacaaaaugaauauuucguuuuuccaaacgaagccacugguuuuaucccgacugaaguagacuuaauggaugaagcaaauuaugacaugaucagcccaaaucuauacagaguucagaaaaugucuaaaacaaaacaaggaauaaccgauaaacgagacuacugguuucgacaccaccuagaaacaguacuuaacaacgacuuaaaaguaagaaauucaauauucaaacaaauaaacucacuaaaaccauuagaaggcauaguuaaaguaagaauaaaugccauaggaaaaaucguugccauaggagaauaugauuga

SEQ ID NO: 5526 - RNA, 4143 nt, Artificial Sequence
  Cas9 variant
augaaaagaauacuagggcuagaucuuggaacaacaagcaucggaugggcgcuuguaaaugaagcugaauccaacaaugaagcaucaagcaucguacgauuaggcguacgcguaaacccauuaacaguagaugagaaaucaaauuucgaaaaagguaaagccauuaccacaaacgccgauagacaauugaggcauggagcaagaauaaaucuucaaagauauaaauuaagacgccaaaacuuacacgauuguuuacagaaacaaggaugguuggguacagaagcaauguacgaggaagguaaagcaucaacauuugagacauacaaauugcgagcuaaagcugcggaagaagaaaucucacuacaugaauuugcuaggguacuauuuauguuaaacaagaaaagagguuauaaaagcaacagaaaagcgaacaacaaagaagauggucaacuguucgacggaaugaccauagcuaagaaauuauacgaggaacaccuaacuccagcggaauauuccuuacaacuuuuaaauaaaggcaagaaauucacacaaggcuacuaucguucagaucuuaacgcagagcucgaaagaauaugggacgaacaaaagaaauacuacccagagauacucacugaugaauuuaaacaacaauuagagggaaagaccaaaacuaacaccucaaaaauauuccuagcuaaauauggaauauacucagcagacuugaaaggacuagaccggaagcuacagccgcuuaaauggagaguagaggcccuuaaacaacaaguggacaaagaaguccucgcuuucguaauaagugauuuaaaaggucaaauugcaaacacaucaggcuuauuaggagcgauaucagauagaaguaaagaacuauauuucaacaaacaaacaguaggucaguaucuuugggcaucauuagaagaaaacccucacaucucaauuaaaaauaaaccauuuuauaggcaagacuaucuugaugaauuugagaaaauaugggaaacccaagcaacauuucacaaacaacucacaccugaacuaaaacaagaaauacgggauauaauaaucuuuuaucaaagaccacuuaaaucaaagaaaucauuaauauccguaugugaauuagaacagagaaaaguuaaagcaaccauugauggcaaagaaaaagaaauaacuaucgguccaaaaguagcaccaaaaagcuccccgguuuuucaagaauuucguauauggcaaaaccuaaauaauguacuauuaauagauaacgauacaaacgaaaaacgcccacuagaugaagaugagcgcuaucuacucuacaaagaacuaaguaucaaagcaaaauuaucuaaaacagaagcacuaaaaauauuaaacaagaaaggcaaacaaugggaucucaauuacaaggaauuggaaggaaaccgaacccaagcaauauuauuugauugcuacaacagaauuauaacauuaacuggucacgaagaaugcgacuuuaagaaaauaaaagcaagcgaaauacgucauuacguaaguacaauauuuaaaaaucuaggguucaguacugaaauacucgauuucgauccaucacucgagaaacacgaacuagaaaaacaaccaauguaccaacuuuggcauuuauuauacaguuacgaaagcgauaacuccagaacaggaaaugaaagucuccuacgaaaauuagaaaccacauuuggcuucccugaagaauacgcgacaguauugugcgacguaguauucgaagaggacuaugguaaucuaucaguuaaagcuaugcgcaagauauuacccuaucuccaagcagguaacgauuauucacaagcaugugcguaugccggauauaaucauucaagacauucacugacaaaggaagaguuagaucaaaaaguauauaaagaacgguuggaacucuugccuaagaacucucuaagaaauccuguaguagagaaaauucucaaucagaugaucaauguaauaaacgccauaauagaugaauacggaaagccagacgaaauaagaauagaaauggcaagggaacuuaaaagcucagcagcagauagaaagaaaacaacacacgcaauuaaucaaggcaaugaugaaaaccaaugcauaagagaaauauuagaaaaagaguucgccuuaagcuauauaucccgaaaugauaucauuaaauacaaacuauacgaagaacuaaaaccaaacggauuuaaaacacuguacucagacacauauaucccaaaagauaaauuauuuuccaaggauuuugauauagaacacauaauuccaaaagcaagacuauucgaugauucauacagcaauaaaacucuagaagcacgagacaucaaucuugcaaagucgaauaaaacugcauucgacuucgucaaggaaaaauacggagaacaaggugcugaagcauacaaaaagaaauuagauaugcuccuuggcaauaauguaauaagcaaaccaaaauacaacaaacuacucaugacagaagcggauauuccaagugauuuuaucaauagagaucugcgaaacacgcaauauauagcccgaaaagcaugugaaauauuaggagagcuaguuagaacagucacucccacgacuggaaagaucacaaaucgauuaagggaagacuggcaauuaguagacgugaugaaagaacuaaauuuugaaaaauacgaaaagcuaggcuugaccgaaauaguugaagaccgcgacgggagaaaaauaaaaagaauaaaagauuggacuaaaagaaacgaucaucggcaucaugcuauggacgcccucgccaucgccuucacuaaaccaagcuauauacaguacuuaaacaaucucaaugcaagaucaaauaaaggagacaguauauacgcaauagaaaauaaagaauuacauuaugaggaaggcaaauuaagauuuaaugcuccuauccccguaaacguguuucgagcagaagccaaaaggcaucuaagcgccauucuagucucaaucaaagccaaaaacaaaguaaugacacaaaacguaaacaaaauaaaaacaaaacaugggauaauaaagaaaauucaacuaacaccccguggaccacuucacaacgaaacaauauauggcacaaaaaugcgccccauaauaaagaaaguaaaaguaggagcagcacuugacgaagcaacaauaaauaaaguaucaaguccagcaauuagggaaguacuacuaaaaagauuaaaugaauacuccggaaacgcaaagaaagcauucacagguaaaaacacacuagauaaaaaccccauauaucuuaacgcagaaagaacaaaaacagugcccgccagcguaaaaaccguagaaugggaaaauuaccacccuauccgcaaaccgauaacaccugauuuaaaaguagauaaaguuaucgauaaagguauaggagaaauucuaaaagcccgauuagaagaauuuaacggugacgccaaaaaggcauuuagcaauuuagaagaaaauccaauauacuuagaucaaacaaagaaaaucgcauugaaacgggugucaauugagggaguuuuaucaacaauuccccuacacacauuaaagaaucaagcagguaaaccuaucauggggaaagauggaaaaccaguacuaggaaauuacguacaaacaucuaacaaucaccacauugcauuuuacuaugacgaagauggaaaccuucaagauaacgcgguaucauucuuugaagcagccgagcgaaaaucccaaggaauuuccguuauagauaaagacuauaaccgcgacaaaggcuggagauuuuuauucacuaugaaacagaacgaauacuucguauucccaaaugaggcaacugguuuuauaccuuccgaagucgauuuaacugaugaagcaaauuauggaauaauuaguccaaauuuauaucguguacagaaaaugucgagaauugaaaaagggacguccguaucaagagacuacugguuuagacaccacuuagaaacaauauugaaugacgacucuagacugaaaaauagugcuuucaaaagaauaaacucgcuaaaaccacuagaagggaucauaaaagucaggauaaacucaauugguaaaauagucgcaguaggcgaauacgacuga

SEQ ID NO: 5527 - RNA, 4143 nt, Artificial Sequence
  Cas9 variant
augaagaaaggauacucaauaggauuagauauagguacaaacucaguuggauucgcagugauuacagaugacuauaaagucccaucaaagaaaaugaaaguucuaggaaacacagauaaaagauucauaaagaaaaaccuaauuggagcacuguuauuugacgaagguacaacagcagaagcaagaagacuuaaaagaacggcucggagaagguacacaagaaggaaaaacagacugagauacuuacaggagauauucagugaagaaaugagcaaaguggacuccucauucuuucauagacuagacgauucuuuccucauuccagaagauaaacgagagucaaaauacccaauauuugcaacacuagaagaagaaaaagaauaucacaagaaauuuccgacaaucuaucaucucagaaaacaucuugcagauucuaaagaaaaagcggaccuccgucuuauauaccucgcauuagcucacaugaucaaauaccguggacauuuucuauaugaggauacauucgacauuaaaaacaacgauauacagaaaauauucaaugaauuuauaucaauuuaugauaacgcauuugaaggauccuccuuaucuggacaaaacgcacaaguagaagcaauauucacugauaaaauaucaaaaagugccaaaagagaaagaguacuuaaacuuuuucccgaugaaaaaucaacagggcuauucucugaguucuuaaaacucauugucggcaaccaagcugacuucaagaaacauuuugaccuagaagacaaagcaccucuacaauuuucaaaagauacuuaugaugaagacuuagaaaaccuacuuggacaaaucggugaugacuuugcugaccuauucguagcagcaaagaaacuauaugacgccaucuuacuuucaggaauauuaacgguaacagacccaucaacaaaagcuccacuaucggcaucaaugauagaaagauacgagaaucaccaaaaugaucuuguagugcucaaacaauucaucaaaaacaaccucccagaaaauuaugucgagguauuuucagacgauagcaaaaauggcuacgcaggcuaugucgguguugauucuaaaauaagaaaacgcaacgcgaaacuagcaaccgaagaggaguucuauaaauaccucaaaaacauacuaaacaauguaaaaggcgcagauuauuuucuagauaaaaucgaacgcgaagacuuucuacggaaacaaagaacuuuugacaauggcucgauuccacaccaaauacaccuucaagaaaugaacgcaauuuuaagaagacaaggcgaacacuaccccuuccugaaagaaaauagagagaaaaucgagaaaauacuaaccuuuagaauaccauacuaugucgguccucuagcacguggaaauagagauuuugcuuggcuaaccagaaacuccgaccaagcaauacgaccuuggaacuuugaagaaaucgucgauaaagcaagcagcgcugaagacuucaucaauaaaaugacaaauuaugaccuauauuuaccugaagaaaaaguacucccuaaacauagucuacuuuaugaaaaguucgcaguauauaaugagcugaccaagguuaaauucaucgcagaaggucugcgagacuaucaauuccucgacagcggccagaagaaacaaauaguaaaccaguuauucaaagagaaaagaaaagugacugaaaaagauauaauacauuaucuacauacaguagauggauacgauggaaucgaacuuaaaggcauugaaaaacaauuuaaugccagucuaucaacauaccaugaccugcucaaaauaauaaaggacaaagaguucauggacgauccuaaaaacgaagaaauucuugaaaauaucguacauacauuaaccauauuugaagaucgugaaaugaucaaacaaagacuagcucaauaugacagcuuauuugacgaaaaaguuauaaaaucuuuaacaagaagacacuauacaggaugggguaaacucucagcaaugcuuaucaacggaauacgagauaaacaaaccgguaaaaccauacucgacuaucuaauugaugaugcuuauuacaaucgaaauuucaugcaacuaaucaacgacgauggacuaucauucaaagaaauaauacagaaagcccaagucguaggcaaaaccgaugaugucaaacaagugguccaagaacuuccuggauccccagcgaucaagaaagguauucuccaaucaauuaaaaucguugacgaacuuguaaaaauaaugcgacauaaccccgaaagcauaguuauugaaauggcaagagaaaaccaaacuacagcaagaggaaagaaaaacucacaacaacgauacaaaagaauagaagacgcacugaaaaaccuagcaccaggauuggacucaaauauacuuaaagaacauccaacugauaacguacaacuccaaaacgacagacuuuuccuauauuaucuccaaaauggcaaagauauguacaccggcgaagcccuagacauaaaucaauuaucaucauaugauauugaucacauaauaccucaagccuuuauaaaagaugauucguuugauaacagaguacuaacuucaucaaaagauaacagaggaaaaagcgacaacguacccucuaucgaaguuguacaaaaacgaaaagccuucuggcaacaguuacuagacucaaaauuaauaucagaacggaaguucaauaaccucacaaaagcugaaagaggggguuuagaugaaagggacaagguuggcuucauaaaaagacagcuaguagagacacggcaaauaaccaaacacguagcucaaauacuagaugcacgauauaacacugaaguuaaugaaaaagacaagaaaaaucgcacaguuaaaaucauaacauuaaaaucaaacuugguaucaaauuucagaaaagaauuuagacuauacaaagucagagaaauuaaugacuaucaucacgcacaugacgccuacuuaaaugccguggucgcaaaagcaauucuaaagaaauaccccaaacuagaaccugaguucgucuacggagaauaccaaaaauaugacuuaaaaagauauauaucacgcucaaaagaccccaaagaaguagaaaaagcuacugaaaaauacuucuuuuauaguaacuuacuaaacuuuuucaaagaagaagugcacuaugcugacggcacaauaguaaaacgcgaaaauauagaauacucaaaagacacaggagaaauugccuggaacaaagaaaaagacuuugcuauaauuaaaaagguucuuagucugccccaaguaaacauaguuaagaaacgagaaguacagacaggugguuuuucaaaagaaucgauacuccccaaaggaaacuccgauaaauuaaucccacgaaaaacaaaagacauacucugggauacaacaaaguauggcggauucgacuccccaguuauagcuuauagcauacuccuaaucgccgauauagaaaaaggaaaagcaaagaaacuaaaaaccguaaaaacccuugucggaauaacaauaauggaaaaagccgcauuugaagauaacccaauuacuuuccuugaaaacaaaggauaucacaauguccggaaagaaaauauauuaugccuaccaaaauacucuuuauuugaacucgagaacggaagaagaagacuacuagcaagugccaaagaacuacaaaaaggcaacgaaauuguuuuacccguauacuuaaccacacuucuauaccauucgaaaaacguacauaaauuagaugagcccggacacuuagaauacauacaaaaacacagaaaugaguucaaagaucuauuaaaccuuguaucagaguucucacaaaaauauguacuagccgaugcaaaccuagaaaagauaaaaagucucuacgcagacaacgaacaagccgauauagaaauauuagccaacucuuuuauuaacuuacuaaccuucacugcuuuaggagcuccagcugcauucaaauucuuugggaaagacauagacagaaaaagauauacuacuguauccgagauccucaacgcaacuuuaauacaccaaucuauaacuggcuuauaugaaacuagaauugaucuaagcaaacucggagaggauuga

SEQ ID NO: 5528 - RNA, 4143 nt, Artificial Sequence
  Cas9 variant
augaaucuaaggcauguagggaauuauaauauuggcuuagauaugggaacagcaaguguaggcugggcagcaauagacgaacaaggugaguuauugcacuuuaagggaaaaccaacuuggggcucgcgacuauucgacucagccaacacagcagcaacagcuagaaugccaagaggccaacgaagacgauacauuagacgaagguggcgccuagaucuacuacaaaaauucuuuagugaagaaauggcagaaaaagacccugaguucuuuauuagacucaggcaaucaucccucuggccagaagaucgcgaaggaggacauacugcauaccacuggccuuuauucaacgacagugauuuuaaugaaaaagaauauuaugaaaaguucccgacgauuuuccauuuaagacaauggcucauggaaacagacgaaaaagccgauauucgacuuauuuaccucgccuuccacaauauuguuaaacaccguggcaacuuccuacaagaaaacaaugauagucuaagcgcacaaaacgcuaacaugcgggagagcuuagaaucauuuugcauagcucuagaagaauggugcgaugaaaaagaacucacaugcagcugugacccucaaaaauuggaacacuuauuuaaagaaguaaaauauagaagugacauaagagacggauuugcugcuuuauuaggccuagcauguaguggugaaaaugaaguagacguaaaagcaauggcuaaagaaaugggaaaggcaauaguaggauacaaagcugacuucucaaaaauauuuacagaaugugauaaagaaggaagcucguuccgguuaucugaugaugaaggaccggaagccuuuuuagacauaugcccagacgauggaaucgcacuauucgaagcaauacaaauggucuauuccucuuuuauauuaaccggaauguuaacagaaaaaggccugagccuaucgaaaauaucugcguauaaucaguauggucaagacuuagaaaguuuaaaagcguuaguaaaagaauauguaccaaacgaauauucuaguuucuuccgaggaccgacauauagcggaaguacagaauaugauccuaguaaagcucaagguuauacuagauauaauuuaggacccaguaaaaaggggaguggcgcuaaaccaauggcauaugaagauuuuaagaaaucaguugaacaacuauuugcaaauacaaacgccauaaaugacgaaagauacaaagagaugaugggaagauuugcugaggaaaaauuucuacggagacuccgcacguccgauaacggacgaauaccauuucaauugaauuuagaagaaaugacagcaaucauaauuaaccaggguaaauauuacccauuccuccuugagcaacaagagaaacucgagucacuuguucguuuuaggauacccuacuacguuggaccacuaacccgcauaaaugcacgacuagauucaaaaggaaacgcuugcuuugcauggaguaaaagaaaagacggcauggauagugcaagcauaaaaccauggaauugggaugaaguaauugacaaacacgcaucggcacaagcauucauugaaagaaugacaggaacauguacguauuuaagaggggagccagucuuaccaagauguucgcuauuauaugaagaauauuguguucuaaaugagcucaauggagcaagauggacucaggauggugauaaauucauacgauuugauuacaaagaucggucggacauaaucgaagaacuuuuuaagaaaagaagaggaaggauucaauacgcagcaguugccgauuggaugaaacaagaacguucacaugcuaacgugcacgucucgggaggccaaggagaaaaugcuuuugaaucuagguuaucuucuuaccauuucuuuuguaacgaugucuuuggaguggaugaacuaccaggauccuacguagauaugguugaagaaauaauauuauggucuacauuguuugaagauagaaguauacuaagggaagaaauacaaaggaaauauggagacguauuaaacgaagaacaaauuaaaacaauuuguaagaaaagauuuucaggauggggccgccuaaguagaaaauuguuauguagucuaaaagcacaaaccgacaaugguccaaaaucuauaauggauauacuacaagaaggagaucaaaauaacggcagaguaggcagagcaaugguauuucaggaaauacuccacgaugaacaauuagguuuugaacagaaaauagaagaagaaaauacacaaaguauguuagaaggagaaaaccugcuaauagaagauuuaccagguucaccggcaauaagaagaucuauaaaucaggccgucaggauaguagacgaaauaguggggauugcugggcacgcaccagauaauauauucaucgaaguuacacgagaagacgauacuaaaaagaaaggaaaaagaacaacgaccagauauaguaauauacaaaaagcacuagaagcauuaaaagaagaaggcgcugaggcuuuacgggaacuaaagacguauaaacacaacgaacuggacaaaagauuaucccuauacuuuaugcaaaaugggaaaucccuuuauagcggcauuccgcuagacaucagaaggcuaagugaauaucaaauagaucauaucauaccccaaucauacauuaaagacgauucauacgaaaauauggcuuuaguacucccuggugaaaaccaaucaaaagcagauaacuuacuaaucucccaagauauccguauuaaaaugaaggcaaccuggacagcgcuccacaaggcgggacugaugggagacaagaaauacaauaaucuaaugaacaguucaaucucagaugcaaagaugaaaggauucauuaaccgucaacucgucgaaacuucacaaucaguaaagcuaacgcagaugauguuaucacaaaaauauccaggagcaaaaguacggcccauaaaagcuagcauaaguucgcagcuaagagacgcuugugacuuaguaaagugcagagaagcuaaugacuaucaucaugcacacgaugcauaucucgcuugccaggugggacguuuuguauuaaaacgacacucuagcauguucgauaaucccauagguaugaccaaaguaauuagagauuucgugaaacgacaagggcaagaguucaaacggaacgggaaauuaccagcauacgcaucuaggucaggguucauaguacaaucuuuuaugcgguccggauucgaugcagaaacaggggaacuguuaagagacgacuggaaugcaccuuuugaaauagcaagaaucaaaagaugucuaaacuauagagacugcuauauuucacgaaugccaauggaagauucaggagcauucugggacgcaacaauauacucuccuaaggcaggcaagaaaggggccuuaccaguuaaacaaggauuaccaguugaaaaguauggaagcuacagcagagaacaauuugcauacuucuuuguauacaaggcauacaauccgaaaaagaaagcauacagacuugaauuugaagcagugccaguaagaguagcaagugccguggaaacaagagaaaaugcacuagaagaauaugcuaaaucaguggcaaagcaagcaggucuggaguucguagaaguagcacgaccaaaaguuuauaaauaucaauuaauugaauuaggcgaagauagauuguacauuacuggaaaacgagaaguccgaaacgcaagucaacuugcauucagucuagacgaaauagauuuacuaaaaaggcucgcugaaggagaagaaacuagcuccgaagaaagagaacgauuguuugauguauuaauugaaaaauacgcaagauacgccccaagacuagcacgacaacuaucaguagauagcauguccgcuacauucgaaacccuuaacgcagaagaacaauugggaaucuuauuaucauuaguggagauugcuaauggaaaaagaaauaugauagauuuaagcagcgcaggaggauccaaaaacgcaggcugcaugaacccaacuuucaguucagaacuaaguucaccaggaaguaauuuuacuuucaucgaccaaucaguaacaggaauguucgaacgccgucaaagacuagaacuguga

SEQ ID NO: 5529 - RNA, 4146 nt, Artificial Sequence
  Cas9 variant
auggucaaaaagaaauacgcaauaggaauagacauaggcacaaacucaguaggauggucaauaguaacagaugauuacaaaguaccuaguaagaaaaugaaaguuuucggaaauacagagaaaagauacauuaagaaaaaccuacuaggaacacuucucuuugaugaaggcaacaccgcugaaaacagaagacuaaaacgaacugccagacguagauauacaagaagacgcaauaggauauuauaucugcaagaaauauuugcggaagaaaucaauaaaauugacgauagcuucuuucaacgacuugacgacagcuuuuuaauaguagaagauaaacaaggcucaaaacacccaauauuuggcacacuucaagaagaaaaagaguaccacaaacaauucccaacaauuuaucaccuaaggaaacaacuagcugacucuucacaaaaagcugauauaagacuuauauaccuggcauuagcacacaucauaaaauauagagggcacuuuuuauucgaaggagaucucaaauccgaaaauaaagacguucaacacuuauuuaacgauuucguugaaauguucgauaaaacaguugaaggaucuuauuuaagcgaaaacuuaccaaacguagccgauguucuaguagaaaaaguuagcaaaagcaggagacuagaaaacauccuacacuauuucccaaacgagaagaaaaaugguuuauucgguaacuuucuagcucuugcgcuaggauuacaaccaaauuuuaaaacaaacuuugaacuagcugaagacgccaaaauucaauuuaguaaagaaacauacgaagaagaccuugaagaauuauuaggcaaaauaggugaugauuaugcagauuuauucauagcaacaaaaucauuauaugacggcauuuuacuggcagggauacuaagcacaaccgauaguacaaccaaagcaccacucagcucaucaauggugaauagauacgaagaacaccagaaagaucuagcccuucuuaaaaauuucauacaucaaaaucuaucagacaguuacaaagaaguuuuuaacgauaaauuaaaagacggauaugcugguuauauagaaggcaaaacuacccaagaaaauuucuauagauuuaucaagaaagcaauagagaaaauagaaggaaguaauuacuucauugacaaaaucgacagagaagacuuuuuacgaaagcaaagaacuuucgauaauggcuccauaccucaucaaauacaucuacaagaaaugcacgccauaauacgacgacaggcggaauuuuauccguuuuugguagaaaaucaagacaagauagagaaaauauuaacauuucgaaucccuuacuaugucggaccacuagcuagaggaaaaagcgaauuugcuuggcuaaacagaaaaucagaugagaaaauucgaccauggaauuuugacgaaaugguagacaaagaaacaagcgcagaaaacuucaucaccagaaugacaaacuaugauagguauuuaccugaccaaaaagugcuuccaaaacacagucuuuuauaugaaaaauucgcaguauauaacgaauuaacaaaaguaaaauuuauagcggaaggaaugcgcgacuaccaauucuuggauucaggacaaaagaaagacauuguaaaaaccuuauucaaaacaaaaagaaaagucacagcuaaagauaucaaagcauaccuagaaaauaguaacggguacgccgguguggaauuaaaaggauuagaagaacaauuuaacgcgagucuaccaaccuaucacgauuuauuaaaaaucuugagagacaaagcauucauagacgcagaagaaaaccaagaaauacucgaagacauaguacuaacacuaacacuauuugaagaccgagaaaugauaagaaaaagguuagaaaaauacaaagauaucuuaacagaagaacaacgcaagaaacuagaaaggagacacuauaccggauggggcagacuaagcgccaaauuaauaaacggcauucuagacaaagugacucgaaaaacuauauuaggauacuugauagaugauggaaccuccaauagaaauuucaugcaacuuauuaacgaugauacauuaucauucguugaugaaauaagauuagcacaaggaucaggagaagcagaagacuaccgugcugagguucaaaacuuagcaggcuccccagcaauaaagaaaggcauacuacaaucacuaaaaauaguugaugaguuaaucgaagucaugggauaugaacccgaacacauagugguagaaauggcaagagaaaaucaauuuacaaaucaaggacgacgaaauagucaacaaagaauuaauagauuagagaacgcacucaaagacuuuggguccaaaauacuagaagaacaaaaaccuuacggaguaagcaaaguaaauaauauacaucuucaaucagauagacucuuucuauacuacuuacaaaacggaaaagauauguauacugacgaagaacuagacauagaucaccucucugaauaugacaucgaccacauuaucccacaggcuuucauuaaagacgauucacucgauaauaaaguauuaacuaaguccgcgaagaacagggguaaaucggacgauguacccaguauggaaaucguacauaaccggaaaaauuucuggagacaacuccuaaaaucuaaauugauaagccaaagaaaauuugauaacuuaaccaaagcugaaaggggaggccuaacuaacgaggacaaagcuagauucauccaacgucaauuaguugaaacucgacaaauuacgaagcauguagcaagaauguuggacacaagauucaauacaaaauuagacgaagcagguaacagaauccgcgacccaaaaguaaauaucauaacccuaaagucuaaccuuguaagccaauuucgaaaagauuaucaacuauacaaaauccgagaaaucaacaacuaucaccaugcccacgacgcauauauaaacgcaguaguagcuacagccuuacuaaagaaauauccccaacuagcuccggaguucguauacggggaauacccaacauacaacucauacaauucaagaaaaagugcaacugaaaaaguucucuucuacucaaauauuaugaacuuuuucaaaagaauagugguacauucaaaaaccggagaaguucguauucgaccaguaaucgaagugaacaaagaaaccggcgaaauaguaugggacaaaaagucagauuuccgcacuguaagaaaaguucuuagcuauccacaaguaaaugucgucaagaaaacugaaguccagaaucacggauuagaccguggaaaaccaaaagguuucuacaacgcgaaccuaagcccaagaccgaaagaaggaucaguagaaaaucuagucccagccaaacagaguuucgauacaaaacgauaugguggguaugcaggcauaucaaacagcuacgcagucuuagugaacgguauuaucgaaaaaggcaagaagaaaucaaaagcggaaguaaccgaguuccagggaauuucuauccuggcccgcaaagacuucgauaaaaacccaaaacaauaccuacucaacuuagguuauaaagauauaaaaaguauaauaaaacucccaaaauacucguuauucgaauuagaaaauggaagccgaagaauguuggcaaguauacuuaguacaaacaauaaaagaggagaaauucauaaggguaacgaaauguaucugccugauaaauucguaaccuugcuauaucacgccaugagaguuaacaggacguuagaaccgggccauaagaaauauguggaaacacacagacauguuuucgacgaacuacugaucuauaucuuggaauauaacgagaaaaucguaggagcaaaagcaaacgggaaaagaaucguggaagcauauucggcacgcaaagacacagacaaucucgaagaacucugcaauaguuuuauaaaucuauuaaaucuaaccgcauuaggaagcgccgucgauuuugaauuuuuaggcacaaaaauaccccgauacagagauuauacaccgaguagccuauuaaaagcaacacuuauccaucaaucaguaacaggacuauaugaaacaagaauagaucugagcaaauuggguggcgacuga

SEQ ID NO: 5530 - RNA, 4146 nt, Artificial Sequence
  Cas9 variant
augaauuauguaaaggaauaucauauaggacuagauauaggaaccucaucaauaggaugggcaguuaccgauucacaauucaaauugaugagaauuaaaggaaaaaccgcaauuggcguacgacuauuugaagaaggaaagacagcagcagaaagaaggacauuuagaacaacaagacgcaggcucaaaagaagaaaauggagacuccauuauuuagaugaaaucuucgcaccccaucugcaagagguagaugaaaauuucuuacguagauuaaaacaaucuaauauacauccagaagauccagcaaagaaucaagccuuuaucggaaaacuuuuauuuccagaccuuuuaaagaaaaaugaacguggcuauccgacucugauuaaaaugcgagaugaacuaccagucgaacaacgagcacauuacccagugacaaacauauauaaacuuagggaagcgaugauaaaugaagauagacaauuugaucuaagggaaguauacuuagcuguucaccauauaguuaaauauagaggucauuucuuaaacaaugcuagcguagauaaguuuaaaguagggaggauagauuuugauaagucuuuuaauguccucaaugaagcguaugaagaacuacaaaacggcgagggaucauucacaaucgaaccgaguaaaguagaaaagauaggccaauuauuacuagacacuaaaaugagaaaacucgaccgacaaaaggcaguagcaaaauuccuggaggugaaaguagcugauaaagaggaaacaaaaagaaacaaacaaauugccacagcaauauccaaacuugucuuagguuauaaggcugauuucgcaacaguagcuauggcuaaugguaaugaauggaaaauagacuugagcucagaaacaucagaggaugaaaucgaaaaguucagagaagaauugagugaugcccaaaacgauauccuaacugaaauaacaucauuauucagccaaaucaugcuaaacgaaaucguccccaacgguaugucaauaucagagucaaugauggauagauauuggacacaugaacggcaauuagcggagguaaaagaauaccucgcaacccaaccagccuccgcccgaaaagaguucgaucaagucuauaauaaguauauaggccaagcgcccaaagaaaaaggcuuugaucuagaaaagggacuuaagaaaauccucagcaagaaagaaaacuggaaagaaauugaugaauuauuaaaagcgggggauuucuugccaaaacaaagaaccuccgccaauguaguaauaccccaccaaaugcaccaacaagaacuugaucgcauaauagaaaaacaagcaaaauacuauccgugguuagcuacggaaaacccagcaacaggagaaagagaucgucaucaggccaaauaugaauuagaucagcuagucaguuucagaauaccguauuauguuggaccccuaguaacaccagaaguccaaaaagcuacuucaggagcaaaauuugcaugggcuaaacgaaaagaagauggagaaauuacaccauggaaucuaugggauaaaaucgaucgagccgaaucugcagaggcuuuuauuaaaagaaugacaguaaaagauacauaucuccuuaaugaagaugugcuuccugcuaacucgcuucuauaucaaaaguacaauguauugaacgaacuuaacaauguaagagugaauggaagaagacuaucaguuggaauaaagcaagauauuuacucagaacucuucaaaaagaagaaaacaguaaaagcaagugauguagccagcuuagucauggcaaaaacgcgaggcguaaacaaaccaucuguugaaggucucucugacccaaagaaauuuaacaguaaucucgcaacauaucuugaucuuaaaucaauaguaggagauaaagucgaugauaauuguuaccaaacagaccucgaaaauauaauugaauggcguucaguguucgaagauggagaaauauuugccgacaaacuaacagaaguagaauggcucacagaugaacagagaucagcucuaguuaagaaaagauacaaagguuggggaagacuaaguaagaaauuauuaaccggcaucgucgaugaaaacggucagagaauaauagaccuaauguggaacacagaucaaaacuucaugcaaauuguaaaucaaccaguauucaaagaacagauugaucaacucaaccaaaacgcuauuaccaaugacggaaugacacucagagaacgagucgaaucuguauuagaugaugcauacacaaguccacaaaacaagaaagcaaucuggcaaguagucagaguuguugaagacauaguaaaagccgucggaaaugcaccgaaaucaauaucgauagaguuugccagaaaugaaggaaauaaaggagaaaucacacgcucuaggcggacucaacuacaaaaauuauuugaagaucaagcacaugaauuaguaaaagauacaagucucacagaagaacuagaaaaagcguuggacuugucugaucgauauuauuuauauuucacucaaggcggaaaagauauguauacaggugacccgauaaauuuugacgaaauaaguacaaaauaugacauagaucauauauuaccacaaucuuuuguaaaagacgauagccuagauaauagaguauuaguuucgagagcagaaaauaauaagaaaagcgauagaguacccgcgaaacucuaugccgcaaaaaugaaaccauauuggaaucaacuacuaaaacaaggauuaaucacacaacgaaaauuugaaaauuuaacuauggauguagaucaaaauaucaaauauagaucauuaggguuugucaaaagacaguuaguugaaacucgacaagucaucaaacucacugcgaauauuuuagguucuauguaucaagaggcaggcacagauauuauagaaaccagagcaggacuuacgaaacaacugcgagaagaguucgaccuuccaaaaguccgugaaguaaacgacuaccaccaugcuguugacgcauauuuaacaaccuucgcaggacaauaucuuaauagaagauacccuaaacuaagaaguuucuucguguauggugaauacaugaaauuuaaaagggguucagauuuaaaauuaagaaauuuuaauuucuuucaugaacuuauggaaggagauaaaucacaaggaaaaguaguagaucaacaaacaggagaacuuauaacgacgagagaugaaguagccaaaucuuucgauagacuuuuaaauaugaaauauauguuagucagcaaagaaguacacgauagguccgaucaauuauauggagcaacaaucgucacagcaaaagaaucaggaaaguuaacaaguccgauagaaaucaagaaaaaccgaccagucgaccuuuacggugcauauacuaacggaacuucggcauucaugacaauaauuaaauucacugguaacaaacccaaauauaaaguuauagguguaccaacaacaucagcagucggauuaaaaagaguaggaaaaccgggcucagaaucauacaaccaagaauuacacagaauuauaaaaucaaauccuaaggucaagaaagauuucgaaauagugguaccgcaugugucuuacucacaacuaauaguagacggugauuguaaauuuacauuagccuccgauacauaccaacacccagcgacacaacuugugcucaguaaagaaaguauggaaaucaucgcugacgauuucaaauuuguaaaagaaaauccggcaacagccgacgaacagcuagucagaguuuuugaugaaaucgucaaccaaaugaaucacuauuuuacaauauuugaccaaagaagcaaccgacaaaaaguuacaaaagcccgugacaaguucguauccuuaccaacagagagcgaauacgaaggagcaaagaaaacgcaagucggaaaaacugagguaauuaccaaccuacuaaugggccuccaugcaaaugccgcacaaggagaucuaaaaguacuuggccuaucuaccuuugguuucuuucagucaagcggaggucucaacuuaagugaggaugcaaugauagucuaccagagccccacaggauuauuugaaagaagaaucuguuuaaaagauauauga

SEQ ID NO: 5531 - RNA, 4146 nt, Artificial Sequence
  Cas9 variant
augaaacagauccucaagaaaguucaaggauauaacauaggccuagauaucgguacaaacucaguaggauggguaguaacugacgaaaaugccaaucuacugcaauuccguaaaaaaaacauguggggugcaaggcuguuugaaaaaggcgacacagcacaagguagaagacuuucaagaucaaccagaagaagauaugauagaagaaggcagcgaauacacuaucuacaagagauguuggcaaccaugguacuaccaauagacgaaaguuucuuuauaagauuaaaugaagcauuucuauggaaagaagauaaaaguguacaaagagacuacauucuguuugcagacaagcaauucaccgacagagauuucuacaaacaauuuaaaacaaucuaccaccuacgaaaauuucuucuagacacuaaagaaaaagcugacccacgauuuauauacuuggcgcuacaucacaugauaaaguacagagguaacuuuuuauaccagggacaaucauuugacgucguagagaacguacaagaaucauucagaguauugcuagaagaaauguacgagcaauuaggcaaagaaugggaauauggagagcacuucgacgacauccaacggauacuagaaaauacaacaauaggcaaaaaaucuaaacaagaacaaaucgccgccauacucaccgaacaguauggcaacaaaaaauuggcaaaugaaguaacaagagcaugucuagguuacucauucgaccuaacaguugugauggaaaaugaaaacuuacuagaugaaucagguaaaaagaucaagauuucauucagcgacaguaaguaugaagaacaagaauuagaacuccaaaauagacuggaagaaaaauuugccgucauagaggcccucaaacgaauauauaacuggcuuguucucaaagacaccuuacgaggaaaaaaguauauaagcgaagcaaugguaaacaaauacgaagcacaccacgaagaucuagugaaacuuaaacgccuauuuagaacuuaccuaucaacagaagaauacucguguuucuuucgaaaagaaaagcaaaaagauaaauauauaucaaauuacgucaacuauagaaaaggcgcagagagauguuccaaagaaaaauuauauaaagcgauacaugaacuauucgacacgguugcaaaagaugacguugucuaucaagagauaguugaaaaaauggaucaaggcgaauuccuuaccaaacaaaaugaagucaguaacgcauacauccccuaccaauguaaugaaguagaaaugaaacgaauauuaaaacaacaaggagaauucuacccggaacuaaaagagaacgcagauaaaauauuacaacuguuguuauucaggauacccuauuauguagggccccuaguugacgaaaagcaaucgaaauucgcauggaugaaaagaagaacuggcauggaacaaguuaagauauacccauggaauuucgaacaaguaguagacauagaccagacugcagaagccuucauuacacgaaugacaaacuacugcacuuaucucccagaagagaagguucuacccaaacaaucauuacuuuacagugaauacgaauuauuacaagagcuaaacaaaauaaagauaaacgguaaguucucguuagaaacccgaaacaaaauaauagaacaauuguuuaaaaaacaaaagaaaguaaccgaaaaacaauuaaagaaauggcuaguacgagagcaauacuguacaacgaaaguaacggaaaaaaugguaaaacuagaugaaaaugcuuauuauaucacuggauuucagaaggaaaaugaauucgcaaguagccuaaccuccuacauagauuucacuaaaauauuaggggaaauaacggaaagaaacagaaaaaugauagaagaaauaauauauugguugacagucuucgaggaaaaaucaauagugaaaagaaaaauacaaaaaaaauacggaaacgaaauaaaugacaaacaauuagcacaaauccuaaaacuaaauuacucuggauggggccgauuuagugaaaaauuuuuaaauggaaucaaaggauucgaccgacaaggacaaaaaaaaacaaucauggagcucuuaagggaagacucacgacuacuaaacauuaugcaaauaauaaacaaugaagaaaugggauuuugcaaaauaaucgaagcaaaccaaaaaaaacuauacggaaacgaaaaucuauuagauguaguacaagaauuacacggaagccccgcaauuaaaagagguauauggcaaagccuuaaaauaguugaagagauaauaaguauaaugggaggcgucccgcaaaauauauucauagaauucgcuagagaagaugacgaucgaguaagaaccaauucucguguaaaacaaauagaaagacuauauaaaaaauuuaaagaggagguuaacgacuucaaugagcacgcugccaacgaacuaaaggagaaacgauaccaaaaccguauugaugaagaaaaaguauuccuuuacuucaugcaaaacgggaaaagccuauacucaggaguaacccuggacauugaucgauuaaacgaauaugaaguagaucacauaauaccaagaacgcuaguuaaggacgauagcuuagaaaacaaagcacuaguauugaaaggagaaaaucagagaaaaggagagggacugauaccgcaugaauggcaaaaucgacagaaagaaguauggaaaaaauuauuaagcugcgggcugauggggaaaaagaaauacgcaaaucuauguaaagaaucuuuuggaaaugagaaagaacaaaaacauuucauagcgcgacaaauuguugaaacaaggcaaauaauaaaacaaguagcaaacauacuugcgcaauauuaucaaggcguaaacguugcagcaguaaaggcuucacucggaagugaauugcgugagaacuacacaauugaaaaaaaagacgacaacgguuuuuucauggaaaauaagaguuacaccauguuaaaaucaagaaaaauaaaugacuuccaccacgcucaggacgcauaccuggcaugugcaguaggacuauauauaaaagccgcuuuuccuaaauaugaaaaagaaauugauuacgaagguuaucgaaaguacuaccagaaaaaaaaccagcaaaaagauggaguuagaaacgaaaaaagacaauuuuuuaguuauguaaugucuagauucucugaacaaauaguagacaaagaaacaggagaaauauuaugggacggaacccaaaaauuagcuuacauuaagaagauauucggauacagagacugccugaucacuaaaaaauuagaagaaaauacaggcgaauucuauaagcaaacaauaaaugcgaagccagaaaaaggaaaagaaaacaacacaaaacuccucccaauaaaaaaaggacugagcguagaaaaguauggaggauaucaagguggugaagccgcauacagcugccuaguucgauaucaacaaggucgaaaaacaaaacuaucacucgaaaaaauaucaguaauaauagcaaaaaaaauugcagaaaaagaagucucacuagaccgauacuuaaaggaaaaacuagggguagaagaaauaguuauacuccggaaaaagguuaugaaaaaucaacugauagaagauagugauggaaacagguucuacuuaaccgcagcuacagaaguggugaacgccaaacaauuuauuuuggacggaaagcaccagcaccuacuaagaacaauagcaauaauggagaaaggagaauauuauggguacagacuagaugaacuagaaaauaguauggaugaguuauaugcauauuaucggaugaaaauacaacagcaauauccagcauacgaaucgauagugaaaaaaauaguagaaagccacguguacgaaagccuucauguagaagaaaaaauaaaggccguacaggaaaaagguaaauuccuaauucaacuauugagacuuacggaagcuaaugccgaauguauagaucucaaaacaaucuccgacgggcggcucgcagaccguauagggagaaaaaaucacuacacaauuaaagaaggcauaaaauuuauagaucaaucaauaacgggucuauaugaaagauauaugacgguguga

SEQ ID NO: 5532 - RNA, 4146 nt, Artificial Sequence
  Cas9 variant
auggacuacguaaaagaauaucacaucggacucgauaucggaaccucaaguauuggcugggcuguaacagauagucaauuuaaacuaaugaggauaaaagguaagacagccauaggggucagacuuuucgaagaaggcaaaacagcagcagaaaggagaacuuuccgaacaacaagaagacgacuaaaacgccguaaauggcgacuacauuaccuagauaagauauucgcaccacaucuacaggaagucgacgaaaacuuucuccggcgcuuaaaacagagcaacauucacccagaagacccagccaaaaaccaagcauucauuggaaaacuacuauuccccgacuuguuaaagaaaaacgaaagaggauauccuacauuaauaaaaaugagagaugaacuuccaguagagcaacgagcucauuauccagugacaaacauauacaaacuaagagaagcaaugauuaacgaggaucgacaauucgauuuaagagaagucuaucuugcaguacaucacaucguuaaauacagaggacacuuuuuaaacaacgccagcguagauaaauuuaaggucgggagaauagacuuugauaagagcuuuaacguacuaaaugaagccuacgaagaauugcaaaacggagagggaucauucacuauagaaccaucaaaaguagagaaaauagggcagcuauuauuagacaccaaaaugagaaaauuagacaggcaaaaggcagucgcaaaauuauuagaaguaaaaguagccgacaaagaagaaacuaaaagaaauaaacagauagcuacagcaauguccaaauuaguacuagguuauaaagcggauuucgcaacaguagccauggcuaacggaaacgaauggaaaauugaucuauccagugaaacaagugaagaugaaauagaaaaauuuagagaagaacuaagugacgcacaaaaugauauucuaaccgaaauaacuagcuuauucagccagauaauguuaaacgcaauaguaccaaacggaaugucaaucuccgaaucaaugauggacagauauuggacccaugaaagacaauuagcagaaguaaaagaguauuuagcgacacaacccgcuucugcaagaaaggaguucgaucaaguauacaauaaauauauaggacaaguaccaaaagaaaaagguuuugacuuagaaaaaggacugaagaaaauacuaucaaagaaagaaaauuggaaagaaauagacgaacuacuaaaagcuggugacuuucuaccaaaacagcgaacaucugcaaauggaguaauaccacaucaaaugcaucaacaagaacuagauagaauaaucgaaaaacaagcaaaauacuauccaugguuagcaacagaaaacccagcaaccggagaacgagaucgacaucaagccaaauacgaauuagaucagcuaguuaguuuuaggaucccuuacuacguagguccacugguaaccccagaaguacaaaaagcaaccaguggugcgaaguucgccugggcuaaaagaaaagaagacggggaaauuacaccauggaauuuaugggauaaaauugacagagcagaaucugcagaggccuucauaaagagaaugacaguaaaagacacuuacuugcuaaaugaagauguccuccccgcaaacucacuacuauaccaaaaauauaauguauuaaaugaacuaaauaacguaagagucaauggucgcagacuguccgucggaauaaaacaagauauauacacggagcuguuuaaaaagaagaaaacagucaaagcgggagauguugcaagucuaguaauggcaaaaacaagaggaguaaauaaaccaucaguagaaggucuuucagacccaaagaaauucaauucaaaucuagccacauacuuagauuuaaaauccauuaugggagauaaaguagacgacaauagauaucaaauggacuuagaaaauauuauagaauggcgaaguguauuugaagacggagaaaucuuugcagacaaacuuaccgaaguagaaugguuaacagaugagcaaagaucggcucuaguaaagaaaagauauaaaggguggggaagauugucgaagaaacuacuuaccgguaucguagaugaaaauggacaaagaaucauagauuuaauguggaacacugaucaaaacuuuaugcaaauaguaaaucaaccaguauuuaaagaacaaaucgaucaacuaaaccagaaagcgaucacuaaugacggaaugacccuucgugaacguguagaauccguucuagaugacgcauauacaucaccgcaaaauaagaaagcaauuuggcaagugguccguguaguagaagacauuguaaaagcuguugggaaugcaccaaaaucgauauccauugaguucgccagaaaugaaggaaauaaaggagaaaucacaagaagcaggaggacucagcuucaaaaacucuuugaagaccaagcucacgaauuagugaaagacacuucuuugaccgaagaauuagaaaaagcuccagacuuaucugauagauacuacuuuuacuuuacacaagggggaaaagauauguauacaggggacccaauuaauuucgacgaaauaucuacuaaauaugauauugaccacauacuaccgcagucauuugugaaagaugauucauuagauaauagaguacugguuucuagagccgaaaacaauaagaaaucugacagaguaccagcaaaacuauacgcugcaaaaaugaaaccauacuggaaucaacuacuuaaacagggacuaauuacucaaaggaaauucgaaaacuuaacuauggacguagaucagaacauuaaauacagaucuuuaggauucguaaaaaggcagcuagucgaaacacgacaaguaauaaaauuaaccgccaauauauuaggcaguauguaccaagaagccggaacagauauaauugaaacuagagccggauugacuaaacaacuacgugaagaauuugacuuaccaaaaguccgugaaguaaacgauuaucaccaugcaguugacgccuaucucacuacguucgcagggcaauaccuuaacaggagguacccuaaacuuagaaguuucuuugucuauggagaauauaugaaauuuaaacacggcucagacuuaaaacuaagaaacuucaacuuuuuccacgaacuaauggagggcgauaagagucaaggcaaagucgucgaucaacaaacaggugaguuaauaacaacaagagaugaaguagcuaagagcuuugacagacuacuaaacaugaaauauauguuaguaaguaaagaaguucaugacaggucagaucaauuauacggagccacaauaguaaccgcaaaagaauccggcaaacuuacaucaccuauagaaauaaagaaaaacagacccgucgaucuauacggcgccuacaccaauggaacaagugcguuuaugacaauaauaaaauucacuggaaauaaaccgaaauacaaaguuauaggaguucccacaacaagcgcagucggauuaaagagaguuggaaaaccuggaucugaauccuacaaccaagaacuucauagaauuaucaaaucaaaucccaaaguuaagaaagacuucgagauaguggucccacauguuaguuauucccaacuaauaguagauggugacugcaaauuuacguuagcaagugacacauaucaacauccagcaacucagcuaguuuuaagcaaagagucaauggaaauuauagcagacgauuuuaaauucguaaaagaaaaccccgcaaccgcagacgaacaauuaguaagagucuuugaugaaauaguuaaccaaaugaaucauuauuuuacaauauucgaccaaagaucaaaucggcaaaaaguaacaaaagcacgagacaaauuugugucuuuacccacggaaagugaauacgaaggagccaaaaagacacaaguagguaaaacagaaguaaucacuaaccucuuaaugggccuacacgcaaaugccgcacaaggugaccuaaaaguucuaggucuuagcacauucggauucuuccaaucaaguggaggauugaauuugucugaagaugcaaugauaguuuaucaauccccaaccgggcuauucgaacgaagaauaugccuaaaagauauauga

SEQ ID NO: 5533 - RNA, 4146 nt, Artificial Sequence
  Cas9 variant
augaagaaaucauacgcaauaggcauagacauaggaaccaacucaguugggcacugcguuauguacacagaaaauuauaaaguaccaagcaagaaaaugaaaguguucgguaacacugaaaaacgauauauuaagaaaaaucuacuaggcacccuccucuuugaugaaggaaacacagcugaaaacagaagacuaaaaagaacagccaggagacguuacacuagaagaagaaaucguauucuauaucuucaagaaauuuucgcagaagaaauaaauaaaauugacgacagcuuuuuccagcgacucgacgauaguuucuuaauagucgaagauaaacaaggaucaaaacaucccauauucggaacauuacaagaagaaaaagaauaucauaaacaauuccccaccaucuaccauuuacgcaaacaacuagcugauucuucacagaaagcagacauacgacuaaucuacuuagcgcuagcacacauaauaaaauacaggggacacuuucuauucgaaggagaucuaaaaucagaaaacaaagacguucagcauuuauucaacgauuuuguagaaauguucgauaaaacgguugaagggucauacuuaucugaaaaccuaccgaauguagcagaugugcuaguagaaaaaguaaguaaaaguagacgguuggaaaacauucuacauuacuucccgaacgagaaaaagaacggacuuuuugguaacuuccuugcgcuagcauugggccuacaaccaaauuuuaaaacaaacuuugaauuagcagaagacgccaaaauacaauuuaguaaagaaaccuacgaagaagauuuagaggaacuucucggaaaaauuggcgacgauuacgcagacuuguuuaucgcaacgaaaucacucuacgacgggauucuucuagcuggaaucuuaucuacaacugacucaaccacaaaagcaccuuugucaucuuccaugguaaacagauacgaagaacaucagaaagaucuagcccuuuuaaaagacuuuauccgacaaaacuuaucagauaguuauaaagaauuuuucaacgauacauuaaaggauggguacgcaggauacauagaaggaaaaaccacacaagaaaacuuuuauagauuuauaaagaaggcaauagagaaaauugaaggaucgaacuauuuuauugacaaaauagauagggaagauuuucuuagaaagcaacgaaccuucgacaauggaucaauaccacaccaaauacacuuacaagaaaugcacgcaaucauacgcagacaagcagaguucuauccauuccuaguagaaaaccaagacaaaaucgaaaagauucuuacauuccguauuccguauuacguugguccauuagcaagaggaaagucagaguucgcguggcugaaaagaaaaucagacgagaaaauaagacccuggaacuuugaugaaauggucgacaaagaaaccucugcagaaaacuucauaacucgaaugacaaauuaugaccaauauuuaccagaucaaaaagugcuaccuaaacauucccuacuauaugaaaaauuugcaguauacaacgaacucacuaaagugcgauauguuacggaacaaggaaagagcuucuuuuucgacgcaaacaugaaacaagaaauauucgauggcgucuuuaaaguauaucgaaaagucacaaaagaaaaacuuauggauuucuuaggaaaagaauuugacgaguucaggauagucgaucuaaugggauuggauaaagauaacaaaucuuucaaugcaucacugggaacauaccaugaucucaaaaagauagucuccaaagaccuacuagacaacccugaaaaugaagacauccucgaaaauguaguacucacgcucacgcuauucgaagauagagaaaugauaagaaaacgccucgaaaaauacaaagauguacuaacagaagaacaacgaaagaaacuagaaagacgacacuacacgggauggggaagacuaucagcaaaacucauaaauggaauacgaaacaaaaccacacguaaaaccauacuagauuauuuaauagacgacggcacaucaaacaggaacuucaugcaacuaauucacgacgauacacucucauucguagaugaaauuagacuugcacaaggaucuggagaagcagaagauuaucgaacagaaguccaaaacuuagccggcucucccgccauaaagaaagguauacuucaaucccuaaaaauuguagacgaacuuauuggaguaaugggauauaauccagaacauguuguugucgaaauggcaagagaaaaccaauuuacaaaucaaggcagacgaucaagccaacaacgauacaagaaaaucgaaaaugcaaucaaaaacuuagacaguaacuugaacucaaaaauacuaaaagaauacccaacaaacaaccaagcacuacaaaaugauagacuauuuuuauacuacuuacaaaacggcaaagauauguauaccgaugaagaauuagauaucgaucaacuaucacaauaugauauagaucauauaauaccccaagcauuuauaaaagaugacucacuugauaauaaaguacuaacaaaaagcgcgaaaaaccgaggcaaaucagaugaugucccaucauuagaaauaguacacaaaaagaaaaauuuuuggaaacaauugcuugacagccaacuaauaucacaacgaaaauucgauaaucuaacuaaagcugaacgaggcggcuuaacaaacgaagacaaagcaagauucauacaaagacaguuaguugaaacccgccaaauaacaaaacacguugcuagaauccuugacaccagauucaauacaaaauuggacgacgccgguaacaggauaagagacccaaaagucaauauaauaacccugaaauccagucuaguaagccaauucagaaaagacuaucaauuauacaaaguuagagaaaucaacaacuaucaccaugcccacgacgccuacuugaaugcaguagucgccacagcacuacuuaagaaguauccccaauuagccccugaguucguauacggcgacuacccaaaauauaacucguacaaaucaagaaagucagcuacugaacgcguccuauuuuacaguaauauuaugaacuucuuuaaacgaguugugaaaagcaguaagacaggaacuguuaaaauacggccuauaauagaaguaaacaaagaaaccggagaaauagucugggauaaaaagagcgauuuucgaaccguccggaagguguuaucuuacccucaaguaaauguagucaaaaagacagaaguacaaaaccacgguuuagaccgaggaaaaccaaaaggauuuuauaaugccaaccuaucaccaagaccuaaagaaggaucaguugaaaaucucguaccagccaagcaaucguuugauacuaaaagguacggagguuaugccggaauaagcaauagcuacgcaguacuuguaaaugguauaauagaaaagggcaagaagaaauccaaagcagaaguaaccgaguuccaaggaauaagcauauuagcuagaaaagauuucgagaaaaaccccaaacaguaccuacugaaccucggauacaaagauaucaaaagcauaauaaaacucccaaaauauucauuguuugaacuugaaaacggaucucgcagaaugcuggcaagcauccuaucaacaaacaauaaacgaggcgaaauccacaagggaaacgaaauguaccuccccgacaaauuugucaccuuacuauaccaugcaaugcgaguuaauagaacacucgaaccaggccacaagaaauaugucgaaacccacagacaugucuuugacgaacuccuaacuuacauacuugaauacaaugagaaaauagugggagcaaaagcuaacgggaaaagaauaguugaagcguacagcgcacgaaaagacaccgacaaccucgaagaacucugcaacucauucaucaaccuauuaaaucuaacagcguuagguagugcuguagauuuugaguucuugggaacaaaaauaccacgguacagagauuauacaccaagcucacuccuaaaagcaacauuaauacaucaaucagucacaggacucuaugaaacacguaucgacuuaucuaaauuaggcggugacuga

SEQ ID NO: 5534 - RNA, 4146 nt, Artificial Sequence
  Cas9 variant
augaagaaaauuauaggcuuagaucuagggaccacaucaauaggaugggcauacgugcaugaagcagaaagugcgcaagaacgaucugaaauaguuagauuaggagcaagaguagucccucuaacaacagaugaacaagaugaguuuaagaaagguaaaaguaucacaaccaaugccgcacgauuaaguaaacgaaguuuaagaagaaaugcugauagauuccaacuacgaagagaugaauuggccggugucaugaaagaagcaggauggaucgacgaaacaacuguacuagcagaacaaggcccuagaaguaccuuugagacuuuaagauuaagagcaaaggcagcguccgaggaagucacuuuagccgaguuugcacgcauacuacuccaaauuaauagaaaaagagguuacaaaaguaaccgaaaaacggacggagaugaagaaggagcucuaauugaugggauggauguaaguaaacaacuaaaugcauccggacaaaccccuggagaauggguuuuagcaaggaugcaagaaggaaaugcuguuauuccugcauucuacuguagugacuuaagugaggaacuagacagaauuuggaggaagcaacaagcaucacaucaagcguggaugaccgaagaacugcauacagucuugagacaugcagaugguaggucagcuaucaggcuaauggacaaagcuggagugguaccagacucaguuaauguaaaagaaaggcgcagaguuauguaugaauggcgggcagccgcaguacgggacugucuaccagcggguagagucgcagcagcauuaaugcaaguaaguaaagagaucgggagagccgacucuuacuugggaaggauaggcgacagaagcaaagaacuauacuuccauaggcaaacuguaggacaauauuuauggaggcuaauaugugacaauccuaaccaaucauuaaagaacuuaguguucuauaggcaagacuaccaacacgaauuugaaacucuauggucaauucaaacaaaauaucacguagaacuaacagaagaucuccgaaaacguguaggaagaauaauauuuuuccaaagaccgcucaaaagcaagaaaggucuaguuaaucgaugugaauuaguucacuauagcgucugugaaaacagcggggaugaucuaaccgaaaaagucgauguaggaccaaaaguauguccuaaauccucuccacuuuuucaggaauuuaaaguuuggcaaguccuaaauaacguagagguuauucauccuucaacacaagaggcaagaagacucgaaauggaagaaaaagaacuacucgccagcgagcugcuuuucagagaccgaaugaagaaaauagacgugcugaaauuacuauuuucgaauuggagagaucuagaucuaaauuacaaagagcuagaaggcaacagaacuauggcagcuuucuauaggguauaugaacagguaauagcucaaacaggacauggagacuaugauuucgcaaaaaugcgagccgcaaaagucaaagagcucgcagaagguguuuuugcuggccuaggcuuugaaguaggccuacuuacauucgaugcagaacuagacaguccugcuuaugaacaacagccuugcuauagacuuuggcacuuacuauauucauaugaaggagauaaaucggccacaggcaacaaaugccuauuaaagaaacuaugucgguuaacaggaaugaacgcugaauugguaggacuauucaugcaaauaagauuuucaggagauuauggcagccuaaguacaaaagcaaugagaaggauucuacccuaccuuaaagcaggaaauacguaugauguggccugcgaauacgcugguuuuagacauuccgcccguucauuaacccgagaagaauuagcacaaaaagaauacaaagacuaucuagauuuacuuccacguaacagcuuaaggaauccagugguagagaaaauacuaaaccaaaugauacauguaguaaacggacuauccucuacauauggaaaaccggaugaaauucgagucgaaauggcaagggaauuaaagaaaucagcgagagaaagagaggaaaugacaagcgcaauuuccaaaacaacaaaagaaaaugcagaaauaacagccauauuacaaagagauuucgguuugcgcuaugucagccguaaugauauauuaagguacaaacuauauugugaauuacggauaaaagguaacgguuguagaacauuauacuccaacacauauauaaaccccaacgaacuauucucaagagaauuugacauugaacauauuauuccacaaucaagacuauuugaugacucauuuaguaauaaaacucuagagucaaggacagccaauuuggaaaaaggggacagaacagccugggacuacgucaaugaaaaauauggagcugagagagcagaugaauauagggcucaaguagaagcacuauacagggacggaacuauaucaaaagcuaaacgcgauaaacugcuuaugccaggugacaaaaucccggaagauuucauugacagagauauaagaaacacacaguauauagcaaagaaagcacuugaaauauucgaagacuuuguucccucaguaguagcaacuucuggcaauguaacagcgcgacuaagagaggauuggggucuagucgauguaaugaaagaacugaauugguccaaauacgagucgcaaggaaugguacauauagaauacgaucgagacggucgaccaauucguagaauuguugauuggacaaaacggaaugaucauagacaccaugcaauggacgcccuagcaguagcguucacaaaaagaaguuauauucaauaccugaaucauuuaaaugccagaaaagaggcaacauccguugcguacgcuauacaacacaaagagauggaacuugaugguaguaauagauggagauuuaaaugucccuuuggugauaggucagcauuccgcagagaagcuaaagcacaacuagaacgaauacugguuucaaucaaaaguaaaaauaaaguacuaacuccuagugucaauagaacaaagaaaagagggggauucaacaagaaaguagaguggacgccaagaggggcguuacacaaugaaacaguguacggaagaauuagaagauacgacguaaaagaauuaagaguagggucaaguuuuacggcagaaguuaucgguaaaguagcugauagccgauauagagccgcacuaaugcauagacuagcagaauuugguggagauccuaaaaaggcuuuuacugguaaaaacagcuuggagaaaaauccacuauauacagaugaagcucauacggccugugucccgaguaguguuaaaguaguaaguuuuguugaaauagguacuauaagaaaaggaguggacccgaaccugaauguggauaaaguuguagauacacauauuaaaaauauauuacuagcacgccuuucagcuuauggaggagacgcaaagaaagcauuuuccaaucuggacgcagauccaauaugguuaaauaaagaaaaaggaauagcgauaaaaagaguaacaauuagcgacgauucugaaguuagaccuauacacguaaaacgagauaugcgaggcagacuuguaugugacgaacauggacgaccuguaccaucugacuacguacaacugagaaauaaucaucauguggccauauucagagaugcaaauggcgaguuaaaagagcgcguaguuacauucuuugaagcaguagaacggguacgacaauuacguucugaaggucgagcaguggaaguuauagauaaaaauuacaaaugcgaagaaggauggaccuuuuuauuuucaaugaaaauaaaugaauacuuuguuuuuccugacgccgcuucaggauuugauccaagggaaaucgaccuuacggacccugcaaauuacgcacuaaucucaccucauuuauuuagaguucaaaaauuaagcucaaaagacuacuauuuuagacaccauuuagagacuaccgucaaugauguuaagcaguuaagggacauaacauggaagcgaauaucaucucuccaagauuuagcagggacaguuaaaguacggguaaaucacaucggacaaaucgucgcaguaggagaauacuga

SEQ ID NO: 5535 - RNA, 4146 nt, Artificial Sequence
  Cas9 variant
augguaaaaaaaaaauacgccauuggcauugauauaggaacaaacaguguagguuggucaauaguaacagacgauuauaaaguaccaucgaaaaaaaugaaggucuucggaaacacugaaaaaagauacauaaaaaaaaacuuacugggaacacugcuuuucgacgaaggcaauacugccgaaaacaggagacuuaaaagaacggcgcgccguagauacacccgucguagaaaccgaauccuauacuuacaagagauauucgcugaagaaauaaauaaaauagacgauagcuucuuucaaagguuagaugacaguuucuuaauugucgaagauaaacagggaucuaaacacccuauauucggaacucuucaagaagaaaaagaauaccauaaacaauucccaaccauuuaccaucuaagaaaacaacuagcagacucaucgcaaaaagccgauauccgccucaucuaucuagcacuagcccacauaauaaaauacagaggacacuuccuauucgaaggagaccucaaaucagaaaauaaagauguacaacauuuauuuaaugauuucgucgaaauguuugacaaaacaguugaaggauccuaccuaucugagaaucugccaaacgucgcagacguucucgucgaaaaaguuagcaaaagcagacgacuggaaaacauacuacauuauuucccaaaugaaaaaaaaaacggcuuauucggaaauuucuuagcuuuagcacuaggguuacaaccgaacuucaagacaaacuuugaacuagcugaagacgcuaaaauccaguucuccaaagaaaccuacgaggaggaucuagaagaauuacucggcaaaauuggagacgacuacgcagacuuauuuauugcaaccaaaaguuuauaugacggcauacuacuugccggaauacucucaacuacagacucuacaacuaaagcacccuuaucuagcaguaugguaaacagauaugaagagcaucaaaaagaucuagcccuacuaaaaaacuuuauacaucagaaucuuucagauuccuauaaagaaguauucaacgauaaauuaaaagauggcuaugcaggauacauagaagguaaaacgacacaagaaaauuucuauagauucauaaaaaaagccauagagaaaauagaaggcaguaacuacuucauagacaaaauagacagagaagacuucuuacgaaaacaacgaacauucgauaacgguucuaucccacaucaaauccaccuacaggaaaugcacgcaaucauacgacgacaagcagaauuuuauccguucuuaguagaaaaucaagacaagauagagaaaauacuaacauuccguauaccguacuacguaggaccccuagcuagaggaaaauccgaauucgcauggcuaaacagaaaaucugacgaaaaaauucgacccuggaacuucgaugaaaugguagauaaagaaacauccgccgaaaacuucauaacacguaugacaaacuaugaccaguaucuaccugaucaaaaaguacuaccaaaacauucacuauuauacgaaaaauucgcaguauauaaugaacuaaccaaagucagauacguaaccgagcaaggaaagucuuuuuuuuuugaugcuaauaugaaacaagaaauauuugauagaacguuuaaaguauaccguaaaguuaccaaagaaaaacuaauggacuuccugagcaaagaauucgacgaauucagaauaguagaccuacuaggcuuagacaaagacaacaaaagcuucaaugcgucuuuaggcacauaucaugaucugaaaaaaauagucagcgaagacuuccuagauaacucagaaaacgaagacaucuuggaaaauguaguauuaacacuuacauuauucgaagacagagaaaugaucaggaaacgacuagaaaaguacaaagauguuuuaacagaagaacaaagaaaaaaacuagaaagaagacauuacacaggauggggccgacuuagugcuaaauuaauuaauggcaucagggacaaaguaacacguaaaaccauacucgauuauuuaauugacgauggaacaucgaauagaaacuucaugcaacugauaaaugacgacacauuaagcuucguggacgaaauaagacuugcucaaggaucaggaaaagcugaagacuacagagcagagguacaaaaucuugccgguagcccagcuauaaaaaaagggauacuccaaagccuaaaaaucguagacgaacuaauagaaguaauggguuacgaucccgaacacauuguuguggaaauggcucgggaaaaccaauuuacaaaccaaggucgaagaaacucacaacaaagauauaaaaaaauagaaaaugcaauaaaaaaucucgacucaaauuuaaacucaaaaauucucaaagaguaucccacaaacaaccaggcacuacaaaacgacagacuguucuuauacuaucugcaaaacggaaaagacauguacacagaugaagaauuagacaucgaucaacuaucacaauacgauauagaccacauaauaccacaggccuucauaaaagacgauagcuuagauaauaaaguauuaacaaaaucugcuaagaaccgcggaaaaucugaugacguaccgagccuagagaucguauacaaaaaaaaaaacuuuuggcaacaacuguuggauucucaauuaaucucgcaacgcaaauucgacaaccucacaaaagcggaacguggcggauuaacaaaugaagauaaagcuagauucauacaaaggcaauuagucgaaacacgacaaauaacaaaacacguugcacgcauauuagacaccagauuuaacacaaaacuagacgaagcaggaaaucguaucagagacccuaaaguaaauaucauaauacucaaaucaaauuuagugucccaauuccgcaaagauuaucaacuauauaagguuagggaaauaaauaacuaucaucaugcgcacgacgcauaucugaacgcaguagucgccacagcauuacucaaaaaauacccacaauuagccccagaauuugucuacggugaguauccaacauacaauuccuacaauagcaggaaaagcgcaacggagaaagucuuauuuuauucaaauaucaugaacuucuucaaaagaauaguuguccacucaaaaacaggagaaguucgaauaagaccaguaauagaagucaauaaagaaacuggagaaauaguuugggauaaaaaaucaaauuucagaacaguaaggaagguuuuaucguacccacagguaaacgucgucaaaaagacagagguacagaaucacggauuagaccgcgggaaaccuaagggauuuuacaaugcaaauuuauccccucgaccaaaggaagguaguguugaaaacuuaguaccugccaaacaaaguuuugauacuaaaagauacgggggauaugcaggcauuagcaauucauacgcgguuuuagucaacggcauaauagaaaaaggaaaaaaaaaaagcaaagccgaaguaaccgaauuccaaggaaucagcauauuagccagaaaagauuucgauaaaaauccaaaacaguacuuauuaaauuugggauauaaagacaucaaaaguauuauaaaauuaccaaaauauucucucuucgaacuagaaaaugguucgcgucgaauguuagcaucaauacucucaaccaauaacaaacguggagaaauacacaaaggaaacgagauguauuuaccagauaaauucgucacucuucucuaccaugcaaugaggguaaacagaacguuagaaccaggacacaagaaauaugucgaagcgcaccgacauguauuugaugaacuacuaaccuacaucuuagaauauaaugaaaaaauagucggggcuaaagcaaauggaaaacgcaucguagaagcauacagugcaagaaaggacaccgacaaccuagaagaacucugcaacuccuucaucaaccuauuaaaucuaacagcucucggaucagcgguagauuucgaauucuuaggcaccaaaauaccaagauaccgagacuacacaccaagcucacuacuuaaagcgacacuaauccaucaaucaguaacuggacuauacgagacaagaauagaccugucaaaacuaggaggagauuga

SEQ ID NO: 5536 - RNA, 4146 nt, Artificial Sequence
  Cas9 variant
augguuaaaaaaaaauaugccauaggcauugauauaggaacaaacuccgucggauggagugucgucacagaugacuauaagguucccucaaaaaaaaugaaagucuuuggaaacaccgaaaaacgauauaucaaaaaaaaccuacuaggaacauuacuauuugaugaagguaauacggccgaaaauagacgcuuaaaaagaacagccagacguagauacacacgacgacgaaaucgaauacuauacuuacaagaaaucuuugcagaagaaauaaacaaaaucgacgacucauuuuuccaaaggcuagacgauucauuucuaauuguugaagauaaacaaggauccaaacacccaaucuucgguacauuacaagaagaaaaagaguaccacaaacaguuuccaacaaucuaccaccuccgaaaacaauuagcggacucaucacagaaagccgacauaagacuaaucuaucuagcauuggcacacauaauaaaauauagaggccauuuucucuucgaaggcgaccuaaaaagugacaacaaggacgugcaacauuuauuuaaugaauuuguagaaauguucgacaaaacaguagaaggcuccuaucucagugaaaacauaccagauguagcggacaucuuaguagaaaaaguaucaaaaucaagaagacuagaaaauguauuacaauauuucccaaacgaaaaaaaaaauggauuacuagggaauuuuuuaucccuagcguuaggacuacaaccaaacuuuaaaaccaacuuugaauuagccgaagaugccaaaauacaauuuuccaaagagacuuaugaagaagaucucgaagagcuccuagguaaaauaggggacgacuaugcagaucuguuuauugcaacgaaaucauuauacgacggaauucuccuagcuggaauccucucaacaacagacuccacuacaaaagcaccacuuaguuccucuauggucaaucguuaugaagaacaccaaaaagaccuagcacuacuaaaagauuuuauaagacaaaaccuaucagauucauauaaagaaguguucaaugaugcgcuuaaagacggguacgcuggauacauagaaggcaaaacaacacaagaagauuuuuauaaauucgugaaaaaaacaauugaaaaaauagaagguagugauuacuuuaucgacaaaauagauagagaagauuucuuaagaaaacaaagaacauuugacaacggaucgaucccucaccagauucaccuaaaagaaaugcaagcaauaauaauaagacaagcaaaauuuuacccauuccuagaagaaaaucaggauaaaauagagaaaauacuaacauuuagaauuccuuauuacguaggcccuuuagcccgaggaaauucagaguucgccugguuaaauagaaaguccgacgaaaaaauuagaccauggaacuuugaugagauaguugacaaagaaacaagugcagaaaauuuuauaacacgaaugacuaauuacgaucaauaucuaccggaccaaaaagugcuacccaaacauucacugcuauaugaaaaauucgcaguauauaaugaauuaacuaaagucagguauguuacagaacagggaaaaagcuucuuuuuugaugcuaauaugaaacaagaaauuuuugacggagucuuuaaaguauacagaaaaguaacaaaagaaaaauugauggauuuuuuagguaaagaauuugaugaauucaggauaguugaucuccuuggcuuagauaaagauaacaaaucuuuuaacgccagucuaggaacauaccacgauuuaaaaaaaauaguaucuaaagaccuacuugacaacccugaaaaugaagauauccuagaaaauguagugcuaacgcuaacacuauuugaagacagagaaaugauacggaaacgucuggaaaaguauaaagaaguucuuacagaagaacaacgcaagaaauuagaaagaagacauuacacagguuggggcagauugucagccaaguugauaaaugguauacgggauaaaguuacccgaaaaacuaucuuagacuaccuaauagacgacggaacaucaaauagaaauuuuaugcaacugauaaacgacgauacgcuaaguuuuguugacgaaauuagacuagcucaagguucuggagaagcggaagauuaccgagcagaaguacaaaaccucgcagguaguccagcuauaaaaaagggaauuuuacaaucauuaaaaauuguugacgaacuaaucgaaguaaugggauacgaaccagaacacaucguaguagaaauggccagagagaaccaauuuacuaaccaaggacgaagaaauucucaacaacgauacaaaaagauagagaacgcuauuaaaaaucucgacucaaaucuaaauucaaaaauucuuaaagaguacccaacuaacaaccaagcccuccaaaaugacaggcuuuuccuauauuaucuacaaaauggaaaagauauguauacagaugaagaacuugacauagaccaacucagucaauacgacauugaucacaucaucccacaagcauuuauuaaagaugauucgcuugacaacaaagucuuaacaaaaucagcuaaaaauagagggaaauccgacgauguaccaucacuugaaaucguauauaaaaaaaaaucguucuggaaacaacuccuugacucacaauugaucucgcaacguaaauucgacaauuuaacaaaagcugaaagaggcggauuaacaaacgaagauaaggccagauucauacaaagacaauugguagaaacacgccaaauaacuaagcacguggccagaaugcuggauacacguuuuaacacgaaauuagacgaagcuggaaaccguauacgagauccgaaaguuaauauaauaacauuaaaaaguaaccuagucucacaauuucguaaagauuaccaacuauacaaaguuagagaaauuaacaacuaucaccaugcacaugacgcauaccugaacgcuguuguagcaacagcauuauuaaaaaaauacccacaacucgcaccagaauuuguuuacggagaauaucccacauacaauucauauaauucacgaaaaagugccaccgaaaaaguauuauuuuauuccaacauaaugaacuuuuuuaaacggauaguaguacacuccaaaaccggagaaguacgaauaaggccgguaauagagguaaacaaagaaaccggagaaauagucugggacaaaaaaagugauuuucgaacuguucgaaaaguacuaucuuauccacaaguaaauguaguaaaaaaaacugaaguacaaaaucauggacucgauaggggaaaacacaaaggcuuuuacaacgcuaacuuaaguccucgcccaaaagaaggaagcgucgaaaaucucguacccgccaaacaaagcuucgacaccaagcgauacggaggauacgccggcaucaguaacucuuaugcaguccuaguaaauggaauuauugaaaaaggaaaaaaaaaaucaaaagcggaaguaacagaauuccaaggaauaucaauacucgcgcgcaaggacuuugauaaaaaccccaaacaauaucugcuaaaucuuggauacaaagauaucaaguccauuaucaaauuaccaaaauacucuuuguucgaacuagaaaacggaagcagaagaaugcucgcgucaauuuuaucaacuaacaacaaacguggcgaaauccacaaagggaacgaaauguaccuaccggacaaauuuguaacccuauuauaucacgcaaugaggguaaauagaacuuuagaaccuggacauaaaaaauauguugaaacucaucgccacguguucgacgaacuccuaauauacauauuagaauacaaugaaaaaauaguaggagcaaaagcgaauggcaaacgaaucguagaggccuacucagcaagaaaagacacugacaaccuugaagaacuauguaauucauucaucaaucucuuaaauuugaccgcacuuggcucagcaguagauuucgaauuucuaggaacaaaaauaccccgauaucgggauuacacgcccucaucacuccugaaagcaacuuuaauccaucaaagugucacuggauuguacgaaacccgcauugacuuaucaaaacuaggaggagacuga

SEQ ID NO: 5537 - RNA, 4146 nt, Artificial Sequence
  Cas9 variant
auggucaaaaagaaauacgcuauaggaauagacauugggacuaauucggucggcuggucuguaguaacugacgacuauaagguuccaagcaaaaaaaugaaagucuucggaaauaccgagaaaagauauaucaaaaaaaauuuacuaggcacucuauuauucgacgaaggcaacacagcugaaaaucguagauuaaaaagaacagcuagacguagauacacucgaagaagaaacagaauuuuauauuugcaggaaauuuucgcagaagaaauuaacaaaauagacgacucuuuuuuccaacgucuugaugauagcuuucuuauugucgaagacaaacagggcaguaagcacccaauauuuggaacuuuacaagaagaaaaagaauaccauaaacaguuucccacaauuuaucaccuacgaaaacagcuagcagacucaagucaaaaagcagauauccgauuaauauaccuagcauuagcgcacaucauaaaauaucgaggacauuuucuauucgaaggagacuuaaaaagugaaaacaaagacguacagcacuuauucaacgacuucgucgaaauguuugacaagacuguugaaggcucauaucuuucagaaaaccuaccaaauguagcagauguacuagucgaaaaaguaucaaaaucucgacauuuagaaaauauuuuacacuauuucccaaacgaaaaaaaaaauggacuguuuggaaauuuccuagcauuagcauuaggacuacaaccaaacuucaagacaaauuuugaacuagcagaggaugcuaaaauacaauuuucaaaggaaacauaugaagaagaccuagaagaacucuuaggaaaaauuggcgaugacuacgcagaucuuuucaucgcgacaaagagucucuacgacggcauucuucuggcugguauauuaagcacuacuaauucaacuacgaaagccccacuaucgucaagcauggucaauagauaugaagaacaccagaaagaccuagcguuauuaaaaaacuucauccaucaaaaucuaucugauaguuauaaagaagucuuuaacgacaaauuaaaagacggguacgccgguuacauagaagguaaaacuacccaagaaaauuuuuaccgcuuuauaaaaaaagcaauagaaaaaauagacggaucaaauuacuucaucgaaaaaauugaaagggaagacuucuuaagaaaacaaagaacauucgacaauggaucuauaccacaccagauucaucuacaagaaaugcaggcaaucauacgaagacaagcgaaauuuuacccauucuuagaagaaaaucaagacaagauugagaagaucuuaaccuucagaauaccauacuauguuggaccccucgccagaggaaaaagcgaguuugcaugguuaaauaggaaaucagacgaaaaaauaagaccuuggaauuuugacgaaauggucgauaaagaaaccuccgcaaaaaacuucauaacacgaaugacaaacuaugaucaauaccuaccugaucaaaagguauuaccaaaacauucauuacucuacgaaaaauuugccguauacaacgaacuaaccaaaguccguuauguaacagaacaaggaaaaucauuuuucuuugacgccaauaugaaacaggaaauuuucgauggaguauuuaaaguuuauagaaaaguaacaaaagaaaaacuaauggauuuccuuggaaaagaauuugacgaauuuagaauagucgacuuacuaggccucgauaaagaaaacaaaucuuucaaugcaagccuaggaacauaucaugaucuuaaaaaaauaguaucaaaagacuuccucgacaacagugaaaacgaagauauccucgaaaauguaguacugacacucacauuauuugaagaucgagaaaugauccgaaaacgccuagaaaaauacaaagacauucuaacagaagaacaaagaaaaaaacuugaaagaaggcacuauacaggauggggucgacucagcgccaaacuaaucaauggaaucagagacaaagucacacgaaaaacgaucuuagauuaucuaauagacgaugguacuucaaacugcaacuucaugcaauugauaaaugacgauacauuaucauucguugaugaaauuagacuagcucaaggaaguggugaagccgaagauuaccgagcugaaguucaaaaucuagcaggcagccccgccauaaaaaaaggaauccuacaaucacuaaagauuguagaugaacuuaucgagguaauggguuacgacccagaacacaucgucguggaaauggcuagagaaaaccaauucaccaaccagggccgacgaaacagccagcaaagauauaaaaaaauagaaaacgcaauaaaaaaccuagauucaaauuugaauucaaaaauacuaaaagaauauccaaccaauaaccaagcucugcaaaacgaucgacucuuuuuauauuaucuacaaaacgguaaagacauguacacugacgaagaacuagauauagaccaacuaucacaauaugauaucgaccacauuauaccacaagccuuuaucaaagaugacucgcuggacaauaaaguacuuacaaaaucggcaaaaaaccgagggaaaucagacgacguacccucauuagagaucguauacaaaaaaaaaucauucuggaaacaauugcuugacucccaacuaauuucgcagagaaaauucgacaaccuuacaaaagcagaaagaggcggucuuacgaaugaagacaaagcacguuucauacaaaggcaauuaguugaaacaagacagauaacuaaacacguagcucggauguuagacacccgauucaauacaaaacuggaugaagccggcaauagaauaagagacccuaaagugaauauuauaacacuuaaaagcaaccuaguuucacaauuuagaaaagacuaccaauuauauaaaguccgagaaauaaauaauuaucaucacgcgcaugacgcauaccuaaacgcuguuguggccacagcacuacuuaaaaaguauccgcagcucgcgccugaauuuguuuauggcgaauacccaacauauaacagcuacaacagcagaaaaucagcaacugaaaaaguuuuauuuuauucaaacauaaugaauuucuucaagagaauaguaguacauucaaaaacaggagagguaagaauuagaccagucauagaaguaaacaaggaaacaggcgaaauagugugggauaaaaaaucagacuuucguacaguaagaaagguauuauccuauccccaagugaacguaguuaaaaaaacagaaguacaaaaucacgguuuagauagaggaaaaccaaaaggauucuauaacgcaaaccucucuccacgaccuaaggaaggcagcguagaaaaccuaguaccagcaaaacaaucauucgauacuaaacgauacgguggcuaugccggaaucuccaacucuuaugcuguuuuagugaauggaauaauagaaaagggaaaaaaaaaaucaaaagccgaaguaacggaguuccaaggaaucagcauauuagcaagaaaagacuuugacaaaaaucccaaacaauauuuauuaaauuuaggauacaaagauauaaaaucuauaauaaaacuaccuaaauacucauuauuugagcuagaaaacggcagccgaagaaugcuagcuucuauauuaucaacaaacaauaaacgaggagaaauucauaaaggaaacgaaauguaucuuccugacaaauuuguaacauuacuauaccacgcaaugagagucaacagaacucucgaaccagggcauaaaaaauacguagaaacgcaccgucacguauuugaugaacuguuaaucuauauacuagaauacaaugagaagauuguaggagcaaaggcuaaugggaagagaaucguggaagcguauuccgcaagaaaagacaccgauaaucuagaagaacuuuguaacagcuucauaaaccuucuaaaccuaacagcucuuggaagcgcaguugauuucgaauuccuuggaacaaaaauaccacgguauagagauuacacaccauccucauuauuaaaagcuacacucauacaccaaucaguaaccggucuuuacgaaacgagaauagauuuaagcaaacucggaggagacuga

SEQ ID NO: 5538 - RNA, 4149 nt, Artificial Sequence
  Cas9 variant
augaagaaaauagugaauuacaaucuaggccucgauaucggcacuucgucaauaggauaugccgcaaucgacgaccaaggucgaccuguaagacaccaaaacaaaaccguaaugggaguccgacuauuuaaagaagguaaaacagcagaaaguacaaggauauucagagguacccguaggcgacucagucacagacauuggaggcuuggauacuuagacagaauauuugauaaugagauagccaagguggaugaaaauuuucuaccgcgacuaaaagccagcaaaagggcacgaucugaugaaaaacgaaguuuuagaggaucacuucucuucccagagacuggcgaugaugcauauuaccaaaaauauccaacaauauaccaucucagauaugcauuaauaacccagaaaaagcaauuugacauccgucugauuuaucuugcccuucaccauaugauaaaauauagaggcaauuuucuagacacaaccccgguauccgcuuucaacauacacgauauagaucuuacagaucaauuugcaucgcuaaacgauuguuaccaacuauuagauauggacuucgaguuccaauuugacuugaauaauaucgaacaaguccaaaaacuccuucuugaugaaaccuuaucgaaaacuaaaagacaagcggcaguuagcaaaguccucguaaugagcacaggcaauaaggcauuugaugaccaacaaaacggcauagcuucagaguucaucaaagcccucuugggaggaccauuugaccugucgaaaauuuuaaaucuaucaguggccgauguaaaauccuggaaacuacacaugacugauaaagacguagacgauacacuaaacagccuaguugaagaauuagacgaaaaucacaagcaaauuguaaaucuacuucaaaugauauacagucaagucaugauguuaggucuacuuaauggacaacaaucuaucucugcaucaaugauugaaagauacgacgaccaugcuaaacacugggccgccuuaaagaaacuccuacccgcccuaggugaacaagaacaauccacgaucauucaugcguauacggcuuacacaggacacucucguacuaaacaacuauccagggccgaguucuauaccaaaguaaacucuauucuuaagaaacaugaaaacauugcagaagcaaccgguuugauugaacuaauugauaggaacgaguucaugccaaaacaaagagacgcaguaaacggaguuaucccucaccaauuacaccaacgagaauuacaacuaauaauacaaaaccaacaaaaauacuauccauuucuagcagcaaaagcauacccggaugccgaugaaacaaugauagaacaguugcuuagcuuucguguuccuuauuacgcaggaccacuugucgaccgugacuuuauuaacgaaagcagugaccaagaacaagcuaugcaaaauacaaaauuuaguuggcuaaaacgaagagaagcaggagaaauuacaccauggaauuucgaacaaaaagucgauguucaagagacagcuaauagauucauuaaacgcuuaacaaccaaagacacauaucugaugacagaagacguacuaccgaaagaauccuuaaucuaucaaagauuugaaguccuaaacgaacuaaaugcaauaaggauaaacgauaggagacuaacugcagaaaauaaacaacuagcauuucaacaauuauuuauggcaggcaacacuaaaaauguaagcauuaagaaauucaggaacuuuguauuugauucauuaaaauuuccagagaaagugaaaauaacaggauucgcaggccaacacaacuuccuagccaaacuaagcacauaucaugauuuuaaaaagauauucggagaaagaguagaucacacugacuuacaaccagacuucgaaagaauaguugaauggugcacaauauucgaggaucgacacauauauagagaaaaacucaaagaaauacaauggcugagccaaagcgaaauagaccaauuaguacucauacgaaaucaugguugggguaggcuauccaaacgccuucuaaccggaauuagagacagugauggacgcacuguaauggaccaauugugguuugguacugauaauuuuaugagaauaauaucucaaucagacuuugccgcagcaauagcaaacgaaaauagaacgcaacuuaaccaacacggcuuagaagacgucuuagacuccgcauuuaugucuccacaaaacaagaaagcaauaagacaagucuuaaaagucguagaugacaucgaacaaacccugggaugucccccaaagaaagucaugauagaauuuacccgcucaccagauaaaaagaaacaacgaaccgucacgaggcuugagaaaguacaacaagcauacaaagccguagcggaccaauuagcgggccaaucgaucgucucagagcuugaccaauacgcuaacacucauucaaaacugucagacaccuauuaccuuuauuucaugcaauuagguagagaucuguauagugggaaacccauagacaucgacucccccaugcuagacgacgaucacauccucccuagggcauuuaugaaagacaauucacuagacaacagagcucuaacagaaaaaccgauaaauaauacaaaagccgccaaauuccccucuaaaguauuugggcaacaaaaagaaguaacagacuuuuggaaacuucuacguagaugcgggcuaaugucuaauauaaaagaaaaacacuuauaucuagacccggacaauguggacaaauggacccgaagaggauuuauucaccgacagcuaguugagacaucacagguaauaaaaaucguugcuaacauuuuaaacgaccgauaucaacaaucacaaacagaaguccuagaaguaccugccaggcuaggcacagaacuacgcgaaugcuucggaugguacaaagucagagaaguaaacgauuaccaucacguauuugacgcauacuuagccgcauuuauaggaaacuaucuauauaggagauaccccaaauuacaaccuuacuuuguauacggcaauuuugccgaacuuaacaaagcucaauuaaagaauauaaaaaguuuuaauuuucuauacaacauuacagacaacaaacgagugguaaaagacauugaaacgggacaaacauuaugggaugaucaaauaagacaacaaauacaacauauauacgaauacaaauauauguuaacaucccacgaagccuuuacacaacacaaagaacuuuauggacaaacaauauauccuagacgagaauuuaaaccaggcacacuaaaagccauaaaacaagaucaaccucaagagcuguacgguggauacaaaaaucuaacagcugcuuacaugugcauaguaaaaauucaagcacguaaacgacgcgcagcugaauacagagucguacgaguugcaacagagucucucagcgcacuacaacaagcaaaacguuuaggcguucaagcguaugaacgaugucucaggcaagaauuaguacgaaauaacgaaauccucagaacaaacgccgaucccaauucagcaccacgugaguucgaaguacuucuagaucguguacuaugucaucaaaugaucauauccgauggacaaaaauaccuacucgggucucacgcauauaaaauaaauuguaugcaauuaguacuaaguaacaauucaaugaagauccucuccaccuccauaguuaaauuaaaacaaaugacaaacgaaccguuaguacaaguauaccgcgaaauucuagacgucgucaauaaauauuucacgcuauacgacgucaauucauucagggaaaacuuaaaucaauucuucgauaaauuuagaacauuaccaauuaccaacgaauacgaaagcucuaagucaggaaagaaacuaauacacagaggucaauuagaaacacucacccuaauccuacggggcuuacaugcuaacagugacaaaguucaauacggugaucaaaguacacuacuaggcgguuuucaaacaaaagacgguauaaaauuaagcaaagauucaguaauucaauacacuucaccagccggccuaaauguccguacugucaaauuaagagaucuagagcaaaaagaagcucagaaauga

SEQ ID NO: 5539 - RNA, 4149 nt, Artificial Sequence
  Cas9 variant
augguagacgagaaaauauuuuggggacucgauaucgggaccgacuccguugguugggcgguaacaaacucagaauacaaacugaagaaauacaaaaauaaucuuaugugggguguacaccuguuugacgaagcaaaacagucagcugaacgcagaucguuucgaaccgcuagacgccgauuagacagaagaaaacaaagaauuauacuauuacaggaauuuuucgugagagcaguuugcgaaaaagacgaaaacuucuuucgucgauuaaaagaaagcgcauuauuaccagaagaugcagaacacaggacgaacaauauauucuuugacgacccugauuauacugacaaagauuauuuugaggaauacccaacuauacaucacuuaauuugugaacuaauggaaucuaaagaaccacacgauguaaggcuaguauacuuagcaugcguauacuuacuagcacaucggggacacuuucuacuaccgguaucggaggaugacauaucaaaaguaacagaauuugaaccucuguaugaaucauucuacaaagcacuggaagaaaaauuagacgacgaaccgccauuugaccgaucggcugacgacuuugcagaaauacuaaaaucacauaaaacuguaagcgccaaaaacaaagauuucgauaaacuacuauuuggagguaaaguaaaaacguacgacaaugaaaacauaucguauucagcauuaaucaaacuuuuaucuggaggaacagaaaaacuaucaaaauuuuucgccaacgaagaauacacagaccuagaaaaagacucagugugcgugagaaaugcugacuuuggagauacacuagaaauguuagagggacaaaucgaugaauuagauuuugcauuacucaaaucaguuaaaucacuguacgacuggagccuccuaguggauauacuagaaggaaaaucccuaaucucggaagcaaagaaagacaaauaugacgaacacggauaugaucuugaugcacucaaauaccuauuuagagaauacuugacaaaagacgacuauaaugaaauguucaaagaaguaucaggaaaacagaauuaugcgucauacguuuacaaugcaaguagcgacaaaacaagagacucaaaauacaagaaaugcucacaaaaagauuuuugcaaauucacuaagaaauucuuaucaaaaauaaaaccaaaugaaaaagauaaaccgugcuuagauaaauuacucgaaaaaugugaacagaacucguuaugcccaaaacaaguaacaaccgacaacagaguaauaccauaccaauuguacuacguagaacuuaagaaaauuuuagaaaaugcauguggcuacuuaccauuccuaaaugaaagagaugaauauggcacaguggcagacaaaauucuuucaauaaugaaauuuagaguaccguauuauguaggaccccuaguagacagcaagaaauccccaaaugcauggcuaguaagaaaacucgaugguaaaauaacaccauggaauuuuacagauauggucaaugaagaugaaucagaaaaugccuucauaagacguaugacaugcaaauguacguacguugcaggacaggacguacuaccuaaauauucauuacuauauucaaaauucuccguacuaaaugaaauuaauaauauaaaacuaaacggagaaccaauaaguguacaaaccaaacaagaaauauauacagagcuauucgagaggaacaaaagucguguaucgaagaagaaaauuagagauugccuaauaagucacgguuaugcagcugacucagacgaagucacagguauagaugauauagccaaaucagcguuaagauccuaccaugacuucaagaaaaugcucucgaacggaauacuaacagaacaacaaguagaggaaauaauagaacacauuacugucacuacugauaauauaagacucaagaaaugguuaaaaacgcaauuuccuaugcuagcagacgaagauguaaaauacaucacaaaacugaaauauaaagauuacgggagauuaucgcgauguuucuuagaagacguacucccaguagacacaaaaacaggagaagccgaaagcgacaaaaauaucaucacaaugcucugggaaacaaacgaaaacaucaugcaguuacuaagcaguaaauacagauacuccgagaauauugagcacaugaacagacaauacuacgcacuaccugaaaaccacaaaucaaugagugaacgacuuaaagacauguauguaccaacagcaguaagacgggcagugacgagaacauuugacauugucaaagaauuaaagaaaauccaagggagagacccagacaaaauuuucauugaaauggcaagaggcacuggugaaacuccaaaaggaaaaagaaccaauucaagaaaagaccaaauuuuagaacauuggcacggcuuagacaauaaagauauaaacgaucucaagaaaucgggaauaugggaacacuuggacacaauugaugaugccaaacuaaggucagacaaauacuuccucuauuucaugcaacuaggccgauguauguacacagagaaaccgauaccguucgaagagguagaaaaugaacauaaauggaauauagaccauauauggccacaggccaaaauaaaagaugacucacuugacaacaaaguacuugucaguaguaacgaaaauggcaagaaaucagauagcuacccaauauccgacgacauacgacacagcauggcaggacuauggcacucucuuuacaagaaagguuuaauaagugagaagaaauaccaaaggcugacaaggucaacaccuuuuaccgaugaugaguuaagcggcuucauagcucgucaauuaguugagaccagacagucuacaaaagcagucgcuacguuauuaaaagaacaguucccaaacacugaaauaguauacguaaaagccgguuuagucucugauuucagacaagaaauggguauguuaaaaugucgagaaguaaaugacuuacaucacgcaaaagaugcuuauuuaaauauuguuuuagguaacguauacaauacaagguucacaaaagacccauuaaauuucguaaagaauaacgagaaauacucaauaaaaauauuccagaaaaacucagauggcaagaaaaccggaguaauuacaagaaaaguagagagagguggagaaguugcaugggaucccgagacaucauuugcuaucguccgaaaaaugaugagcaaaaauucaauacgguacguuagauaugcauacaugagaaaaaguggccaaaaugguggcuuuuucgaucaaaacccgcuacguaaaggaaaaggcauggucagcauuaaacacaaucuaucuauagaaaaguacggcggauaugacaaugccacuauuagcuucuuuucgcuagucucaauaaaagauuuuggggucauauuacuagccguagaacuauuaucagcaaacaaauuucuaaagaauauaucagaggcuaaagaauacgcagcagacaaacuaucaaaagaacugaacgucaaaauagugccaaacgauguggccuucccacuaaauaauagguacaacgucgugaaaaucaacgcaguguuggaacuagacgguuaccgggucaugaucgccgcaaaacaaaacaguaguaucaaguuuguaucaaaugaaucacuaauacuaaguucgcaacauauggcauauguaaagaaaauaacgaaauuuaucgagaaaagaaaacaagauaagguauguaugauaaaugccuuuucagggauaagcauagaagacaauauagaauuauaugaugugcuaguaagcaaaugcaacaucaaaccauucaauauaauguaugagaacuuaggaaucaaauuaucagauaauagggacaauuucaucaagaaaaguguagaaaaucaaguauuaauauugagcgaaaugguuagguuguuuaaaacaggaagaaaagccgguguuaaucuagaagaaguaggaggcagaaagaacucugguguaaaaacauuaaacacaugccuauauaaaguaaaagauuacucuaauauauucuuaguagaucaaagcccaacaggauuaauagaacacaaguccccaaacuuauuggacuuguga

SEQ ID NO: 5540 - RNA, 4155 nt, Artificial Sequence
  Cas9 variant
augaauaaacccuauucaauagguuuggauauaggcacaaacaguguaggauggucaauaauuacugaugauuacaaaguaccagccaagaaaaugagaguauuaggaaacacagauaaagaauauaucaagaaaaacuuaauaggugcucuacucuucgaugggggaaacacagcagcagacagacgguuaaaacgaacagcacgucgacgcuacacucguagacgaaaccgaaucuuauaccuucaagaaauauucgcagaggaaaugucaaaaguugacgacucauucuuccauagacuagaagauucauuccugguagaagaagacaaacgcggcucaaaauacccaauauuugccacucuacaagaagaaaaagacuaucacgaaaaauucucaacuauauaucauuuaaggaaagaacuggccgacaagaaagaaaaagcugauuuaagacucauauacauagcauuagcucacauaauaaaauuucguggucacuuccucauagaagacgacucauucgauguucgaaacacagauauaagcaaacaauaccaagauuuccuugaaauauuuaauacaacuuuugaaaacaacgacuugcugucacaaaauguagacguagaagcaauccucacagauaaaaucaguaaaucagccaagaaagaucgaauacuugcacaauaucccaaccagaaaaguacaggcaucuucgcagaguuccuaaaauuaauaguaggcaaccaagcagacuuuaagaaauauuucaaucuagaagacaaaacaccguuacaauucgcgaaagauucauacgaugaagaccuagaaaaucuuuuaggccaaauaggagacgaguucgcugaccuauucuccgccgccaagaaacuauaugacucaguuuuacuaagcggaauacuuacuguuauugaucuaaguaccaaagccccacuaagcgcgagcaugauacaaagauaugacgaacauagggaagaccuaaaacaacugaaacaauucguaaaagcaagucuacccgaaaaauaccaggaaauauucgccgacucaucaaaagaugguuaugcaggauauauagaaggaaaaacgaaucaagaagccuucuauaaauaucucaguaaacuauuaacgaaacaagaagacucagaaaauuucuuagagaaaauuaaaaacgaagacuuuuuacguaaacaaagaacauuugauaauggauccauaccacaucaaguacaccucacugaacucaaagcaauaauuagaagacaaucugaauacuacccuuuccucaaagaaaaccaagacagaauagagaaaauacucaccuucaggauuccguacuacaucggaccacuugcuagagaaaaaucagacuuugccuggaugacaaggaaaacagacgauucgauccggcccuggaauuucgaagauuuaguggacaaagaaaaaucagcagaagcauuuauucauagaaugaccaauaaugacuucuaucucccagaagaaaaaguucugccaaaacacagucugauauacgaaaaauuuacaguauauaacgaauuaacaaaaguacgauauaaaaacgaacaaggagaaacauacuucuucgacucaaacauuaaacaagaaauauucgacggaguuuucaaagaacaucgaaaaguaagcaaaaagaaacuucucgacuuuuuagccaaagaauaugaagaauuuagaauaguagacgugauaggacuugacaaagaaaauaaagccuuuaaugcuagucugggaacauaccaugacuuagagaaaauucuugauaaagauuuucuagauaauccagacaacgaauccauauuagaagauauuguacaaacacucacacucuucgaagaucgagaaaugauuaagaaacgauuagaaaauuacaaagaucucuuuacugaaagccaacuuaagaaacuauaccguagacacuacaccggcuggggacgccuauccgcaaaacucauaaacggaauacgagacaaagaaucccagaaaacgaucuuagacuaucuaauagacgauggccgcuccaacagaaacuucaugcaauugauaaaugacgacggucggucaaacagaaacuucaugcaacucauaaacgaugacggcuugagcuucaaaucaauaauuucuaaagcacaagcaggaagccauagugacaacuuaaaagaaguuguaggagaacucgcaggcaguccagcaaucaagaaaggcauccuacaaucgcuuaaaaucgucgacgaauuagucaaagucaugggauaugaaccagaacaaauaguaguagaaauggcaagagaaaaccaaacaacgaaccaaggaagaagaaacaguagacaacgauacaaacuacuagacgauggagucaaaaaucuagcgucagaccuuaaugguaauauacugaaagaauaccccacggauaaccaagcacuucaaaaugaaagguuauucuuauauuaccuccaaaauggaagagauauguauacaggagaagcacucgauaucgacaaucuaucucaauacgacauugaccauauaauaccccaagccuucauaaaagaugauucaauugacaauagaguacucguaucaucugcuaaaaaccgaggaaagucagaugacguuccgucuuuggaaauagucaaagacugcaaggucuucuggaagaaauuacuagacgcaaaacuuaugucacaaagaaaauaugacaacuuaacaaaagcggaaagaggcggacucacgucagacgauaaggcaagauuuauacaacgucagcuaguugaaaccagacagauaaccaagcacguagcuaggauucuggacgaaagguucaacaacgaacuagauagcaaaggaagacgaauccguaaaguuaagauaguaacacucaaaagcaaccuaguaucaaacuuuagaaaggaauuuggauucuauaaaauaagagaagucaauaauuaccaucaugcacaugacgccuauuuaaacgccguaguagcaaaagcaauccuuacaaaauauccucaacuagaaccugaguucguauauggcgacuacccuaaguauaauaguuauaagaccagaaaaucagcaacagaaaaacuauucuuuuacucgaacaucaugaacuucuucaaaaccaaaguaacccuugccgacgguacaguuguaguaaaagacgacauagaaguaaauaaugacacaggugaaauagucugggacaagaagaaacacuuugcaacaguaagaaaaguacuaaguuacccgcaaaauaauauagucaagaaaacagaaauacaaacaggaggauucucgaaagaaaguauucuagcacacggaaauuccgacaaacuuaucccaagaaaaaccaaggacaucuaucuagacccuaagaaauaugguggauucgauucaccaauuguugccuacagcguccuaguaguagcagacauaaagaaaggaaaagcacaaaaacuaaaaacaguuacagaacucuuaggaauuacuauuauggagcgauccagguucgagaaaaaccccagcgccuuccuugaaucaaaaggauaccucaacauacgcgcagauaaauuaauaauacuucccaaauacagucuauucgaacucgaaaacggaagaagacguuuauuagccagugcgggagaacuacaaaaggguaaugaacuagccuuacccacgcaauuuaugaaauuuuuauaccuagcaucucgauacaaugaaucaaaagguaaaccugaggaaauagagaagaaacaagaguuuguaaaccaacauguuuccuacuuugacgacauuuuacaacuaauaaacgacuuuagcaaaagaguaauccuagcagaugcuaaucuggagaaaauaaauaaauuauaucaagauaacaaggaaaacaucaguguugaugaacucgcaaacaacauuauaaaucucuuuacauucacaagccucggagcaccagcggccuucaaauucuuugacaaaauaguagaccguaaaagauacaccucgacaaaagaaguauuaaacucaacccuaauacaccagucaauaacuggauuauaugaaacaaggauugacuuaggaaaacugggugaagauuga

SEQ ID NO: 5541 - RNA, 4155 nt, Artificial Sequence
  Cas9 variant
augaaauugcgugguauugaggaugacuacucuauaggauuagauauggggacgaguucggucggaugggccgucaccgacgaaaggggaacguuggcacauuuuaaacguaaaccuacauggggaucaagguuauuucgagaagcccagacugcagccguugcacgaaugccaagggggcaaagaagaagauauguucggagaagguggagacuagauuuauuacaaaaacucuuugaacaacaaauggaacaagcugauccggacuucuuuauacggcuaaggcaaucaagguugcuacgagacgacagagcugaagaacacgcggacuauagauggccacucuuuaaugacuguaaauuuacugaaagagacuauuaccaacgauuuccgacuauauaucauguaagaucaugguuaauggaaaccgacgaacaagccgauauacgacugauauauuuagcacuacauaacauaguaaaacacaggggaaacuuucuuagagagggacaaagucuauccgcaaagagugcaagacccgaugaagcauuaaaucacuuaagagaaacacucagaguaugguccucagaacgcggguuugaauguagcauagcagauaacgguuccauauuagcaauguuaacucauccggacuuaaguccuucugauagaaggaagaaaauugcaccuuuauucgauguuaaauccgacgaugccgcggccgacaaaaagcuaggaauugcgcuagcuggagcuguaauaggcuuaaaaacagaauuuaaaaacauuuuuggugauuuuccuugugaagauaguucgauauaccugagcaaugaugaagcaguugaugcaguacggucugcuuguccagaugacugugcugaacuuuucgacagguuaugcgaaguauauagcgcauauguccuacaagggcuucucaguuaugcaccaggacaaaccauaagcgccaauaugguggaaaaauacagacgguauggagaagauuuagccuuacugaagaaacuugucaaaauuuacgccccagaccaauacagaauguucuucucaggagcaacuuaccccgguacaggcauuuaugaugccgcacaggcaagaggauauacaaaauauaaucugggucccaagaaaagugaauacaaaccuucggaaucuaugcaauaugacgacuuccgaaaagcagucgagaaacuauucgcuaaaacagaugcgagagccgacgagagauaucgaaugaugauggacagauucgauaaacaacaauuucuuagacgacuaaaaacaucagacaacgguucgauuuaccaccaauugcauuuagaagaacuaaaagcaaucguagaaaaucaaggaagauuuuauccuuuucuaaaaagagacgcagacaagcuagugucccuaguaucauuuaggauaccguauuacguaggaccauuauccacaagaaacgcuagaacagaucaacauggagaaaacagauuugcuuggagcgagagaaaaccugguaugcaagaugaaccgauauuuccauggaauugggaaucuauuaucgauagaucaaaaagcgcugaaaaauuuauacuacgaaugacugguaugugcacauaucuucaacaagaaccuguuuuaccuaaaaguucauuauuauaugaggaguucugcguacuuaaugaacuaaacggugcucacuggucaaucgacggugaugaugaacauagguuugacgcugcggaucgugaaggaauaauagaagaguuauuucgacgaaaaagaacuguuucuuauggcgaugucgcaggauggauggaacgcgaaagaaaccaaauaggagcacacgucugcgguggacaaggcgaaaaaggauuugaauccaaauuaggaagcuacauuuucuuuuguaaagacguuuuuaaaguggaaagauuagaacaaucugauuaucccaugauagaaaggauaauauuauggaacacacuuuucgaagacagaaaaauauuaagccaaagauuaaaagaagaauacggaagucgauuaucagcugaacaaauaaaaacuauaugcaaaaagagguuuacaggcuggggaagacucagugaaaaauucuuaacaggcauuaccguacaagucgaugaagacagugucucgauaauggacguucuacgagaaggguguccuguaucagggaaaagagguagagcaauggucaugauggagauccuacgcgaugaagaacugggauuucaaaagaaaguagaugacuuuaaucgagcauuuuucgcugaaaacgcacaagcacuaggaguaaacgaauuaccugggucaccagcgguacgacggucguuaaaccaaucaauuagaauaguugacgaaauagccucaauagcuggcaaagcaccagcuaauauauuuauagaaguaacucgggaugaagauccuaaaaagaaaggucgaagaacaaaaaggagauauaacgacuugaaagacgcacuagaggcauuuaaaaaggaagacccugaacuuuggagagaguuaugugaaacagcaccaaacgacauggaugaaagauuaagccuauauuucaugcaaaggggaaaauguuuauacagugguagggcgauagacauucaccagcuaucaaacgcugguauauaugaaguggaucacauaauuccuagaacauacguaaaagaugacagccuugaaaacaaagccuuaguauacagggaagaaaaccaaagaaagaccgacaugcuauugauagaucccgaaauaagacgacgaaugagcggauauuggcgaauguugcacgaagcaaaacuuauuggugauaagaaauuucgaaaccucuugaggagcagaauagaugacaaagcauuaaaaggauucauagcacgacaauuaguggaaacaggucaaaugguaaaacucgugagaucacuauuagaagcgagauauccggagaccaauauaauaagcguaaaagcauccauaagucaugaucuaagaacagcggcagagcuagucaaauguagagaagcaaacgauuuucaucaugcgcaugaugcauuccuugcaugcagagugggacuauuuauacagaaaagacacccgugcguauaugaaaacccaauuggauugucgcaaguaguaagaaauuauguaaggcaacaagcagacaucuuuaaaagauguaggacuauuccgggaucaucuggcuuuauaguaaacucguucaugacaucaggauuugauaaagagacgggagaaaucuucaaagaugauugggaugcagaagcugaaguugagggaauuagaagaaguuuaaauuucagacaauguuuuauaucgagaaugcccuuugaagaucaugguguauuuugggaugcaacuauauacaguccacgagcuaagaaaacagcugcacuuccucuaaaacaaggucuaaacccgucuagauacggguccuuuucuagagaacaauucgccuauuucuuuauuuauaaagcucgaaauccaaggaaagagcagacgcuuuuugaauuugcucaaguaccugugagguuaagugcacaaauacgacaagacgaaaacgcauuagaaagguacgcuagagaauuagcuaaagaucaagggcuagaauuuauaagaauugagagaucaaaaauauuaaagaaccaacuaauugaaauagauggcgauaggcuauguauaacaggaaaagaggagguucgaaacgcaugugaauuagcauuugcacaagacgaaaugaggguuauacguauguuagucagugaaaaaccagugucucgcgagugcguaauuagccuuuuuaaucguaucuuacuacauggugaucaagcaucucgccgacucaguaaacaauuaaaauuagcacugcucagcgaagcauuuucagaagcaagcgacaacgugcaaaggaauguaguacuaggcuugauugcuauuuuuaacgggagcacaaauaugguaaaucucagcgauaucggcggcaguaaauuugccgguaaugucagaaucaaauauaagaaagaauuagcaucaccaaaaguaaauguacaucugauagaucaaucaguaacaggaauguucgaacgcagaacaaaaaucggucuuuga

SEQ ID NO: 5542 - RNA, 4158 nt, Artificial Sequence
  Cas9 variant
augacaaaaccguauucaauagggcucgacauagggacuaacucagucggaugggcaguaauuacagaugacuauaaaguacccucaaagaagaugaaaguacuuggaaauacaagcaaaaaauacauuaaaaaaaacuuauuaggugcauugcuauuugacucaggaauaaccgcugaagggcgucgacuaaaaagaacggcuagaagaagauacacacgaagacgaaaucgcauuuuauaccuucaagaaaucuucucaaccgaaauggcaaccuuagacgaugcuuucuuccaacgcuuagacgauuccuuccucgucccugaugacaagcgagauucuaaauauccuauuuucggaaacuuaguagaagaaaaaguuuaucacgaugaguuuccaacaauauaccaucucaggaaacacuuagcugauucaucgaaaaaagcagaccuuagacucgucuaccuagcauuagcacauaugauaaaauaccgaggacauuucuuaauagaaggagauuucaauucaaaaaauaaugaccuacaaaaaaauuuucaagauuuucuagacacauauaacgcuauauucgaaagugaccuaagccucgaaaacuccaaacaauuagaagaaauugucaaagacaaaauuuccaaaucggcaaagaaagauagaauacuaaaauuauucccaggagaaaaaaacagcgguauauuuucagaauuucuaaagcuaauagucgguaaccaagccgacuucagaaaauacuuuaaucuagacgaaaaaaccagccuacaguuuucuaaagaaaguuacgaugaagaucuagaaacgcuucuuggccauauaggagaugauuauucagauguguuucucaaagccaaaaaauuauaugaugcgauccuacuaucuggaauccuuacaguaaccgacaauggcacagaagcuccacucaguuccgcaaugauaaugagauacaaagaacacgaagaagaucuugcccuucuaaaagcauauaucagaaauauuaguuuagaaacuuacaaugaggucuuuaaagauaacaccaaaaacgguuacgcaggcuacaucgaugguaaaacaagccaagaagauuuuuaugucuaccuuaaacgauuacuagcaggucuugaaggggcugacuauuuccuugagaaaauugaccgagaagauuuccugagaaagcagagaacauucgacaauggauccauaccauaucaaauuuauuuacaagaaaugagagcaauauuagacaaacaagcuaaauuuuacccauuucuagcaaaaaacaaagaaaggauagaaaaaauauuaacuuucaggauacccuauuaugugggccccuuagcgcguggcaacucugauuuugcuuggucaauacggaaacgaaacgaaaaaauaacuccauggaauuucgaagauguaaucgauaaggaaaguagcgccgaagcauucauaaaccggaugacaucguuugaccuauaucuucccgaagaaaaaguacucccaaaacacagucuccuuuaugagaacuuuaccguuuauaacgaacuaaccaaaguaagauucaucgcagaaggaaugagggauuaucaauuucucgacagcaagcaaaaaaaagauauaguccgacuuuacuuuaaaggaaaaagaaaaguaaccgacaaagacaucauagaauauuuacacgccauugacggauacgauggaaucgaacuaaaaggaauagaaaaacaguucaacucaucccuuucaaccuaucaugaccuuuuaaacauaauaaacgauaaagaauuccucgaugacagcucuaaugaaacaaucaucgaagaaauuauccacaccuuaacaauguuugaagacagagagaugaucaaacaaaggcuauccaaauuugauaacauuuuugauaaaucuguauuaaaaaagcuuucacggagacacuauacuggguggggaaaauugagugcaaaacuaaucaacggaauccgugacgaaaaaagcggaaauacuaucuuagacuauuuaauagaugauggcguguccaaucgaaacuucaugcaacuaauccaugacgaugcacucuccuuuaaaaaaaaaauuaaaaaagcacaaaucaucggcgauaaagauaauauuaagcaaguuguaaaaucacuaccugguaguccggccauaaaaaaaggaauucuacaaucgaucaaaauaguagaugaauuagucaaaguaaugggucgagaaccagaauccauugucguagaaauggcaagagaaaaucaauacacaaaccaaggaaaaucaaacucucaacaacgcuuaaaaaggcuugaggaaagucuaaagggauuaggauccaagauacuaaaagaaaauguucccacaagacuuucaaaaauugacaauaaugcacuacaaaacgauagauuauauuuauacuauuuacaaaacggaaaagacauguauacgggagaagaacuagacaucgaucgacuaucaaauuaugauaucgaccauauuauaccacaagccuuucuaaaggaugacuccaucgacaauaaaguccuuguuaguucagcuaguaacagaggaaaauccgacgacguaccgucacuagaagucguaaaaaaacgaaaaacauuaugguaccaauuacuaaaaucaaaauuaaucucucaacguaaauuugauaauuuaaccaaagcagaacgagguggccuaucccaagaagaaaaagcaggauuuauucaaagacaacuaguugaaacacgacaaauuaccaaacacgucgccagauuacuggacgagcgauuuaacaacaaaaaagaugaaaacaauagaacccuaagaaccguaaagauaauaacucucaaaucuucuuugguaucacaauucagaaaagacuuugaacuauacaagguaagggaaauaaacgacuuccaucacgcacaugaugcauauuuaaacgccguagucgccucagcauuacugaaaaaguacccuaaauuagaaccagaauucguauauggggauuaccccaaauacaauucauuuagagaaaggaagucggccacugaaaaaguguauuucuauucaaacauaaugaacaucuucaaaaaaagcauaccgcuggcagacggaacaguaauugacagaccacuaauagagguuaacgaagaaacaggagaaaguguuuggaauaaggucgcagaucucaacaccguaagaaaagugcuuuccuacagucaaguaaauauaguaaaaaaaguagaagaacaaaaccacggcuuagaccgaggaaagccaaaaggacucuucaacgcaaaucuaaguagcaaacccaaaccaaauaguaaagaaaacuuagugggagcaaaagaauauuuagaccccaaaaaauacggaggauacgcuggaauaucaaauaguuucgcaauacuaguaaaaggaaccaucgagaagggcgcaaaaaaaaaaauaaccaauguacuggaauuucaggggauauccauuuuagaccgaauauauuacagaaaagauaaguuaaauuuuuuacucgagaaagguuauaaagauauugaauuaauaauugaacucccuaaauauucauuguucgaacuaagugacgguuccagaagaauguuagcaucaauacucagcacgaauaacaaaagaggagagauacauaaaggcaaucaaauauucauaucacaaaaauucguaaaauugcuauaccaugcuaaacgcauaucuuccacauuuaacgaaaaccacagaaaauacguagaaaaucacaaaaaagaauuugaagaauuauucuauuauaucuuagaauuuaaugaaaauuacguuggagcuaagaaaaauggagaauuacuaaaaucagcauuucaaucguggcaaaaccacuccaucgacgaacuauguucaucauucaucggaccgacaggcagugaacgaaaagggcuauuugaacucacgucaagagguggagcagcagacuucgaauucuugggaguuaagauuccaagauacagagacuacacgccauccagccuauugaaagaugcaacgcuaauacaucaaucagucacagggcuuuacgaaacacgaaucgaccuaggcaaacuaggcgaggacuga

SEQ ID NO: 5543 - RNA, 4158 nt, Artificial Sequence
  Cas9 variant
augcaaacauacuuuggaaugaagaaaauauuaggauuagaucuuggaacaaacucaauaggcugggcccuaguaaacgaagccaacgaugacaacgaaaaaucuaguauaauaaaacuuggaguaagaguuaauccucuaacugucgaugaacagucaaauuucgaaaaaggaaaauccaucaccacuaacgcugaaaggacaauaaaacgcucaauaagaagaaguuugcaacguuauaaacugcgaagagaaaaucuaaucgaaauccuaaaggaacacaauuuuaucacagaugauaccauauuauccgaagacggaaacgcaucuacauuugaaacguacaggcuaagagcaaaagcagcauccgaaaaaauaucgcuagaagagcuuggccgcguuuuauuaaugauuaacaaaaaacgagguuacaagucauccagaaaagcaaaaaaccaagaagaaggacaacuaauagacggaauggaaguagccaaagaacucuacgaaaagaauaucaccccuggucaauucguauuucaacuauuaaaacagggaggcaaauucauucccgacuucuaccgguccgaucuucaagcagaguuugacaaaauuugggaauuucaaaaauuauuccaugcugaaauucuaguagaugacuucaaaaaacaguuagaacgaaaaggaaaacuaaauucaaguaaaauauuccuuggacgguuuggaauauacaccgcagaaaauaaaggaaaugacaaacgacuccaggcuuaccaauggagaguagaugcccuuacgaaagaauuaacgaaagaagaauuagcauauguaauaagcgauuuaaacgggaucauuucaagcucaagcggauacuugggaaguauaucagauaggagcaaagaacuauauuucaacaaccaaacaguaggacaauuucuaauggcacaauuagaccauucaccacacacaagucuuaaaaaucaaguguuuuaccgacaagauuaucuagacgaguucaauacacuaugggaaaaccaagcgcauuaccauaaaguacuuaccagcgauuugaaaagugaaauuagggauguaauaauauuuuaucaaagaagacuuaaaacccaaaaaggcuuaauaaguuucugcgaauucgaaaguaggaaaaucgaaguagaaaucgauggcaaaaaaaaaaucaaaaauguuggaucccgaguaugcccuaaaagcagcccuauuuuccaagaauucaagauauggcaaauucucaacaacauugaauuacuagaaaaaagcaguaaagcaaaaagauuuuuagaccaagaagaaaaagaacuauuauuuaaagaacuaagcauaaagaguaaaaucucgaaaucagaugcucuaaaacuucucuucaaaaauucaagagaacucgacuuaaauuacaaggaaauugaagguaauagaacgcaaucagcgcuauucgacgcauauagcaaaauuauagaauuaaguggacacggagaauacgauuucucaaaaauggaggccucuaauaucauagaacuagugcaagaaguauucaccggauugaacuauaauaccgaaauacucuauuucgauucgucauuagaagguaaagauuucgaaaaccaaccaauguaccgacuauggcacuugcuauacaguuuugagggagacgauuccaaaacaggaaacgaaaaauugauaaauaaacuaagcgaacuauacggauucgagaaaaaauacaguauuguccucgcaaacguuagcuuccaagaagacuauggaucacuaucaaccaaagccaucagaaagauacacccuuauuuaaaagaaggaauacaauacgauguagcaugcgaauuugcagguuaccgucauucaaaaaguagucucaccaaagaagaaaucgaaaauaaaauacuuaaagaccaauuggagauucuaccaaaaaacagucuuaggaacccaguuguagagaagauauugaaucaaaugauuaacgugguaaaugcccuaaacgaaucauacggcaaaccagacgaaauuagaauagaauuagcuagggaauuaaaaaaaagugcaaaagaacgugaagaacuaaccgcaucaauaggagaaacaacaauaaaacaugaaaaauauagagccauacucgagaacgaauuugguauuucacauguaagcagaaacgauauaauccgauauaaauuauaucuagaacuagaaaacagaggauacaaaacucuauauucuaauaccuauguaucucaagaaaaacuguucagcaaagaauuugacauagaccacaucauaccccaaagcugucucuucgacgacaguuuuucuaacaaaacccuagaaucaaaaucaguaaauauagaaaaaggcaaugacacagccuucgauuauguguucgcaaaauauggugaagccggccucucggacuacauaauacacaucgaggaauuguucaaagacggaaaaauuucuaagacaaaacuaaacaaacuaaaaaugaaagguaaugagauaccaagcgacuucaucgcccgugauauuagagauacacaauauauugcccgaauagcaaaaaacauacuggaagagacagucagaaacgucguaucaacuagcggaaguaucacagauagauuaagagaagacuggcaacucauagacguaaugcaagaacucaauugggaaaaguacucagcgcuuggacucacggaaauauacgaaaauagagaaggccauacaauaagacgaauaaaagacuggacuaagagaaacgaccaccgucaccacgcgauggacgcauuaacaaucgcauuuacaaaaagaucgcacauucaguacuuaaacaauuuaaaugcuagaucugacaagucaggcucaaucuauggaaucgaaacuaaagagcucuauagagacgaccacggaaaacuuaaauuuaaaccaccaauaccauuaaaugaauucagggcugaagcgaaaaaacaccuagaaaauacacuaauuucgauaaaagcaaaaaacaaaguagcuaccauaaauaucaacaccaccuccaccaaagaaggaaaaaacaaaaaacggcaauuaacgccacgaggccaacuccaccuggaaacaauauacggcucaauacagcaauauguaacaaaacaagaaaaaguaggagcaagcuuuaaugaggagcaaauaagcaaaguagccaaacaaaaauacagacaggcauuacugaacagacuccgagaauucgacaaugaccccaaaaaagccuuuacgggaaauaauaguuucgaaaaaaacccgauauacuuagacguacuacaaacacagaaaguacccgauaaaguugaaacagucucaaaagaaauuaucuacacaauucguaaagacauaacgccagaacucaaaauagaaaaaguaauagauaaaaagauuaaaacaauauuacaaucuagacuaaaugaauauuccggugauuccaaaagagcauucuccaauuugaaagaaaacccaauauggcuaaaccaagagaaaggcauugaaauaaaaaggguuacaauaucgggaauuucaaacgcagucgcaauacaugacaaaaaagacaagaacggaaaucuaauacucgauaacgagggaaguacccaagcaguagacuucguaaacaccgguaauaaucaccacguagcaauauacaaggacgaaaggggaaaccuacaugaaucagucguaucuuucuucgaagccuguacacgagucaacuuagguggaccggugauauuuaaaaacuauaacaagucagacgggugggaauuucuauuuagcaugaaacaaaacgaauauuuugucuuuccuaaugagaagaccggauucaacccuaaugaaauugaccuacucgauccagacaacuaucgacuaaucucacccaaccucuucagaguacaaaaaaucaguucaaaaaacuacguauucaaucaucauuuagagacaucagccauuacuggugaaaccuuaaaaaacaagaaacagcuaucaagugugacuuaucauuuuauacaaucuuugccgccgauaaaagauaucguaaaggucagaauaaacaacaucggccaaaucguuugggucggagaguacuga

SEQ ID NO: 5544 - RNA, 4158 nt, Artificial Sequence
  Cas9 variant
auggacgaacuucaaaacuuugaaaaaggcaaaaguauuacaaccaaugcagacagaacagcugggcgaagcaugcgaagaaacuuacagcguuacaaacuaaggagagaaaacuuaauagaaguucuaaaagaauacaauuuuauaacugaugaaaugauacucagcgaaaauggaaacaggacaacuuuugaaaccuacagacugcgagcuaaagcagccguggaagagauauccuuagaacaauucgcucguguauuacucaugauaaauaagaaaagaggauauaaaaguaguaggaaagcuaaaggcgcugaaaacggaacccuaaucgauggaauggaaguagcgaaaaagauguaugacgaaggaauaacaccaggagaauuguguuuacaacuucuaacggcaggaaaaagauacuucccugacuucuauaggagcgauuugcaggccgaauuugauagaauauggaacuuucagaaacaguuuuacccagauagccuaauagauaaaguaaaagacgaaguccgcggcaaaaacaaaucccagacaugggcaauacuagcaaaauacuucguuuggaaagaaguugaaaauucguggaaugaagaagaagcccaaacaagaagaguagaaaaggaauaccgccuaguaggaauaaagagaggaguaaagagagaggaacuaaaauuagaaaauuuucaauggagaguaaaagcauuaagugaacgaaugaaucccgaagaauuagcaauaguauuacaagaaauuaacgaacaaauaucaaauaguaguggauaccuaggagcuauuucagauagaagcaaggagcuguauuucaaccgacaaacaguaggucaauaccaaauggcgguccuagauaacaauccgaauauaggauuacguaacaugguuuucuacagacaaggauauuugggagaguucaacacuaucugggaaaaacaagcggaguuccacaaggaacuaacggaagacuuaaagaaagaaauuagggacauagucauuuucuaccaaagaagacuaaaaucccaaaaaggauuaauaaauaucugcgaguucgaacgucgucaaauugaaguugaaauugauggaaagaagaaaauaaaaaccauaggcucaaggguaaucccccgaaguucgccauuauuucaagaguucaaaauauggcaaacgcuaaaugacaucgaagucuccguacucggggucaaaaacaaacgaaagaaacaagaugauaauucuaccacacucuuagacucagcagaaaauauagauucacuaaaauuaaauguaucuagaccuuuagaugcggaugagaaaaguuuauuagccaaagaacuauuuauaagagacaaauuaaccaaaucggaugucuuaaaacuacuauucaacaauccacaaaaucugaaucuaaauuuuaagaauauagauggaaacagaacugguagugcucuauaucaagcauucagcaaaauacucgaaauuucaggccaugaaagcauaaauuuuaagaaaucagcagaugaaauaguagaacaaguaaaaacaaucuuuucagccuuaggauggaacacagaaguacuuuguuucgacucagaaaaagaacuugauaaacaaccuuacuuuaaauuauggcaccuacuuuacaguuucgaaggagacagcacacccacaggagauggaaaucuaauucagaaaauagccgaccuuuguggauuugaaaaagauuaugcgagcauuuuagcaaacauaacguuccaagaagacuacggaaguuuaucaaccaaagcuauacguaaaauacuaccacaucuuaaagacggaaaucaauaugacguagccugugaauacgcaggauauaaacauagcaagucuucauugaagaaagaagaaaucaaaaacaagguacuaaaagauaaauuagaauuacucccuaaaaacucacucagaaacccaguaguugagaaaauauuaaaccaaaugguaaauguaauaaaugccaucauaacuaccuauggcaaaccagaugaaauucguauagaauuagcaagagaacuaaagaagaaagcgaagaaaagagaagaguuaacaaaaacuauaguagauacaacaaaaacacacgaaggaauacgagcgauauuacaaaacgauuucggaaugucacacguuucgagaaacgccauaauaagauauaaauuauaugaagaacuaaaagauaauggauauaaaacacuguauucaaacaccuauauaccuaaagaaaaauuauucagcaaagacuucgauaucgaacacauaauuccacaagcacgauuauucgaugacucguuuuccaacaaaacguuggaggucaaaucaauaaacaucgaaaaaggcucaaaaacagcauaugauuucguagaagaaaaauacggcgaacaaggacuacaagaguacuugaacaggugugaggucuuguucagggacaagaaaacuaaacuaagaaaauuaaaaaugcaagaaagugaaaucccugaagguuucauugauagagaccuacgaaauacgcaguacaucgcaaagaaagcccuaucaaugcuaaacgaaaucugcagacgcguaguugcaacgaccggagcaauaacagaugaauuaagagaagacuggcaauuagucgauguuaugaaagaauuaaacugggaaaaauacaaaguccuagggcuaguugaauauuucgaagauaacgacggaagauuaauuggaagaauaaaagauuggacaaaaaggaacgaucacagacaucaugcuauggaugcgcuaacaguagcauuuacuaaagacguauuuauucaguacuuuaauaacaaaaacgccaguuuaaagccugauacaaacgaagcagcaauuagaaacaaguauuuccaaaacggaaaagcaaucccgccaaugucccuugaugaguuccgagcagaagcaaagaaacauuuaaaugauacuuuaaucaguauaaaaacgaaaaacaaaguaguaacaauaaaucuaaauaggacgaaaaagaaaaacggaauaaauaagaaacaacaacaaaccccgagagggcaacuucaucuggaaacaguauacggaucccacaaacaguacgucguuaaagaagaaaaaguuaaugcuaguuucgacgcugccaaaauagcaacaguaaacaaacccgcuuauagggaugcccuucuuagaagauuacaagaaaacgguaaugauuccaagaaagcauuuaccgggaaaaauucacuagauaaacaacccgugugguuagacgcaaaacaaaaugaaugcguacccgaaaaaguaaaaacaguuauguuagaaacgguauacaccgucagaaagccaauagaugaaaaauuaaacguagacaaagucguagaugcccgaaucagaaaauuacuucaggacagaauuaaagaauauggaaacgccaaguccgccuuugcuaaucuagaugaaaauccaauaugguuaaauaaagaaaaaggcauaacaauuaaaagaguaaguguaaguggaaucucaaaggcacaaucuuuacaugaaaagaaagauaaagauggaaacuuuauauuggacaaagauucuaggaggauaccagucgauuucguaaauacaggaaauaaccaccacguggcuauuuauagaaaaccuguuuuagauaaaaagggucaagcaguuuucgacgagaauggagaguuaaaguucgaguuagaagaaguaguagucagcuuuuucgacgcaguaacacgaguaaauuuaucacaaccuauaauagauaaggauuauaaacgaucagaaggauggaaauucuuauuuagcaugaaacagaaugaauauuucguauucccaaacgaaaagaccggauuugacccaaaggaaauagauuuauugaauccagaaaacuaugcauugauuaguccgaaucuauuccggguacagaaaauagcaagcaaagauuauguauucaggcaccaccucgaaaccguaguugccgauagaaaagaauuacaagaaaucacauggaagcgaaucagcucgcuuucaauauuaaacagaauaauaaaaguucgaguaaaccacauaggucaaauagugaugauaggagaauacuga

SEQ ID NO: 5545 - RNA, 4158 nt, Artificial Sequence
  Cas9 variant
augacaaaacccuacaguaucggacuugacauaggaacuaauuccguagggugggccgucauaacagaugacuauaaaguaccaagcaaaaaaaugaaaguucuggguaauacaucaaaaaaguacauuaaaaaaaaucuauuaggcgcguuacucuuugacuccgguauaacagcagaaggcagacgucuuaaacgaacagcuagacgcagauacacgaggcgacgcaacagaauacuauaucuacaagaaauuuuuagcacugaaauggcaacauuagaugacgccuuuuuccaacgcuuagacgacaguuucuuagugccagacgacaagagagauucaaaauauccaauauucggaaaucuaguugaggaaaaagccuaccacgaugaauucccaacaaucuaucaccuccggaaauaucuagccgauagcacaaagaaagcggaucuccgauuggucuaucucgcacuagcacacaugaucaaauauagaggucacuuuuuaauugagggcgaauuuaacaguaaaaacaacgauauacaaaaaaauuuccaagauuucuuagacacauacaaugcaauuuucgaaucugaccuaaguuuagagaacucaaaacaacucgaagaaauaguaaaagacaaaauaucaaaaagugcaaaaaaagauagaauucuaaaacuauuccccggggaaaaaaauucaggaauauucagcgaauuuuuaaagcugauaguaggaaaccaagcagacuuuaaaaaauauuucaacuuagaugaaaaagcacccuuacacuuuuccaaagaaucuuacgacgaagaucuugaaacccuauuaggauauaucggcgaugauuauagcgauguuuuucuuaaagcuaaaaaacuuuacgaugcaauacuacuaucagggauacuaaccguaacagacaaugguacagaagcaccauuaucaagcgcaaugauaaugcgcuacaaagagcaugaggaagaucuagcauuauuaaaagccuacauucguaacaucaguuuagaaacauacaacgaaguauuuaaagacgauacaaaaaauggcuacgccggauacaucgaugggaaaacaucacaagaagauuuuuacguacaucuaaaaaagcuccuaguaggacuggaaggugcggauuauuuccuagaaaaaaucgacagagaagacuuccuucggaagcaacggaccuuugauaacggaaguauuccauaucaaauacacuuacaagaaaugcgagcaauccucgacaaacaagccaaauuuuacccuuuccuagcgaagaacaaagaacgcauagaaaaaauacuaacauuuagaauaccauacuacguuggaccucuugcccgaggcaacagugacuucgcgugguccauccgcaaaaggaaugagaaaauaacaccuuggaauuucgaagaugucauagauaaagaaucaagugcagaagcuuuuauaaauagaaugacgagcuuugaccuuuaucuaccagaagaaaaaguacuaccuaaacauagucugcuguacgaaacauuuaaugucuauaaugaacuaacuaagguacgauuuaucgcagaaucuaugcgugacuaucaguuucucgacagcaaacagaaaaaagauauaguucgcuuauacuuuaaaaauaaacgcagaguuacagacaaagauauuauagaauaucuacacgcuauugacgguuaugacggcauagagcuaaaagguauagaaaaacaauuuaacucgucauuaaguacuuaucaugaccuacuaaacauaauaaaugacaaagaauuccuagaugacucuuccaacgaagcaauuauagaagaaauaauacacacccucacgaucuuugaagaccgcgaaaugauaaaacagagauuaucaaaauucgaaaauauuuuugauaaaucagucuugaaaaaauuauccagaagacacuauacaggauggggcaaacuauccgccaaauuaauaaaugguauccgcgaugaaaaaucagguaacacaauccuagauuaccuaauagacgauggcguaucaaaucgaaacuucaugcaauuaauucacgacgaugcuuuaaguuuuaaaaaaaaaauaaaaaaagcucaaauuaucggcgacaaagauaauauaaaacaagucguucaagcacuuccagguagaccugcaauuaaaaaaggaauacuacaaaguauaaaaaucguagaugaacucguaaaaguaauggggcgaagaccugaaucaauaguaguagaaauggcaagagaaaaccaauacaccaaucaaggcaaauccaacucacagcaaagacuaaaaagacucgaggaaucucucaaagaauuagggucuaaaauucucaaagagaauauccccgcaaaacucucaaaaaucgacaauaacgcgcuccaaaacgaucgcuuauacuuguauuacuuacaaaauggaaaggacauguauaccggugaagaauuagauauugauaggcuaucaaacuaugauauagaucacauuauaccacaagcauuccucaaagauaauucaaucgacaacaaaguacuaguuagcagcgcuagcaacagaggaaaaucagaugacgucccaucacuagaaguaguaaaaaaacgaaaaacucugugguaucaacuccuuaaaucaaaacuaaucucucaacgaaaguucgacaaccuaacgaaagcugaaaggggaggacuaucaccagaagcuaaagcaggauuuauccagagacaauuagucgaaacgagacaaauaaccaaacacguugcuagacuguuagaugaacgcuucaacaauaaaaaagacgaagauaacaaaacacuacgaacuguaaaaaucaucacacucaaaucaaguuuagucucacaauucaggaaagauuucgaacuauacaaaguaagagaaauaaacgacuuccaucacgcacacgaugccuaucugaacgcagucguagccucugcgcuauuaaaaaaauacccaaaacuagaaccugaauuuguauacggggacuauccaaaguauaauucauuuagagaaagaaaaucagcaacagaaaaaguauacuucuacucaaacauaaugaauauauucaaaaaaagcauaucacucgcugacggcacaguaauagaacgaccguuaauagaagucaacgaagaaaccggcgaaagugucuggaacaaaguagcugauuuaaauacaguaagaaaaguauuaagcuacagucaaguaaauauagucaaaaaaguugaagaacagaaucauggacuggaccgaggaaaaccaaagggacuauuuaacgccaacuuaaguucaaaaccaaagccaaacaguaaagaaaacuuaguuggagcuaaagaauauuuagacccaaaaaaauauggaggauacgcagguauaaguaacaguuucgcaguuuuaguaaaaggcaccauugaaaaaggagcaaaaaaaaaaaucacaaauauacuagaauuccaaggaauaucaauauuagacagaauaacauacagaaaagacaaauuuaacuuucuacuagaaaaaggauauaaagacaucgacuuaauaauagaacugcccaaauauuccuuauucgaauuaagcgaugggaguaggcgaaugcuagcgucaauuuuauccacgaacaacaaacguggagaaauacacaaaggcaaucaaauauucauaucacaaaaauacguaaaauuacuuuaccaugcaaaaagaauuagcaauacuuucaaugacaaucacagaaaguacguagaaaaucauaaaaaagaauucgaagaauuauucuauuacauacuagaguuuaaugaaaacuacgugggcgcuaaaaaaaauggagaauuacuaaaaagcgccuuucaaucguggcagaaccauucuauugaugaacucugcuccuccuuuaucgguccaacaggaucugaaagaaaaggacuauuugaacuuaccucccgaggaggcgcagcggacuuugacuuccuaggcguaaaaauaccaagauaccgagacuauacaccuaguucacuacuaaaagaugcaacucugauccaccaaucaguaacagguuuauaugaaacccgaauagaucuaggaaaacuaggugaagacuga

SEQ ID NO: 5546 - RNA, 4158 nt, Artificial Sequence
  Cas9 variant
augaaaaauaaaacuugguaucuaggauugggaguaggaccaacaagcauaggaugggcagcaacugauagcaacuauaaacuacuacguaaaaacaagaaacggcuauggggaguaagacucuuugaagaagccaaaacggcaguagauagaagaacauuccgagcagaacgacgaagacucgccagaaggaaauggagaauaucacugcuagaagaacucuucgcgaaagaaguaucuaaaaacgaccccaacuuuuuccucagguuaaaggaaucaaaauaccauuucgaagauaaaucguuaaugaacgaauauauacucuucaaugauaaagauuauaccgauaaagacuacuacaaagaauauccaacgauauaucaucucagacugucacuuacaacagaagaaaacccagauauacgcaaaguauacuuagcuguacacuccaugcuuaaaaaccgaggccauuuucuacuacaaggacaaucauucaaugacucgaauauagacucuguaauaaaagaacuacuagaacuagaaacaguaaaaauaaauuucgaagucaccgacgaaguaauccacucacuaaagaaaauugcccuagagaagaaaaaucuaagugauaaaaauaacgacguaaagaaacuauaccccaaagaaaaacaacuucaagaaauauucaaauugguuuuugguggaaaaacgucacuugacaaacucuacgacauagaagaauacaaagaacuagacaacucagucaaaagcauauccuucaaagaaaaagucuaugaagaaguaagaccggauuacgaacaaauauugucaaauuacaucgaacucuuggauuuagcaaaacuuguauaugauucaauagucuuagcagacaucaagaaagaaggaaaaacgaucagugaaagcaaaguagaauuauauaacaaacauaaagacgaccuugccaauuuaaagaaauuaguaaaaauugauaguaaauuaucggaagauaaaaagaaagaaguuuacuucaccauuuuuaaagaagacaaagaaaaaggaacaaauuaugugaacuacacucaccgaagccaagaaggaaaaucauguucuuaugaagauuucaagaaauuuuuaaagaaagaacucgaaaaauuagaagauaguccaacaaaaacaacuauucuagaagaacuagaccucgaaacguuucugcccuuacaacgaacaaaagauaauucuguagucccuuaccaaauacauaaagaagaacuuguaaaaauacucgacaacgcugcaaaauaucacaguuuccuagcugaaaaagaugauucuggauauagcaccagagaaaaaguuguacaauuauucgaguucaggauuccauauuauauaggaccauuaaacgcccaccacaacaccgaaaacggaggcuauucuugggcuauaagaaagaaaggaauggaauccguaccaguaacaccguggaauuucaaagacguaaucgacgaaagcgcgagcgcagaagcauuuguaaacaaucuuaaaaacaaaugcgcuuaccucucuggagaagacgucuuaccuaaaaacucccugcuguacuccgaauaugcuuuauuaaacgaacuaaaugcacuaagauaugaaggaaaccgaaucagcguagaagccagggauguaauaguaacaaaacucuucaaagaacagggcaagaaaguaacaaagaaaaccauaaaagaauuacuaaaaacugaagguuuuauugacggaaaaggggaaauaguaggaauugacaacauaguuaaaaacgaucugaaauccuaccgcgauuucaagaaaauacuggcugauaaauuugacaaagaaagaguagaaaauauaauauuguggaucacccuauacggcgaauccaggaaacuaauuaaagagaaaaucaccaaaguauacggagauuucuacacgguagaugaaauagagaaaaugucuagacuaacauacaaagauuggggaauauuaucuagaaaauugcugacugaacugguuucagaaaaauuauauaacgaagaaacuggcgaaugcuuaaauauaauaggagcaaugagacaaggaacaauccuauucauggaauuacuugccgauaaauucgacuacaugucccaaaucaaaaaucacaacaaagaaaacaaagacgauauaacugaaaucaccccagacauacuggaaaaucuacaugccaguccugccguuaaaagaucaaucuggcaaacaguaagaauaguagaagaacucaaaacaauuaucgguugugucccuacaaaaaucuuuauagagacgacaaaaagaaacaacgcacccuacaaaguacccacauugaacagaaacgacuuaguuacaaaauauaaaacaauaagagagcacgaaauuuuugaacuagaaaaagaacucaaaaacacacuggacuuuacacuaaacaaaaaucgauuaauaaacgaagaaccgucaaaacuuaaagcaacaaaauuguaucuauacuacacacaauuaggaagauguauguacaccgguaagaaaaucgaucuaggggaacuauucgacaacaacaacaaauaugauauagaccauauauacccacaaagcaaaguaaaagauggauccuucaacaauauaguacucguaacaaaagcgucaaaugauaugaaagcagauguguucccccucaaaaguaaauuucaaacaaaagaaaauaaaauauucuggcgauuccuuaaagagaagaaauugauaacagaagaaaaauauaacagacuuguacgcacagaagaauuuuccaacggcgaacuaacuggauucauuacgagacaauuaguugaaacaagccaagcuauaaaagucauaucaaauguacuaagagaacuaaauccagagacaacaaucugcuauucuaaagcggaaaacguauccucauuuagacaaucauuuggaaaaauaaaagaagcaaacagaaaagcggaaaacaacgaaaagcugaucagaguucaagaaauaaacgacuacuacaacgcaaaagacgccuaccuaagcauaguagucgguaacguauaugauguaaaauuuacgagaaauguccacaauuuuaucaaaaauaacaaggacgcaagaagauacucuuuaaauggacuuuucuauacagacgugaagaaugcuaacacgauugcaugggaaauggacaaaaccguacacguuguagagaaaacaaugaacaauaauaacauacuaauaacaagacggaccagcgaacaaaaaggagcauuauaugaugcaacacuuuacaaggcuaaagucgcggaaaaagcuaaagagggaacauauuaccccuuaaaaacaacagauaguaaaauuaaagacgucggcaaauacggcggauuuacaaaaauuaaaauugccuauuauucaauauuugaauacacacuugauggcaagaaaggaaaacagaaaauaacaagaauaguuccuauaccgauauacauuucacagaauauaaaagaugacaaagcccuauuggaauaugcacaaacucgacuccccggaaaagaccucaaaauaaaauacagaaaacuuugcauaggcucauuaguuaaaaucaacaacuuuaauuacuacauaggagguaaaacuaauaacaauuucacuuucgacagcgccguacaaguaauccucgacaaagacagugaaucuuacaucaaagaacucgcaaaauaccuaaauuggaagaaagaaaauaaagacgggaaacuaugggaaucaaucacagaagauaaaaacauacaauuauaugauucauuagugaagaaaaugaacaccggcauuuuuauccgcaaaacaccgaacaaguacaccgaacuccuaacguuagaagucaaaaauaaauucauaaacauugacauugacgaacaaguaaaauuauuacuagaaauccuaaacuuauuaacgaauaagaaauucacaucuaaacuuaaugaaauaggaaucacagcauccagaggcguauguucauucaacuuaaguaaucaaagucaguuuaguauaaucgaacaaucaguuacaggaguauacgaaaaagaaaagcuaauaauagagaagaagaaagaaggaauacuuuga

SEQ ID NO: 5547 - RNA, 4161 nt, Artificial Sequence
  Cas9 variant
augaaucaaaaauacucaauuggccuagacauaggaacuaauucaguagggugggcuguaauuacagacgacuacaaagugccugcaaagaaaaugaaaguauuaggcaacaccgacaaacaaagcauuaagaaaaacuugcucggagcccugcucuuugauagcggagagacagcagaagcuacuagacugaaaagaacugcuagacgacgcuacacaagaagacguaacagacuaagguaccuccaggaaauauucgcagaagaaaugaugcaagucgacgaauccuucuuccaacgauuagacgacucuuuccuaguagacgaagacaaaagaggagaaagacacccgauauucgggaacauagcggcagagguuaaauaccaugaugaauuuccaacuauuuaccauuuaagaaaacaucuagcagacauaagucaaaaagcagacuuaagacucguauaccuagcucuagcacauaugaucaaauuuagaggacacuuccuaauugaagggcaguuaaaagcagaaaacacaaacguccaagcauuauuuaaagauuucguagaaguuuacgauaaaacaguagaagaaucacaccuauccgagauaacaguagacgcauuaaguauucucacagaaaaaguaucaaaaucacgacgacucgaaaaucuaauugcacacuauccagcagaaaagaaaaauacauuauuuggaaacuuaauagcucuauucuuaggacuucaaccuaacuucaaaacaaacuuccaauuaucugaggaugcaaaacuacaauucucuaaagauacuuaugaggaagacuuagaaggauuauuaggggaaguaggagaugaauaugcugauuuauucgcuagugccaaaaaccucuaugacgcaauacuuuuaucugguauauuaacagucgaugauaacucuacuaaagcacccuuaucagccucaauggucaaaagauaugaggaacaucaaaaggaucuaaagaaauucgaagacuuuaucaaaguaaacgcccucgaucaguacaacgcaauuuucaaagauaaaaacaagaaagguuaugcaggcuacauugaaaguggaguaaaacaagacgaguucuauaaauaccuuaagggaauauuauuacaaauuaauggaucaggugauuuucuggauaaaauagaccgagaagauuuucucagaaaacaacgcacuuuugauaauggaucuauaccacaccaaauacacuuacaagaaaugcaugccauacuucguagacaaggagaacacuaccccuuuuuaaaagaaaaccaagauaaaaucgagaaaauacucacuuuccguauaccauacuauguaggcccacuugcuaggaaaggaagcagguucgcaugggcagaauauaaggcagaugaaaagauaacuccauggaacuuugacgacauucuagacaaagaaaaaucagccgaaaaauucauuacacgaaugacacugaacgaucuauauuuaccugaagaaaaaguccuaccaaaacauagccuuuuguacgaaacauucacgguauauaacgaacuaacaaaaguuaaauauguaaacgaacaaggugaagcaaaauucuuugacgcuaacaugaaacaagaaauauucgaucacguauuuaaagaaaacagaaaagucacuaaagacaaauuacugaauuaccuuaacaaagaauuugaagaguucagaaucgugaaccugaccgguuuagauaaagaaaauaaggucuucaauucuucacuggguacuuaucaugauuuaagaaaaauacuaaacaaaucauuuuuagauaacaaagaaaacgcacaaauaauagaagauauaauucagacccucaccuuauucgaagacagagaaaugauuagacaacgcuuacaaaaauacagugacaucuuuacaaaagcgcaauuaaagaaacuugaaagaaggcauuauacaggauggggaagacucaguuauaaacucauuaacgggauuagaaauaaagaaaacaagaaaacaauauuagacuaccucauagacgauggguacgccaaccguaauuuuaugcaacuaaucaaugacgaugcguuaucguucaaagaagaaaucgccaaagcccaaauuauaggugacguggaugauauagcaaacguaguacaugacuuaccuggaucgccagcaauaaagaaagguauccuacaaucaguaaaaauuguggaugaauuaguaaaagugaugggacacaauccugcgaauauaauaauagagauggcaagggaaaaccaaacaaccgauagagguaggagaaacucccaacaaagauuaaaacuacugcaagacucgcugaaaaauuuagacaauccagugaacauuaaaaacguagaaaaccagcaauuacaaaacgauagacuauuccuauacuacauacaaaauggaaaagauauguacacaggcgaaaccuuagacaucaacaacuuaucacaauaugacauagaccacaucaucccccaggcuuauaucaaagacgauucauucgacaaucgaguacucacuucaagcucggaaaacagaggaaaaucagauaacgucccaucaauagaagugguuugugccagaaaagcugacuggaugcgcuuacgaaaagcaggcuuaauuagccaacgaaaauucgauaaucuaacaaaagcugaacgaggcggcuugaccgaaaacgacaaagcaggauucauaaaaagacagcuaguagaaacgagacaaauaacuaaacacguagcccaagugcuagaugcaagauucaaugcaaagcaugaugaaaauaagaaaguaauacgagauguaaaaaucauaacucuaaaaucaaacuuaguaucacaauuccguaaagacuucaaauucuauaaaguacgugagaucaacgacuaccaucacgcccaugaugccuaccuaaaugcaguaaucgggaccgcacuccuaaagaaauaucccaaacucgcaagugaguucgucuauggcgaguucaagaaauaugauguacgaaaauuuauagcaaaaagugacaaagaaauaggaaaagcaacugcaaaauauuucuuuuauucuaaccugaugaacuuuuucaagaaagaagucaaauucgcagacgggacuguaguugaacgacccgacauagaaacaagugaagauggcgaaauagcuuggaacaaacaaacugacuuuaaaauaguucgcaaaguauugucuuacccucaagucaacauuguuaagaaaacagaaguccaaacucacgguuuagauagaggaaaaccaaggggacuauucaaugcgaacccaucaccuaaaccaaaaccggauagcucagaaaaucuagucggcguaaaaagaaacuuagacccgaagaaauacgguggauaugccggaaucagcaacucauaugcaguauuaguaaaagcaauuauagaaaaaggagugaaaaagaaagaaacaaugguuuuagaguuccaaggcauauccauacucgauagaauaacguuugaaaaagacaaacgcgccuucuuauuaggaaaaggauauaaagacauuaagaaaauaaucgaauuacccaaauacucacuauucgaauugaaagaugguucacgaaggauguuagcaucgauacucuccacaaauaauaaaagaggcgaaauacacaaaggaaacgaacuuuuuguaccccaaaaauucacaacucucuuauaucacgcaaagagaaucaauaaccccaucaacaaagaucauauagaauauguuaagaaacauagagacgacuucaaagaauuauuaaacuacgugcucgaauuuaacgagaaauauguaggagcuacgaaaaauggcgaaagacuaaaagaagccguugccgauuuugauuccaaaucaaaugaagagaucuguacuucauuuuuaggagcaguaaacaguaaaaaugcaggucuguuugaauuaaccagccuaggaagugcauccgacuuugaauuucuaggcgucaagauaccaagauacagagauuacacaccaucgagccugcucaaggacuccacccucauacaccaaaguauaacggguuuauacgaaacaagaauagaccuaaguaaauuaggagaagacuga

SEQ ID NO: 5548 - RNA, 4161 nt, Artificial Sequence
  Cas9 variant
augacuaaaauaacagaagacuacauaguugguuuggacaucggcacaaacucauguggauggguagcaauggauagcaaaaacacaauuuuaagaaugcacggaaaaacugcaauugguucacaucuauucgacgcuggaaacagugcagcugauagacgcgcguuucgcacaacucgaagaagaauaaaacgccguaaauggagauuaaaauuacuugaagaaauuuuugacucgcaccuagccaaaguagauccguauuuuuucgcuagacuuaaagagagcggacucucacccuuagauacucgaaaaaacguuucaucaaucaucuaccccacuucgcuagaagacaaaaaauuuuacguagauaacccaacaauauaccaucuaagauacaaacucaugacagaagaccguaaguucgaucuccgagaaguuuaccuugccauucaccacaucgugaaauaccgaggaaacuucuuguacaacacuccaguuaaagcauucgaagcaucaaaaauagauguaaaagggucacuaaaaaaacuaaaugaacuguacgagggcuuagacucugaauucaacgucgaacuugacagcaacaacgcccuggaaauagagaauauaauacgcgacaaaaaaaucuucaaaauuaacaagguaaaagaaauaaaccaacuucucagcuuaaaaacagaagauaaagaaaggacaaaacuuaugaaagaugucucaaaacaaaucguaaacgccaucuuaggauacaaaaccaaguucgaaaccauuuuacuaaaagacgucaguaaagacgaagcggaugauugggaauuuaaacuaaccgacguagacgcugacaacaaauucgagaaccucauaggagacuuaaaugagaacgaacaagaaauacuccuaguaauucgcaaacuagcuaacgcaauaacacuaagcaacauaguugaagaaggaaaaacauuaagcgaaucaaugaaagauaaauauaaaaaacauucggaugaccuuaaguugcuaaaacagguuauuucggaucacccggacagggauaaagcaaaaaaauuggcacuugcauacgaucucuacguuaacaaucgacacggaaaaauucuacaagcgaaagauaucuuagaaaaaaagaaaacccuuagcaaagaagauuucuauaaagaaauaaaaaaaaaccuagacgacucuaaagaaucucaagaaauauuagacgcuauaucucuagauucuuucaugccaaaacaaagaacuaacgaaaauggagucauacccuaucaauuacaccaauuagaacuagacaagauaaucgaaaaccaaggcaaauacuacccauuuuuaaaagaaguaaacccagucucuucccauuuaaaacaagcucccuauaaacuagaugaauuaauaagguuucgaguucccuacuacgucggaccacuaauaucuccuaaugaaucuacaaaaaauaaacaaaccaagaaaaaucaaaauuuugccuggaugauaagaaaagaacagggccaaauuacgccguggaacuuugaucaaaagguagaucgaauggcuucagccaauaaauucaucaaaaggaugacaacgaucgacacauaucuacugggagaagacguauugccagcuaacagccucuuauaucaaaaauucacaguacuaaacgaacuaaacaacguaaaaauaaauggcaagaggauaagugucccacucaaacaagaacuguacaauaacuuauucaagaaaaauucaacaguaacaacaaauaaacuaaagucauaucuuaaagaaaauuacaagcuaauuaaaguagaaauaaaagguuuaagcgacgaaaaaaaauucaacucuggacuuaccacauauaacaaauuaaaaaaucuaaaaauuuucgaccaacaaauagacgaccccaauuacaacaaagacuuugaacguauuauugaauggucuaccauauucgaagacaaggcgauauacaaagaaaaauuaaagaccauagacugguuaucagacagacagauagauaaauuaagcaaaauuaggaugcaagguuggggccaacucucaaaaaaacuacuaucacaacuaacagacaauaacggacaaacuauuauagaacaacucugggacucccaaaacaacuuuaugcaaauaguaaaucaagccgauuuuaaggacgccaucgcaguugcaaaccaaaaccuauuaguagacacuucaguagaagacauacuaaacgaggccuacacuucuccagccaacaaaaaagcaaucaggcaagugguaaaaguuguugacgauaucguuaaagcaacaagcggaaaaguaccgaaacaaauagcaauagaauuuaccagagaugcugaugacaacgcaaaaauaucacaaagccgcgcaaacaaacuacgcaaaguauacaaagagaugucuaaugaauuagcgagugaaacuauaagaaacgaacuagaaaggguagcaaaagaucaaaaacuccuaaaagauaaacacuacuuauacuuuaugcaauuagggagagacgcuuacacuggagaauuaauagauauagacaaccucgaacaauaugauauugaccacguacuaccacaaucuuucauaaaggaugacucucuugaaaacagaguacuaguaaaaaaagcugucaauaacggcaagagcgacaaugucccagucaaacuauacggaaauagaauggcgacagauuuaggaaugacuauacgucacaugugggaaaaguggaaagaacaaggucuaauaacaaaaacuaaauacaacaaccuaauaauagaccccgauaaaaucaacaaauaugaaagcaguggcuuuauacaccgacaauuagucgaaacaucccaaauuauaaaauugguuucgaccauccuucaaucuaaauaccccgauacagaaauaaucgucgucaaagcaagauauaaucacuaucuaagaaaaagauuaaauuuauacaaauccagagaaguaaacgauuaccaucaugccauagaugccuacuuaucagcaauaugcggcaaucuacuauaucaaguauacccauaccuccgaccauucuucguauacggacaauacaaaaaauuuucaucagagccugaaaaagaaaaaauuaucuaugacaaaacaagaagauauaacuucauaucgcagauauucgaaaacaaagauaaugacauaauauccagagaaaccaaaaaaaaggucuuugacaaaaaagacauuauugaaaaacucaaacgagcuuauaauuacaaauacaugcuaguaagucgagaaaccgagacacacgaccaagaaauguucaaaaugacaguuuacccaaggcucagccgcgacacaaaaaaaucaagaaaucuaauaccaaaaaaaaaagauaugccaaccgagaucuauggaggauauacuaacaauucugaugcauauaugaucauagcuagaaucaauaaaaagaaaggaccagaauauagaguuuucgguguacccaugagagaacuaguaaauuuaagaaaggcagaaaaaaacggacacuauaaagcuuaccucaaacagguauuagaaccagagauaauguacucgaaaaacggaaagaaaaauaaaacuauaagcagcuucgaaauuguaaaagcuaaaguaccauacaaacaagucauacuagauggagacaagaaauuuaugcuagcaucuucaacuuauguccaaaaugccaaacagcuaacucuuucacaauacaguaugcaagcaauaacagauaauugugaaaacgacacugaagaagaaaaagcauugguagaagccuacgacgaaauauuaacaaacauagauaaauaccuaccguuauuugauauaaacaaauucagagaaaagcuacacgcagggagagaaaaauuuguagaucuaccauuagcugaaaaaaaagagaccauauuacaagugcuaaacgguuuacacgacaaugcaguaaugccuaagauaaaaucacuaggacuaucaaccccucuagguuucaugcaauuccacacuggcgucucauuaagugagaacgcaaaacuaauauaucaaagccccaccgguuuguucgagaagagauuaaaaauuucugaucucuga

SEQ ID NO: 5549 - RNA, 4164 nt, Artificial Sequence
  Cas9 variant
augucggauuccaaaaaauucgaaggcgaaaauguaaaauccggcgauaaaaaaacuaacaaaaaccaugguaaaguccuaaaaucaaguccuaaagaaaucagaaaaaacacagaauauuuuauaggacuugacauaggcacgucaucaguuggcugggcugucaccaacacagacuacgaaauacuaaaauuuaauggcaagagaauguggggaaguagguuauucaaugaagcaucaacagcagaggaaagaagaggucaccgaguaaaccgcagaagaauacaaagaagacgagauagacuaaaccuguuagaagagaucuuuagugaagaaauggcaaaaguggauccugaauucuuuaugagacuuaaagaaucaaaguuucacuuggaagacaaagaugaaagaauacuaggagagucaaauauaauauuuaaaggaagcgaagacggagauaagaaauacuacgaaaaauacccaaccauuuaucaucuacgacauaaauuaaugcaaaguugcgaagauguagacauaagggaauuauauauggcauuacaucacaucauaaaauacaggggccacuuucuauucaaaggagauuuugaagaaaccggcacuagcauagaaaacauaauaauugaauuacuagaacuaauuaauaauaaccuaggaguaaaaaaauucgaauauaacgaaagucuaauuaaugaauugaaaaacauagugaguaauacgagcaacaccauaaccaacaaaaaaaagcuacucggcgaguuuuucaacaaaaaagaauacaaagcacacaagaguuuauucaucuuaucaaucggagccagugugaaacccguagacuuauuucuagaggaagaauacaaagacauagaugauauaaaaaauaucaguuucaagaauuuagaauacgaucaaguacgcgauaccuaugaaucgauuuuuuuagacaaaauagaauucaucgacguagccaaaagauuauacgacgcuacgauucuccugucaauaaaaccagaaggaaaaacauuaagugaagcuaaaguagacauauauaacaaacaccacaacgacuuagaacuacugaagaaagucuuaaaaacagacaaagagaaauaugacucuauccuaaagcuagauaucaagaaagguaacaauuacguaaacuacgucaaaaaaaguaaaaacgguauaucauguaguaaagaagaauuucacaacgcucucaagaaaguacuaguuaaaauagaaaaaacagaugacauaaaauauauacuuaaugaaauagaacuggaacgcuuccuaccauuacaaagagucaaagacaacagugucauccccuaccaaauccacagauaugaguugaaaaaaauucuugagaaugcaagcaaaaaguuuacuuuuuuaaaugaagaaucagauggccacacaaacaucgagaagauaauaaaaauaauggaauaccgcauaccauacuauguuggccccuugaaugaucaccacagcguauauaacaaugguuuugcauggguaagcagaaaaagaaguggaagaaucacccccuggaacuucgacgaaaugguugacaaagaagaaucagcagaaagauuuauagaaaauuuaacaaauaaaugcucguacuuaauaggagaagauguucuacccaaagaaucauuacuuuacucagaauucucauuauuaaaugaacuaaacaauauaaaauaugacggcauaucauuacccaucgauauaaaaaaaucaauaguggaaaagauauucagaguagaaaaaaaacgaguaacgaaaaaauacauuaaagaauuucuaaaacaagaaggauauucugacgguaaaggagaaguaaguggcauugauaucgauauaaagucugauuuaaaaucauacagagauauggugaaaauuuucgguaccgaaauagacuauagaauggcugaaaauaucauaaaauggguaacgcuuuucggagacagcaaagaccugcugaaaaccaaaauaaacaaagaauauggagaaaaaguauccaaagaucaacucaaaaaaguauguaaguuaaaauacagggauuggggacgacucucaaaaaaauuccuaaccggcauucgaucaagcguacucguaaacgaugcuacaggcgaaggauacaccauaauugaggcaaugagaaauacagauaauaacuuaaugcaacuacuaagaaacgaauacgacuaccuaaagaaaaucgaucaaauaaauaugcucagcagaaaagacauagaugaaaucagucaugacauauuagaugaccuauacugcucaccagcugugaaacgaucacuauggcaaacaaucaaaauaguagaagaaauaaaaaagauaaugggccaugaacccaaaaaagucuuuguagaaguaacgagaacuaacaaagcugauaaaaaaacaacaaucacgagaaagaaucgccuucuagaacuuuacucagccauaaaugcagaaagcagagauugggucaacgaacuuaauucaacugaagugucaaaauuuaacucuaaaaaacucuaccuuuauuacacucaaauggguaaaugcauguauacugggaaaaacauugacauagaaucauuauuuacagauauguaugacauagaccacaucuuuccucgaaguaaaacaaaagauaauaguuucgaaaauuuaguacucguaacacguaaagccaacgcggacaaaagagacguuuauccaauagacccaaaaauccaaaccgaaagaaaaagucuaugggauauguuacaugauaaaaaacuaauuggggauaaaaaauaugaccguuuaacucgaacaacugguuuuacggacgacgaaaugucuggauucauagcacggcaauuaguugagacuucacaagcaucaaaagcagcggcggaaauguuaaaacuaauuaacaacgacagcgaaauaguauacguaaaagcagaaaacgucucagauuuuagacaugaaaacgaauucauaaaagucagagaaauaaaugaccaccaccaugccaaagacgcauaccuaaauauaguuguagguaauguuuauaacgaaaaauucacaaagaaccccgccaauuacauuaagaaggguggcggaaauaauuauucccucaauugcauauucaaccgaaacuuagaucguaacggcaaaagaauaugggacgaaaaaaaaucaauagacacagugaacagaaugaugaaaucaaacgacguccgaguuacauuuaaaaauagaguagauaaaggaccgauacuuaauaaagugacaauccacaaggcaagcgaauucauggacgacgguaaaaaaaauaaaaaaggauucccaauaaaguccucugagaaaaacggcaauaacagacucuguaauuuauacaaauauggagguuacaaagauuuaaacuacucucauuacaccauaguacgauacaacguauaugaaaaaaaaggauuagacaucaaauacuacaugauaccaauuccauauuaucucugccuaugcaauauaaaccaacaugacuacguauacgacuauauaaguaacagaucuaaaaaagacgucaauaauauagaaaucauaguaaacgaauuaaagaugggcucgcuaaucaauaucgacggauacaacuacuaccuaggaggaucaaaaccaaaaacuuuuuaugucgacccagcauaucaaauaauacuagacaaagaaauagaaaggugcauuaaagagauaguaaaagccaagaacaaugaguaucgauuuauaaauacugauaaaauuaacaaaaacuuaaacaugaaaauauacaaauacaucguaaacaagaaaauuauuggaguuuuuagaaacagaaaaugggauaaaggggaauaccuaaauuccucagaaacaauagaaaaauuuucaggccucucugucgaaagucaauguaacgucauacuaagauuaauaaaugauaugaggggaagcaacaaaggaggugcaaacagcaaauucgacgaauuagaaaugacaauaagcagggcagaaaucccccaaacacucaguaauguaucauccuucaagaucauaaaccaaaguauaacuggucuauuugaaaaugaagucaccauaguauga

SEQ ID NO: 5550 - RNA, 4167 nt, Artificial Sequence
  Cas9 variant
augacaaaaccauauaguauaggccuggacauaggaacuaauucaguaggaugggcagucauaaccgacgauuauaaaguuccaucgaaaaaaaugaaaguacucggaaauaccucgaaaaaauauauaaaaaaaaaucuauuaggcgcuuuacuuuucgacucuggaauaacugcagaaggacgcagauuaaagagaacagcuaggagaagguacaccagaagaaggaaucgaauacuguacuuacaagaaauauuuaguaccgaaauggcgacauuagaugaugcauucuuucaacgccucgaugacucauuuuugguuccagaugacaaaagagauagcaaauauccgaucuuuggaaaucuaguagaagagaaagcauaccacgacgaauucccaaccaucuaccaucuacggaaauacuuagcagauuccacuaaaaaagcugaucugcguuuaguuuacuuagcauuagcccacaugauuaaauaccgaggccauuucuugauagaaggcgaguuuaacaguaaaaauaaugacauacagaaaaacuuucaagauuuccuugacacauacaaugcaauuuucgaaucagaucugucguuagaaaauucuaaacaauuagaagaaaucgugaaagacaaaauaucuaaauuagagaaaaaagaccgaauacucaaacuauuuccaggugagaaaaauagcggcaucuucucagaauuccuaaaacuuauaguaggcaaccaagcagauuucaaaaaauauuucaaucuagacgaaaaagcaucauuacacuucaguaaagaaaguuaugaugaagaucuagagacccuacuuggauauauaggcgaugauuacagugauguuuuccuaaaagccaaaaaacucuacgacgcgaucuuauuaucaggaauccuuacaguaacagauaacggaacugaagcucccuuauccagcgcgaugauuaugagauauaaagaacacgaggaagaccugggguuauuaaaagccuauauaaggaacauaucucucgaaacguacaaugaaguauuuaaggacaauaguaaaaaugguuacgcaggcuauauagacggaaaaacuaaccaagaagacuucuacguauaccuuaaaaaucuguuaucaaacuuugaaggggcugauuacuucuuagagaagauagauagagaagauuuucugcgcaaacaaaggacauucgacaacggcucuauuccuuaccaaauccaccuacaagaaaugagggcaaucauagacaagcaagcuaaauuuuacccauucuuagcuaacaauaaagaaaggauagaaaagauacuaacuuuccgaauaccuuauuauguuggaccucuagccagaggaaauagcgacuucgcauggaguauaagaaaacgaaacgaaaaaauaacuccauggaauuuugaagacguaauagauaaagaaaguagcgcagaggcauucauuaacagaaugacaucuuuugauuuauauuuacccgaagaaaagguucuaccaaaacauucccugcuauaugaaacauuuaacgucuauaaugaacucacaaaaguacgcuuuauagcagaaucuaugagcaaauaucaauuccuagacagcaaacaaaagaaagacauaguaaggcuauacuuuaaggacaaaagaaaagugacagacaaggauauaauagaauauuuacacgcaaucgacggauacgauggaauagaauugaaaggaaucgaaaaacaauucaacucaucccuuucaacauaucaugaccuacuaaauaucaucaaugacaaagaauuccucgacgauuccucaaacgaagccauaauagaagaaauaauacacacacucacaaucuucgaagacagagaaaugauaaaacaacgccuaucaaaauucgaaaauaucuuugacaaaucaguucugaaaaaacucucacgaaggcacuauacaggauggggaaaacuaagcgcaaaauuaaucaacggaauaagagacgaaaaaucagguaacacuauucuagacuaucucauagacgauggaauuaguaaucguaauuucaugcaauuaauacaugacgaugcauuaucauuuaaaaaaaaaauccaaaaagcacaaauaauaggagacgaagauaaggggaauauaaaagaaguagugaagucucuaccaggcaguccagcaauaaaaaaagggauccuccaaagcaucaaaauagucgaugaauuagucaaagucaugggaggucgaaaaccagaguccauuguaguagaaauggcccgagaaaaucaauacaccaaccaagguaaaucaaacagucaacaaagauuaaaaagacuagaaaaaucgcuuaaagaacucgggucuaaaauccuaaaagaaaauauaccagcaaaacuuaguaaaauagauaauaaugcccuacaaaacgauagacuuuaccuuuacuaccuucaaaacgguaaagauauguacacgggagaugaccucgacaucgaccguuuauccaauuaugacauagaccacauaaucccccaggcauucuuaaaagauaauagcauagacaacaaaguuuuagucaguucagccucuaaccgaggcaaauccgaugacgucccaagcuuagaaguaguaaaaaaacgaaaaacucucugguaccaacuacuuaaaagcaaacuaaucagucaacgcaaauucgauaacuuaacaaaagcugaacgaggaggacuaagucgagaagacaaagcgucauucauccaaagacaacugguagaaacccgccaaauaaccaaacacguugcacgacuauuagacgaaaaauuuaacaauaaaaaagaugaaaauaaccgggcaguaagaacaguaaaaaucauuacauuaaaaaguacucuagugagucaauuuagaaaagauuuugaguuauacaaaguaagggaaaucaacgaccuacaucacgcgcacgaugccuaccuuaaugcagugguagcuucagcacuacuaaagaaauacccaaaacuagaacccgaauuuguauauggcgauuacccaaaauauaauucauuuagagaacgcaaaucagccacugagaaaguuuauuucuacagcaacaucaugaacauauuuaaaaaauccaucagcuuagcugacgguaccguaaucgaaaaaccuuuaauugagguaaacgaagagacaggagaaucaguauggaauaaagagucagaucucgcuacgguaagaaggguccuuucauauccccaaguaaacguaguaaaaaaaguagaaaaacaaaaccacggacuugauagaggaaagccaaaaggcuuauucaacgcaaaucucaguucaaaaccgaaaccgaauucuaaugaaaaccuaguuggugccaaagaauaccuagauccgaaaaaauacggugguuacgcagguauaucaaacucauucgccguacuaguaaaaggaacaauagaaaaaggagcaaaaaaaaaaauuacaaacguacuggaauuucaaggaauaagcauuuuagacagaauuaauuacaggaaagacaaauuaaacuuccucuuagaaaaaggcuacaaagauauagaauugauaauugaauuaccaaaauacucacuuuuugaauuaucugaugguuccagacgaaugcuagcuuccauauuauccaccaacaacaaaaggggagaaauacacaaaggcaaucaaauauuucuaucacaaaaauucgucaaacuucuauaccacgcuaaaagaauaucaaacacaauaaacgaaaaccauagaaaauauguugaaaaccacaaaaaagaauucgaggaacuauucuauuauaucuuagaauuuaacgaaaauuauguuggggcaaaaaaaaacggcaaacuguuaaauucagccuuccagaguuggcaaaaccauucuauagaugaauuaugcuccucauuuauagggccaaccggaagcgaaagaaaaggccuuuuugaauugacaucucgagggucagcggccgacuuugaauuuuuagggguaaaaauaccaagauaccgagacuacacuccaucaucauuacugaaagaugcuacccucauacaucaaaguguaacgggacuauacgaaacuagaauagaucuagcaaaauuaggagaagguuga

SEQ ID NO: 5551 - RNA, 4167 nt, Artificial Sequence
  Cas9 variant
augacaaaaccauacuccaucggccucgacauaggaacgaacucuguagguugggcagucauaacugacaacuacaaggugccuucaaaaaagaugaaaguucuagguaacaccucaaaaaaguauauaaaaaaaaauuuacuaggaguauuauuauucgauaguggcauaacagccgaaggaagaaggcuaaagaggacagcaagacgaagauacacacgacgaagaaauaggauccuguauuuacaagaaauuuuuuccacggaaauggcaaccuuagaugacgcuuuuuuccaacgccuagaugacucauucuuagugccagacgauaaacgagauucuaaauauccuauauucggaaauuuaguagaagaaaaaguuuaccacgaugaauucccaacaauauaucaccuacgaaaguauuuagcagacucaaccaaaaaagcggaccuacgccuaguuuacuuagcacuagcacauaugauuaaauauagaggccauuuuuugauagaaggagaauucaauuccaaaaauaacgauauacaaaagaacuuucaagauuuucucgacacuuauaacgccauauucgaaagugauuuaucacuagaaaacucaaaacaacuugaagaaauugugaaagacaaaauuucaaaacucgaaaagaaagacagaauccucaaacuuuucccaggagaaaaaaauuccgguaucuuuucggaauuccuaaaacugauaguaggaaaucaggcugacuucaggaaaugcuuuaaccuagacgaaaaagcaucauuacacuuuuccaaggaaucuuaugacgaagaucucgagacacuauuaggauauauaggagacgacuacucagacgucuuccuaaaagcaaaaaaauuauaugacgcaauacuuuuaucuggauuucuaacagucacggacaaugaaaccgaagcgccauugagcagcgcaaugauaaaaagauacaacgaacacaaagaagacuuagcacuauuaaaagaauauauacgaaacauaucauuaaaaaccuauaacgagguuuucaaagaugauacaaaaaaugguuacgcggguuauauugacgguaaaacgaaucaagaagacuuuuauguuuaucuaaaaaaccuacuugcugaauucgagggagcagacuauuucuuagaaaaaauagaccgcgaagauuuucucagaaaacaacgcaccuucgauaaugguaguauacccuaucagauacauuuacaagagaugagagcaauucuagacaaacaagcaaaauucuauccauucuuagccaaaaauaaagaaagaauagaaaaaauauugaccuuuagaaucccauauuaugucggaccucuagcaagaggaaauucagauuuugcauggucaauaagaaaacguaaugaaaaaauaacaccauggaacuucgaagacgugauagacaaagaauccagcgcagaagcauucauaaauagaaugaccucauuugaucuguauuuacccgaagaaaaaguacuaccaaaacauucauuacucuacgaaaccuuuaauguguauaacgaacugacaaaaguaagauuuauagcggaaucaaugagagauuaccaauuucuagacagcaaacaaaaaaaagauauaguucgauuauacuucaaagacaaaagaaaaguaaccgauaaggauauaauugaauaucuacaugcaaucuacgguuacgacggaauagagcucaaaggaauagaaaaacaauucaauaguucauuaucuacguaucaugaccugcuaaauauaauaaaugauaaagaauucuuagacgacucuucaaaugaagcuauaauugaagaaauaauacauacacuaacgaucuucgaagaccgugaaaugauaaaacaaagacuaaguaaauuugaaaauauauuugauaaaucaguacugaaaaaacuauccaggagacauuacacaggaugggguaaauuauccgccaaauuaauaaacggaauucgugacgaaaaaucugguaauacaauccuagacuaccuaauagaugauggcauauccaauagaaauuucaugcaacugauacacgacgaugcauuaaguuucaaaaaaaagauccaaaaggcgcaaauaauaggugacgaagacaaagggaacauuaaagaaguaguaaaaucauuaccaggaucacccgcuauaaaaaaaggcauauugcaaucuauuaaaauuguugaugaacuuguaaaagucaugggaggaagaaaaccagaaaguauagugguagagauggcacgcgaaaaccaauauaccaaccaaggaaaaucaaacagccaacaacgacuaaaacgacuugaaaaaagccuuaaagaauuggguucaaaaauacucaaagaaaauaucccagcaaaacuuucgaaaauugacaacaaugcauugcaaaacgaccgauuauaccucuacuaccuacaaaacgguaaagauauguacacaggagacgaccucgacauugacagauugucgaacuaugacaucgaccauauaauaccacaggcauuccuuaaggauaacucaauagacaacaaaguacucguaaguucagcgaguaaccgaggaaaaucggaugacuuuccaucucucgagguagucaaaaaaagaaaaacauucugguaccaacuacuuaaaucuaaauuaauaucucaacgcaaauuugacaaucucacaaaagcagagcgcggcggucuauuaccugaggacaaagcaggcuuuauacaaagacaacucguugaaaccagacaaauaacaaaacacgucgcaagacugcuagacgaaaaauucaauaauaaaaaggaugaaaauaaucgugcuguacgaacaguaaaaauaauaacauuaaaauccaccuuaguuucacaguuuagaaaggauuuugaacuauacaaagucagagagaucaacgacuuucaucacgcucaugaugcuuacuuaaacgccguuauagcaagcgcucuacucaaaaaguauccaaaacuugaaccugaauuuguguacggugacuacccaaaauacaauucauuuagagaacgcaaaucagcuacagaaaaaguuuacuuuuacagcaacauaaugaauauuuuuaaaaaaucuauaagucuagcggauggcagaguaauagaaagacccuuaauagaaguaaacgaagaaaccggagaaucaguauggaacaaagagucagaucuugccacaguaagaagaguauuaaguuacccacaagucaauguaguaaaaaaaguagaagaacaaaaucauggguuagaucguggcaaacccaaaggacuauuuaacgcaaaccuuucaaguaaaccaaaaccuaacucaaacgaaaaucuuguaggugcuaaagaauacuuggauccaaaaaaauacgguggauacgcaggaauaucaaacucauucgcuguauuaguaaaagggaccauugagaagggagcaaaaaaaaaaauaaccaacgucuuagaauuucaaggcauaucaauauuagaucggaucaauuacagaaaagacaaauuaaauuuuuuacuggagaaaggauauaaagacaucgaauugauaaucgaacuaccaaaauauuccuuguucgaauuaucggauggaucaagacgcaugcuagcgucuauacuaucgacaaacaauaaaaggggagagauccacaaaggcaaucaaauauuucucucacaaaaauucgucaaacuccucuaucacgcaaaaagaaucucuaauacaauaaacgaaaaccaucgaaaguacguagaaaaccacaaaaaagaauuugaagaacuauucuacuauauacucgaauucaaugaaaauuauguaggugcaaaaaaaaacggcaaauuacuaaacucagcauuucaaucauggcaaaaccauuccauagacgaacugugcaguucauucauagguccaaccggaucagaacgaaagggacucuucgaauuaacaucgcgcggcagcgccgccgauuuugaauuuuuaggaguuaaaauaccacgauaucgcgacuacacgccuucaagcuuauugaaggacgccacguuaauccaucagagugucacuggccuauacgaaacgcgcauagaucuagcaaaacuaggagaaggauga

SEQ ID NO: 5552 - RNA, 4167 nt, Artificial Sequence
  Cas9 variant
augacaaaaccauauucuauaggucuagauauagguacaaauuccguagggugggcuguaaucacagacaauuacaaaguacccagcaagaaaaugaaaguacuaggcaacacuuccaagaaauacaucaagaaaaaccuuuuaggcgugcuacuauuugacuccggaauaacagcugaagggcgaagacuaaaaagaacagcacgaaggcguuauacaagacgucgcaaucgcaucuuauaucuccaagagauauucagcaccgaaauggcaacccucgaugaugccuucuuccaacgacuagaugauucauuccucguaccagaugauaaaagagacuccaaauaccccauauucgguaauuuaguagaagaaaaagcauaucaugacgaguucccuaccaucuaucaucuccgaaaauacuuagcugacucuaccaagaaagcagauuuaaggcucguauaucuagccuuagcccacaugauaaaauaccgaggccauuuccuaauagaaggagaauuuaacaguaaaaauaacgacauucagaaaaacuuucaagauuuccucgacacauacaacgcuaucuuugaaucagacuuaucauuagaaaacucaaaacaacucgaagaaauaguaaaagauaaaaucuccaaacuagaaaagaaagauaggauacuuaaacuauucccaggagagaaaaacagugguauuuucucagaguuccuaaaauuaauaguaggaaaucaagcagauuuccgaaaaugcuuuaacuuagacgaaaaagccagucuacacuuuagcaaagaaaguuacgacgaagacuuagaaacauuacucggauauaucggagacgauuacuccgacguauucauuaaagcuaagaaauuauacgaugcgauucuauuaucgggcuuucuaacuguuacugacaacgaaacagaagcaccauuaucaucggcgaugauaaaacgauacaacgaacacaaagaagaccuugcacuucuaaaagaauauauacguaauauuucauuaaaaacauacaaugaaguauucaaagaugauacgaaaaacggguaugccgguuacauugacggcaaaacaaaucaagaagauuuuuauguauaccucaaaaacuuacuagcagaguucgaaggggcggauuauuucuuagagaaaauagacagagaagauuuccuaaggaaacaaagaacauuugauaauggaucaauacccuaccaaauccaucuacaagaaaugagagcaauccuagauaaacaagcaaaauucuacccauuucuagcgaaaaacaaagaaagaaucgagaaaauacuaacauuuaggauaccauauuauguagguccauuagcaagaggcaauagcgacuuugcauggucuauaagaaaaaggaacgagaaaauaaccccuuggaauuucgaagacgucauugacaaagaauccagcgcggaggcuuuuauuaaucgaaugaccaguuucgacuuauacuuacccgaagaaaaagugcuuccaaaacacucacuccuauacgaaaccuuuaauguauauaacgaacuaaccaaaguaagauucauagccgaaagcaugcgagauuaccaauuucuugacucaaaacagaagaaagauauuguuagacuauauuucaaagauaaacggaaagugaccgacaaagauauaaucgaauaccuacaugcuauuuacggauacgacgguauugaauuaaaagggauagaaaaacaauucaauucaagucucucaacauaucacgacuuacucaacauaaucaaugacaaagaguuccuggaugauucaagcaacgaagccauuauugaagaaauaauacacacacuaacaaucuuugaagaucgagaaaugauaaaacaacgcuuaaguaaauucgaaaauauuuuugacaaaagcguacucaagaaacuuucucgacgccacuacaccggauggggaaaacuaucugcaaaauugaucaacgggauacgugacgaaaaaucggguaauacuauucuagacuaucucauagacgauggaaucuccaaccgcaacuuuaugcaacuaauacacgaugacgcacuuucauuuaaaaagaaaauucaaaaagcgcagauaauuggagaugaagacaaaggcaacauaaaagaaguaguaaaaucccuaccgggauccccagcuaucaagaaaggaauauuacaaucaauaaaaauugucgaugaacucguaaaagugaugggaggccgaaaaccagaaucaauaguaguagaaauggcacgcgaaaaccaauauacaaaccaaggcaaaagcaauucacaacaaagacuaaaaagacucgaaaaaucacugaaagaacuaggaagcaaaauucuaaaagaaaacauaccagcaaaacuuucaaaaauagacaacaaugcccuacaaaacgauagacuauaucuauacuaucuacaaaaugguaaagacauguauacuggagacgaccuagacauugacagauuaucaaacuacgacauagaccauaucaucccacaagcauuucuaaaagauaauucaauagauaauaaaguccucguaucuucagccucaaaccgcggcaaaucagaugacuuuccaucucuagagguuguuaagaaacguaaaacuuuuugguaucaacuguuaaaaagcaaacugauuucacaacgcaaauucgacaacuuaacaaaagcugaacgaggcggacuacucccagaagacaaagcggguuucauacagagacagcuggucgaaacacgacaaauuacuaaacacguagcacgauuacuagacgaaaaguucaauaacaagaaagacgaaaacaacagggccguacgcacaguaaaaauaauuacauuaaaauccacacuugugucucaauucagaaaagacuuugagcucuacaaagugagagaaauaaaugauuuucaucaugcgcaugaugcuuauuuaaacgcagucauagcuagcgcacugcucaagaaauauccaaaauuagaaccagaauuuguuuacggagacuacccaaaauauaacuccuuccgugaacgaaagagugccacugaaaaagucuacuuuuauucaaacauaaugaauauuuucaagaaauccauaagccuagcggauggacgcguaauugaaagacccuuaauagaagucaacgaagaaacuggagaaagcguauggaauaaagaaagcgacuuagcuacaguacgaagaguccucuccuacccccaaguaaauguagucaagaaaguagaagaacaaaaccacggacuagacagaggcaagccaaaaggacuuuucaaugcaaaucucucaaguaagcccaaaccaaacagcaacgaaaauuuaguuggagcaaaagaauaccuugaucccaagaaauacggcggauacgccggaauaaguaacucauucgcagucuuaguaaaaggaacaauagaaaaaggagcgaaaaagaaaauaacaaauguccuagaauuucaagguauaagcaucuuagaucgaauaaacuacaggaaagacaaacugaauuuccuucuagaaaaagguuacaaggacauagaauuaauaauagaacuuccaaaauacucucuauucgagcuaagcgacggaucacguaggaugcuagcguccauauuaucaacaaauaauaagcgcggugagauacauaagggaaaucaaauauuccugucacaaaaauucgucaaauuacuauaccacgcuaaacgaauaucaaacacaaucaaugagaaccacagaaaauauguagaaaaccacaagaaagaguucgaagaacuguucuacuacauauuagaauuuaacgaaaacuauguaggagcuaagaaaaacggcaaauuacucaacucagcuuuucaaucauggcaaaaccauucaauagaugaauuguguucaucauucauagguccaaccgggucagaacgcaaaggacucuuugaacuaacauccagaggauccgcagccgacuuugaauuuuuagguguaaaaauccagagauaccgagacuacacaccaagcucauuacuaaaagaugcuacuuugauacaucaaucaguaacaggccuguaugaaacaagaaucgaccuagcaaaacuaggagaaggauga

SEQ ID NO: 5553 - RNA, 4167 nt, Artificial Sequence
  Cas9 variant
augaaaagaauuuuaggauuagaucuuggcacaaauuccaucggaugggcacucguuaaugaagcugaaaacgaaaaagaaauuucaaaaaucauuaaacuaggaguacgagucaaccccuuaacgauugacgagaaaaccaauuucgaaaaagggcguccacuauccaccaacgcggaccgaacccuaaaaagaggugcaagaagaaaucuucaaagauauaaauuaagaagagaaaauuuaauagaaauacuaauagacaaucauaucauaacaaaagaaaccccuuugacagaaaucggcaaggguacaacauaucagacguuaucauuaagagcaaaagcaguaagagaacgcauagacuuagaagacuuugcaaaaguucuacuugcaauaaacaaaaagagaggauauaaaaguucacgaaaggcuucgaaugacgaagaagggcaagcaaucgacgguauggcaauugccaaagaacucuaugaaagaggaauaacaccuggacaauacguucucgaauuauuagaaaacgauagaaaauacauaccagauuuuuauagaagcgaucucaaacaagaauuuaacaaaaucuggaauaaccagaaaaccuucuauccggaaauacuaacagacgaauuauucaaagaacucgacgguaaaaacaaaagucaaacuugggcuaucugccaaaaaccuuuuaacauaaaaggaauaaaacguauaacaaaaggacgagaaaagacaauagaaaacuaucauuggcggguuaaaggcuuaucaggaaaacugaacuuagaaaaauuagccauaauccuacaagagauuaauaaugauaucaaucagagcucaggcuaucuaggagguauauccgacaaaaguaagaaauuguaucuaaauaaagaaacugugggugaauuucuuuauaagcaaauagccaaaaacccacauacaaguuuaaagaaccaaguguuuuaccgacacgauuaucuagaugaguucgaacaaauuuggaaaacacaauccaauuucaacgcaaauuuaacugacgaauuaaaacaagaaaucagagauguuaucauauuuuaccaaagaaaaaucaaaucccagaaaagccuuauauccuucugucaauucgaaaguugggaacaagaauauuucgacaaagaaacugguaaaaccaaaacacggacagucggaagaaggguaaucccaaaauccuccccacuauuccaagaguucaaaauauggcaaaaccuaaaccaccucgucuucacaaacagugaaacagacgagaaaauagaaaucaaagaaguagaacaagaaauaagaaaagaguuguuugaagaacugaaccucagaggcgaccuaaauccaaaugauuuacuaaaaauacucagaucacaauuuaaaauagguaaauuaucaaauuggaaaugcaacuuugaaaagauagagggaaaccguacaaacgccgcacuuuuuaacaucuaccagaaaaucucagacuucgaaggauacgguauugauuggaacaaguccaacgcuaaaaagauaagaaaagagcuaaaagcaacauuuccagaaauaggaauagacgcaagcauauuagaauuugacgcauauaagaaacaacucacaaaccaaaguagcuaugaacuauggcaccuucuuuacucagcggaagaagacuucaaaauaucggaacaagauaaacuaauauacggaaauucauccgucucauugaaaaagaaauuacacuuaaaauucggauuuaacccugaauaugcaaaaauguuagcaaaccucucacugaugagugauuacgguaaccucucagcgaaagcuauaaagaaaauacuaccuuaccuugaagauggccaucuguauucagaggcuugcagacuagcagguuauaaccauucuaaauccuuaacagcggaagaacuugagaaauuugaacccaaggcaaaacucgacuuacuaaagaaaaacagucuaagaaaccccgucgucgagaaaauuuuaaaccaaaugguaaacguugucaaucaaguaaucgacacauacggaaaaccagacggagucagaauugaacucgcaagagagcuaaagaaaagcgcaaaagaaagagcugaaaugacaaaagguaucgccgauggcacaagacgcaacgaagaaauaaagaaaaucaucacccaaaaauuugguauccccaacccaacaaaaagugaucuaguaagguaccgcuuauggcaagaacuagaaucacgaggauacaaagacauauucaccgacaaauauaucagcccugauaaaauauuuucaagcgaaauugacauagaacacauaauaccuaaagcccuucuauucgacgauuccuuuaguaauaaaacccucucguuuagaaacguaaauuuaaagaaagcaaaucgaacagcccuugacuucauaacacaagauuaccagagcaacguagaagcauacaaagaacggguugaaacauggaacaaagacaaucacauuucaaaagguaaaagaaacaaauuacuaaugucacuaaaagauauaccagauggguuuauagaaagggaucuuagaaacucccaauacauagcacggaaagcuaaaagaaugcuuuacgaaguauucccaaaugaaguucuagccacuucgggaucaauaacagacaaauuaagauccgauugggauuuaauaaacguaaugaaagaacuuaaucuaccaaaauacaaagccuuagggcuaacagaauacgaagaacgacuagauaaaggcacagaagaguuauuuaaacacgaagucaucaaagacuggacuaaaagaaaugaccacagacaccaugcaauggaugcacucgcuguagcauucacaacccacaaccauauacaauacauaaacaaucugaaugcaagaaaagacauuacccaagauaaucauccaauaauuaaaaacaucgaaaaccuaauuacagaaguuaauuccaaagguaaacgaguauuuaaagcucccaugucgucauuuagagaauccgcaaaagaacaaauagaagcaauauuaguaucauuuaaaaacaaaaauaaagugguuacuaaaaauauaaaccaaacuaagaaagaaggaggauucaauuaccaaaaugcuaaaacaccuagaggacaguuacauaaagaaacuauauacgggaaaaguaaacaaccgcuugaaaaaccaguuaaaaucaacaaucgauucuguaagaaacaagucgggcuaauaauuaauuuuaaagaacaagaagcaguauuacaucaccugaagaaauaugacaauaacgagaaaaucgcauuuucuaauaaaacccuuaaaagugacccgauacaaguuaacgguucaccccuucgagaaguuaaaauauucgaagaaauuuuuacaauaagaaaagacaucaauccagacaacuucaaaacccaaaaacacuuagacaaaauaaucgauaaaggaauaaaagaaguaaugaagaaaagauuagaagaauacaacggcgacuucaaaacagccuucuccgacuuagacaaaaaucccaucuggcuaaaucaaucuaaaggaauuacaauaaaaagagcaacuauaagcggagugacuaaugcagaaccauuacaccaagcuaaagaccaccuaggaaauauaauuuuagacgauaacgggaaagaaauaccaauagauuauguaucgaccggcaacaaccaccacguagcaaucuaucaagacgaaaguggaaaccuacaagaagaaguagucucuuucuacgaagcaguaauccguaaaaaccaagaccaacccauaaucaagaaacgacacccaaaaggauggaaauuuuuauucacuaugaaacaaaaugaaauguucgucuucagcucagaaaauuuuaauccaucagaaauagaccuacuggacgagaaaaacgcagcaauuauaaguccaaaccuguuuagagugcagaaaauagccacgaaaaacuauauguuucgccaccaucuggaaacagaagucacaaauaauuuagacuucacauaucgacauuuccaagcaaccgaaugguugcgaaaucuaugcaaaguacggaucgaccauauugguagaauaguccaaauaggugaauacuga

SEQ ID NO: 5554 - RNA, 4170 nt, Artificial Sequence
  Cas9 variant
augauaauaagaacguaugaacuuaaaacaauaacuacaauugcaauacuaaaaauguuucaacuacucaccggagguuuaaguaugacaaaauuagguaaaccauacggaaucgguguagacauaggcucaaauagcauagguuucgcugcugucgaugaaaacagucaucucauaagacucaaaggcaaaacaguaauaggagcccgauuauuugaggaggggaaagcagcagcagauaggagggccucgcgaacgacuagaagaagacuaagucgaaacagauggagauuauccuuuuuaagagacuuuuucgagagucauaucacaccaacagguccaaauuucuuuaugcgucaaaaauacagcgagauaagcccgaaagauaaagcuagguacaaauaugagaaaagacuauuuaaugacagaacugacgcugaauuuuaccaacaauaucccacuauguaccaucuaaggaauagauuauuaacggacccuucaaaagccgauguaagagagauuuauuuugccauacaucauauacuaaaaucuagaggccacuuuuugacaucggguuaugccaaagacuuuaauacuaacaaaguagcucuuaacgaaauauuucccgcacuacaagacgcauaugcacaaguauauccagaccuagacauaaccuuugaugaaaacaaaguuaaugaauuuaaaacgguucuuuuaaaugaaaaagccacuccaagugacacacaaagagcucuagucaaucuuuuacuugcagaagacggagacaaagauauucugaaacaacaaaaacaaguacuaacagaguucgcaaaagccgucgucggacucaaaacaaaauugaaugucgcacuagggaccgaaguggauaguucggaagcuaccgucuggaauuucagucuaggacaacuugaugauaaaugggcaggcauagaaucagcuaugacugaugaaggaacagaaauccuagaccaaauaagagaucuauauagagcaagauuacuaaauggaauagugcccgccgguaaaacauuaagccaagccaaaguagaugacuaugcccagcaccacgaagaccuagaauuauucaaagacuacuuaaaacaacuagaggaugauggaacagcuaaagcaauacgacaauuauacgaccguuauauugauggugacgacgcgaaaccauuuguucgagaagauuuugucaaagcacucacaaaagaaguaacagcacacccuaaugcgaaaaguccagaacuauuagaaagauuagcgcaaccggacuuuauguugaaacaaaggaacaaagcaaauggagcaauuccgguucaaaugcaacaacgagaacuagaccaaauaauuaagaaucagucaguguauuaugacuggcuggcagcaccgaacccaguagaaaaacaccgcaaaaguaugccauaccaacuagaugaacuacucaauuucaggauacccuacuacguaggcccauuaguuacagcaaaagaacaaaaagcggcacaaggagguguauuugcauggaugguuagaaaagauccugacgguaauauuacaccuuauaauuucgaugaaaaaguagauagagaagcaagugcuaauacauucauacagagaaugaaaacaacagacacuuauuuaauaggcgaagauguucugcccaaacaaucacuacuauaucaaagauacgaaguacuaaacgagcuaaacaauguaaggguaaauaaugaaaaauuaagcauagagcagaaacaacaaguaauacgagagcuauuugaaagacacaauuccgucacaauaaagcaauuugcugaaaaucuacgugcacauggagauuaugcacacauaccugaaauaagaggacuugcugacgagaaaagauucuuaucaucacucucuacuuaucgacaauuaaaaucacuacuaccagaugcgauagaugacccagcaaagcaagcagacauagaaaacauaauagcaugguccacuguauuugaagaugcggcaaucuucaaaaccaaacuaaaggaaauaaauugguuagauucgcaaaccauuacaaaauuaucaaauauaagauacagaggauggggccaauuuucccauaaauuccuaaacggacuaacauuaggaaauggacauacuaucauacaagaauuauuucuuucgaacaacaaucuuaugcaaauacugacagaugaaacacuacaaaagaaaaugacagaauuaaaugcagauaaacuaaaagcggcuaacauuaacgaugcaauugacgaugcauacacaucaccuuccaauaaaaaggcuuuacgccaaguacuuaggguuauagaagacauaaaacgugcggccgauggacaggacccgaguuggcucuaugucgaaacagcagacgguggcggcacaccuggcaaaagaacaagagcaagacaacaucaacugcaagaaauuuacgcaaacgcugcacaugaacugauagauuccgcagucagaggagaguuagaagauaaaauugcagacaaagccgauuucaaugauaggcuagugcuauacuuuaugcaagggggcagagauauauauacaggcacgccacuaaacauagaccaauuaucuucauaugacaucgaccacauucuaccccaauccuugauaaaagauaacucgcuugauaauagaguccuaguacacgcaauuauaaauagagagaaaaacgccaccuucgcauccacaauuuaugcacagaaaaugaacgccaccuggaggcaauggcaugaagcuggcuuaauuuccggaagaaaauuaagaaaucuacagaugagacccgaucaaauagauaaauacgcuucaggauucgucgccagacaauuaguagaaacucgccaaaucaucaaacuaacagaacaaauaguugcagcucaauacccagaaacaaaaauuauugcaguuaaagcaggcuuaucccaucaacuccgagaagaauuagaguuuccuaaaaaccgcgacguaaaucacuaucaccaugcauuugaugcuuuccuggcggcuagaauaggcaccuauuuauuaaagcguuuucccaaccuacaagccuucuuuacuuaugggaaauuuaagaaagcugacguuaagaaauuacgaggcuucaauuucauuagagauaucacacaugccgaggauaaaauaguaguaaaagauacgggagaaguaauaugggauaaaaagagagaugucgaugaauuagauagaauauacaauuuuaaaagaauguuaauuacacaugaaguacauuucgaaaaggcggacuuauuuaaacagacaguuuacggcgcgaaagacagcaaagaagcgggaggcaagaaacaacucauuucuaaaaagaaaggauauccgguugauauauacggaggcuacacgcaggaaacaggaucuuacuuaucaguagugagauuaacaaagaaagcuauguacgcagugguaaaaguaaguacacgagacgcagcuaaauuagccguagcaaaaucuauaagugaacaaaaagaaaaugagacacuaaacgauaucauagaugaaaaauuaucgaaaauaaguaaaaacggaaaaauuacacacgaauuauucgaaguagucuuaccccgugugggucagaaaacauuauuuaaaaacaguaaauacaaccuauucuuggugaacucugauacauauaugcauaauuaccaagaacucuggaugccaagagaauaccagaaaauguggaaagauaucuccuuaucaaaauauggugacgcgcaaacugaagaccaacuagaccaaauuuuuggauucauaguaucucaaguuaacuccuauuucaauuuauaugauauaaaucaauuccgaaagaaauuaaacgacgcugcggauaaauuugcaacacucccuaugagagacacugaugauaugcaaggcaaaauagcaacaauuggacaauuacuaauuggccuacaagcaaaugccgcaagaagcgauuuaagaaauuuagacauaaaaaccccuuuaggccuccuacaaauuccuaacgggauaucgcucgacucagacacaucaguugucuaucaaaguccaacugguuuauuagaaagagaaguacauuuaucagaccuauga

SEQ ID NO: 5555 - RNA, 4170 nt, Artificial Sequence
  Cas9 variant
auggcaagagacuauucagucgguuuagacauuggaacaagcucugucgguugggcagcaauagacaacaaauaccauuuaauucgagcaaaaagcaaaaaucuaauagguguacgccuuuuugacucagcugucaccgcugaaaaacgccgaggauauagaacuacaagaagacgacugucaagacggcacuggcgccuaagacucuugaacgacauuuuugccgguccauuaaccgacuucggcgacgaaaauuuucuugccagacuaaaguauagcugggugcauccucaagaccaaucaaaucaagcucacuuugcagcuggccuacucuuugacaguaaggaacaagauaaagauuucuaucgcaaauacccaacuauuuaccaucuacgauuagcgcuaaugaacgacgaccaaaaacacgauuuaagagaaguuuaucuugcaauacaucacuuaguaaaguauagaggacauuuccuaauagagggagauguaaaagcagauucagccuucgacguccauacuuuugcggacgccauucaaagauacgcugaauccaauaacucugaugaaaaucuuuugggaaaaauagacgaaaagaaacugucggcagcccuaaccgacaaacacggaucaaaaucacagcgugcagaaaccgcugaaacagcguucgauauucuugacuuacaaucuaaaaagcaaauacaagccauucuaaaaucgguuguugguaaccaagccaaucucauggcuauauuuggauuagauucuucugcgaucaguaaagacgaacagaaaaauuauaaauuuuccuuugaugacgcagauaucgacgagaaaauagcggacucagaagcauuacuaucagauacggaguucgaguuccuaugcgaucuaaaagcagcguuugaugguuugacauuaaaaauguuacuuggagacgauaaaacaguaucggccgcaaugguucgucgauucaaugaacaccaaaaagauugggaauacauaaaaucacacaucagaaacgcuaaaaaugcaggaaauggccuuuacgaaaagagcaagaaauuugauggaauaaaugcagcauacuuagcacuacaaucugauaacgaagaugaucgaaagaaagcaaagaaaaucuuucaagaugaaauaucauccgcagacauaccggaugauguaaaagcagacuuccuaaagaaaauagaugacgaucaauuuuugccaauacaaagaaccaaaaauaacggcacaauaccccaucaacuacacagaaacgaauuagaacaaauuauagaaaaacaagggauuuauuacccauuucuaaaagacaccuaccaagaaaacucacacgaauuaaacaaaaucacugcauuaauaaauuuccgcguuccauacuacgugggaccucuaguagaagaagaacagaaaauugcagacgauggcaaaaauauaccagauccaacaaaucacuggaugguacgaaaaucuaacgauaccauaacaccguggaauuugagucaaguaguagaucuugauaaaucuggaagaagguucaucgaaagauuaacaggaacagauacauacuuaauaggagaaccaacucuucccaaaaauaguuuacuauaccaaaaauuugauguucuacaagaacuaaacaacauacgagucuccggaagaagacuagacauaagagcaaaacaagaugcuuuugaacacuuguuuaaaguacagaaaaccguaucagcaacuaaccucaaagauuuccuggugcaagcaggauacaucagugaagauacacaaauagaaggacuagccgacgucaauggcaaaaacuucaauaaugcauugacuacauauaauuacuuaguaucuguauuagguagggaguucguugaaaacccaaguaacgaagaacuacuagaagaaauaacugaacuucaaacugucuuugaagacaagaaaguuuuacgucgacaacuugaccaacuagauggucuaagugaucauaauagagaaaaauugaguagaaaacacuacacagguugggggagaauuagcaagaaacuauuaacgacaaaaauuguacaaaaugcagacaaaauugauaaccaaacuuucgauguaccacgaaugaaucaaucaaucauagauacacuauauaauaccaaaaugaauuuaauggaaaucauaaacaacgcagaagacgauuuuggagucagagccuggauagacaaacaaaauacgacagacggagacgaacaagacguuuacagucuuauagaugaacuagcagguccuaaagaaauuaaaagagggauaguacaaucguuuagaauauuagaugauauaaccaaagcuguaggguacgcaccuaaacgcgucuacuuagaguucgcuagaaaaacacaagaaucccauuuaaccaacuccaggaaaaaucaacucuccacuuuacucaaaaaugcaggccucucagaauugguuacacaagucagccaauaugaugcagccgcacuucaaaaugacagauuauaucuauacuuucuacaacaagggaaagauauguacaguggggaaaaauuaaauuuagacaacuuaucuaacuacgauauagaucacauaauaccacaagccuauacaaaggacaacucacuugauaauagaguucuaguaagcaauauaaccaauagaagaaaauccgauuccuccaauuacuuaccagcucuuauagacaaaaugagaccauucuggucuguacuaucuaagcaaggucuucuauccaaacauaaauuugcaaauuuaacccgaacaagagacuucgacgacauggaaaaagaaagguuuauagcuagaucauuagucgaaacucggcaaaucauuaaaaacgucgcuuccuuaauagacucacacuucgguggagaaacuaaagcaguugcaauucggagcucauuaacagccgacaugagaagauauguagauauaccuaaaaaucgugacauaaaugacuaucaucacgcauucgacgcuuuauuauucagcacuguaggccaauacaccgaaaauuccggucuaaugaagaaaggacaacuaucagacucagcugggaaccaauauaaccguuauaucaaagaauggauucaugcagcucgccuuaaugcacaaucacagagaguaaaucccuucggcuucguagucggcaguaugagaaaugcugcaccaggaaaauuaaaucccgaaacuggcgaaauuacgccagaagaaaaugcugauuggucaauagcugaucuagauuaccuucacaaaguuaugaauuucaggaaaaucacaguuaccagacgcuugaaagaucaaaaaggacaacuauacgaugaaucccgauacccaucagucuuacacgacgcaaaaagcaaagccuccauuaacuuugauaaacauaaaccaguagaccuauacggcgguuuuucaucugcaaaaccugcauaugcugcucuaaucaaauuuaaaaacaaguucagacuuguaaauguauuacgacaauggacauacuccgauaaaaauuccgaagacuauauauuagaacaaauaagggguaaauaccccaaagcugaaaugguauugagccacaucccauacggacaauuaguaaagaaagauggagcucuagucacuauaucaucagcaaccgaacuccacaacuuugaacaguuauggcucccuuuagcagauuacaaauuaauaaauacccuacugaaaacuaaagaagauaacuuaguagauauucugcacaacagacucgaccuucccgaaaugaccauagaaucagcauuuuauaaagccuuugacucaaucuuauccuucgcauuuaacagguacgcuuuacaccaaaacgcccucgugaaacuacaagcccauagagaugacuucaacgcacuuaacuacgaagacaaacaacaaacauuagaaagaauacuagacgcauuacaugccagcccagcuagcucagauuugaagaaaauaaaucuaucaucaggauuuggacguuuauucucaccuucacauuucaccuuagcagacaccgacgaauuuauauuucaaucgguuacaggauuauucuccacacagaaaacaguagcccaacuauaccaagaaacaaaauga

SEQ ID NO: 5556 - RNA, 4170 nt, Artificial Sequence
  Cas9 variant
augaaaaacuauaacauaucucuagucccgucccccaguggugucggauacgcuguaacagacgacaaccuaaacauaauaaaaccaguucaccauguaucgggaaucggaagucguuuauucaaugaaggaucaaguaaacaagauagacgcaauuccagaucugccagaagauccagacauagacaacaaggacgaauaaaagcucugaacaguauaaugaaagacgaaaucauaaaaguagaccccacuuucuuugacaggcuuuaccaaagcgaacucagcccacuugacaaaaauaagaaauaucgaaauauaauauucgauaaaccuucagucgaaagcuauuauuacaagaaauucccaacaaucuaccaucuugaaaaauaccucauaaacacagacgggaaagcagauauaaggcuaauauacugggcacuucacucucuacucacucacagaggacauuuuuauaacacgacaccagucucgcaauuuaaaccuggagcauuaaacauuaaagacaaauucauugaacuaaaucaacuuaaccaaguaaaaacauucgaguucucagucgcaaacacacccgaaaucgaacacauacucaaagacagguauaucucaaaacaaaacaaaauaaaccaacucgcggaacuucuauuugaacaagaacccgaaaaagacauccaaaaagccaauacuaaagucgcaaaaaccauagccaaagcuauacuuggaaacaaauuucaauuagaugaaauuauuggacucgacguaaauaaauccgagaagaaagaauggagccugcaacuaucagaucuuaaccuagacucaaaaauagaugaacuuuccgauagucuaacagaucaacaauuaagaauacucgaaauacuacaagaaauguacgccgccacaacauugcuagacauucuacaaggaucagauagucuacuggaugcaaaaaucaaaagcuacaaugaauacaaacaaaauagauuauuauucuuugaucuucuaaaaacccuuccugauaagaaagcacaccucuuaagacaaggcuacacccuauaccuuaacaaucaccaucgcgacuuagcuucugcucgcaaagacuuagggauaguagcagcaacaaacuucuccaaaacagacuuauaugcacuuaucaagaaaacauugaaagacgaaccagaaacuccagaaagcaagaaagucuuagggcuaaucgauaaaggcgaauuucugaacaaacaacgaacagacuuaaacacuuacauuccuuaccaacuaaacgcauuaauacuaaauaaaauacugaaaaaccaaggcaaacacuauccauucuuaauaaaagaaaauccagcagaaccagauagaaaagaagcaccauaugaaauaucacaauuaaugcaauuuaccauuccauauuacugcgggccucuagcaacaccagaagaacagaaaaaccucccugaaucaagcagauucggguggcuagucaggaaagaagaaggcagaauuacaccguggaauuuuuacaauaaaaucaacgucauagaaacagcuaaugcauucauuaaacgcuccauaggaaaagacaccuacuuacuguccgaaccaguauuaccagacaauucauuacucuaccaaaaauacaaaguacuaaaugaacuaucuucgauuucuuuaguugacgcuaauaccaagaaagagaagaaacucacugcaaaaauaaaacaacuccuuuauaaagaaggguuuaagaaacacgugaccguaucaaaaacaauggcacuuaaaauauugaacgacaacaacgucccaacaucagauauacucggacuaucaacaggcaagaaauucgacaacucccuaagcacauacaacucauggaagaaagcauucccagagcaaaucgacaauccucauuaccgucaagaccuagaauauaugauagaauggucaaccgucuuuacagauagaaaaauucuaguugaaaaauuaaaagaaauagagugguugcguccagagcaaauuaaauucguuuuggaacauagauuaacgggauggggaaaacuaaguaaacgccuauuaguggaacucaaagauaauaaagguaaaucaaacauagacaauuuauucaacaccaagaaaaauuucaugcaaaucguuagccaacaaguauauaauacucaaauagaagcaaucgcgcuaaaaaccaccaaaaaccaaucccucgauaacaucuuagaagcugccuauacaagucccgccaauagaaaagcaauccgucaaacaaugaaaguaguaaacgaaaucguuacucuggcagguaaaggaacucacccugauaaaaucuuccuuacauuccaacgguccaaagagcaagaagguaaauugacuacagauagagccucaucgcuacuuaaaauauaccgaggaaucaaagacccacucuguacuaaagagcuaguggaugaacucuccaaaaauguaagagcaaaucuaauaaaaacuaaagaguacuuauauuaucagcaauuaggacgcgacgcauuaacuggggaaaucauagacaaaacagaccuuagaaauuaugcaguacuucacauaauuccccgaagcguaguaguagacgauucgauaaauaaccucguacuuacuaaagucaaaaaugcaaaagaaucaauagucguacaauacgguagcaaaaacaucuccgacauuaguaugucagucaaagacuuuuggaacagauuacagaaacuaggcuuauuuucaaaaggaaaacuaagaaaccuuacaacugacuuaacagaacuaaaucaauacgaaaaacaagguuuuauagcaagacaauugguagaaacuaaccaaauagugaaacuucuugcaacuauucuacaaggucaauucccacauaccaaaauaauugaaguccgucaagaacaaauagcaaacauaagauaucaacucgacauauaucgacuaagagaucugaauguauauuauaggggaauggacgcuuaucuagcagccguuguuggaacguaccuguacacuguauacccaaaagccagacgauucuuuguuuauggaaaauaccucaaacaggauaaaaacaaccgagaagaaggacaauucaaaacuuccggacauucauuuaauuuccuguggaaauuauuuuaugguggagaagacgaaauauacguacaaggcacuaauaacauagcauucaauaagaaagaucucuugcagaaaauaaaagaaguuaauaauuacaaauuucaaaauguauccuuagcaacagguacuagaagguccgauuuauuuaaacaaacgauauacccgcgacaagagcgcgacguaaagaaaucaagaacauuaauaaccaagaaaaauggacuauucacugacauuuaugguggauacacaggaaacgucaacucauauuucguucuuguacaaacaaaauauaagaaagacccagacaaauucaaccuuuauggcguuccaaauagguaugucgcaaugcuggaacaauccaaaucaaaagguaauuaugaaaccaaauuaaaagaagucauggaaccuauaauuaaaaauucgaacaagcgaaugauuggauauaaaauucuaaaggauagaauauuauacaaucaaauaauugaagacaaugguuacaaauucuuuauaaccuccucacaauacaggcauaacuucagacaaaugauacucagcgaccaaucuaagaaaauucuaauggauuaugucuuugacccaaauuucuauagacauaagaaaaccgaggacguaaauaaugacaaagacgcuaaacucauuaaagucuacgaugaaauauuauaccaaauagaucauuaccuucaaauauucacaaucggacaucauauagauaaauuaaagaaagcacgcccguuguuugaaaaauguacacuagccgaaaaagcacaaguauuaaacgauauauuaauaauugcuggcucuaaccaaaccgaauuagcacuaaaaccauuaaaaacaacuaaacuaacauucucgaaacaaaacuguccauugacaaaagacgcaaucuucuacuaccaaucuccuaccggaaugauaacaagaaaagaaaguaucaaagauauacucaaacaaaacauuuga

SEQ ID NO: 5557 - RNA, 4173 nt, Artificial Sequence
  Cas9 variant
augagucgcaaaaacauaguggaagacuacgcaauuucgcuugacauagguaacgcaucugugggauggguugcauuuacaccaaacuauagacuuguaagagcuaaaggucaugaauuaauuggagccagacuguucgagccagcgucaacggcggaggaaagacgaauggcucgaacaaccaggagacgauauucucguagaagauggagauuacgaauguuagauagcauguuugaucaagcucuaagugaaguagauccaucguuuuugaugagaagaaaauauaguuggguacauccagaagauaaaaauaacgaagcccauugguuuggcggaguauuauuugauaguaaugaacaagauaaaagauuuuacgagaaauauccaacuauauaccaucuacgaaaaaguuuaauggaagaugacgaaagacaugauaucagggaaguuuauuuagcaauucaucauaugaugaaauaucgaggaaauuuccuaacggaaggugaauuagcuccaucaaguguguucgauguugaggauuuccuaaaauuauuaacagaaauacuccaauaugcagaugaaggcgaaacagaugaagauuuagaauuacaagcagacgcuaauggacuaacagaagcccuuuguaccacaaaagguucaagaagcauacgagccaaaaaugcaauaucgauucuaaaagaaggggcagcauuaucgaaaagacaagaagcaauaauuucagcaguauuugcaggacuagaagggaacaaauuggaccuaacaaaaguauuuccaaacaaagaauauacacccgaagauaagaaaacucucgcacuauauuucaacaaagccgauuaugaugaaaaacgaguagcaauaggagauaguggauuauuagaagauaaugaaugugacuuucuugauuguaucagaagacaauacagugcaauagcacuuaaacaacuccugggagacuucacuucaaucagcgaaucuaugugugccagauacgaacaacaccaacgaaauugggauuuaauaaaacgauacuguagggaagaaaguaaugcagaaaauaucaauaaaaacuauggcgcacuugucgguugggaaaucgucgguggacaaagaagaucaauaagaggggcgaaagacuacgaaaacaagagaaaagcagcaaacaaauucuuugaagaacuuauaaaaggaagcgcguugccagaccaagaaaaagaaagauuauuacacgacauagaaaacgacgaacuauucccaguacaacgagacuccggcaaugggguaauuccauaccaacuccacuugaaugaacugaagaaaauaauccaaaaacaaggccguuauuaucccuuccuacuggaaacauacauaaaagacggaaaagaaguaaacaaauuagaaggacuauuggcauucagaguaccuuauuacguuggaccauuaguaucaagagaugauaugcagucuagugauaauagagaaaaucauuggaugaucagaagaaagaaaggaguaauaacacccuggaauuuugaugaaaugguugauaaagacaaaucaggacacgaguuuauaaaaucauuaguaggaaccgacagcuaccuuuuaggugaaacaacccucccuaaaaacagucuacucuaucaagaguucgaaguacugaacgaacucaauaacguuagacuaagcauucggacaggaaaccauugggcagauaaacgaagggugagauuaggacauaacgagaaaaaguuguuacucgaagaauuauucgcuaaacaagcuacagucacaaagaaagcugccgaaaaucuauuaagaagaaccuaugguaacacguaugagauaaguggcuuagcggaugaaaagaaauuuguuucaucccugaguucauauggcaaaaugugucgaacauuaaaagcaaguuaugucaacucacauaaagacguuguagagaaaauuauagaacuacaaacaguauuugaagacaagaaaacacucaaacaucagcuacaacuauuaggagaacuagcugaaaccaacugcgaacuacuaucaaacacacacuauacagguuggggaaaacucagcagaaaacuacuaaccucaaaaguaguugucugcaaaauaggaaaugacuucgccccagcaaaacacuccauaauagaaauaaugagagaaacagaccgaaacuucauggaaauaauaacggacaaagaccugggaguaggugaauggauaaaccaacaaaacguaggagccgaagauggcaauaguuaccaagacauaauagacgaucuuagagucaguccaaaagucaaaagagguaucaaucaagcaauaagagugauugacgauauaaguaaagcaguagguaaggaaccaucccgcauauuccuggaacuagcuggugacgugcaacaaagcgcaagaacuguaucuaggaaaagucgacuacaagguuuguauaaaucugcaggauuacaaaaagaguucagagauuuagcugaaagucuaaaugaguguucagauaacgaucuacgcgaugauagacuauuucuuuauuauacacaguuaggaaaggauauguacacuggggaaccacuaaaccuagauagacugaguagcgacuaugauauagaucauauaauaccacaggcugucacucaaaaugacucauuagacaacagaguuuugguagcucggguagcaaaugcaaggaaaacugauucguuucaauaucucccugagaucgccaauagaaugcguaauuuuuggcaagaguuguuagaugcaggucuuauaucacgaguaaaauuugauagacuuaacagacaaaacgauuucucaucacaugaaaaagaacgguucguucaaagaucuuuaguagaaacacgacaaauuaugaaaaauguugcaacaaucaugcgaaaaagauaugguaauagcgcagcuguaauagggcuuaauagugaauuaacuaaagaaaugaggcaauaccuaggauuuucgcacaaaaauagagacauuaacgauuaccaucacgcucaggaugcacuuugccucggaauagcaggccaauuugccgucaauagaggauucuuugcuaauggaaugguuucagauggagcgguuaauucauauaaucuauaccuacaggauuaucuuaggggauacagggagaaaaugagcgcaggagaacgaagaagaaacaaagcauuuggcuucauaguuggauccaugaacucacaagauagugacaaacggauaaauccaaaaacaggagaaauagcaugggacgacgaagauaaagucuaccuaaggaaaguuaugaacuaccgcaaaaugcucauaacacaaaaaguaggagauaguuuuggagcacucuacaaugaaacuagauacggaacaagcgcaaaagaaggaguaaacggaauaccauuugauaagcauaagcaagauacagcuuuguauggaggauucagcucagcaaaaacuguauauguagugcuuauugaagccaagaaaaagacuagguuagucaacauaaccaugcaagaauacgcagaacucggugaccauccaagcgacgacgcacuccgcgcuguacuugcgaaaaagaaacccgaauauggaaaggcaagaauacuauuaagacacauucccccaaugcaacuaauaagauacgguggagcauuaguaacaguuaaaagcgcaacagagcuuaacaacgcgcaacaauuauggcucccauacaaagaauacugucuguuugaugacgucauaucuucagcuauagauguagaugaagccagacuaugccaaauguuagauguaauucucgacgcaauccaaaaauacuacccaaaacagcguuucgaugagacuggauugucugcauuccacaaugcuuucaaugaaguaucagcagaagauaagaaaagaauuguaggagaaauggucggaaugcuucacgcagaugcuaaaaacgcaaaucuuaaagcauuaggcaugaguggacgauggggacgaauguccaaucagucaggcuacacuuuugcagacucugaugaguuuaucuuucaaagcccuucaggauuauucgaaaaacguaucucuguaggugaauugaagaaaagacgagcaagauga

SEQ ID NO: 5558 - RNA, 4173 nt, Artificial Sequence
  Cas9 variant
augaaggaaguuaaggauuacaucauaggauuagacauuggaacaaacucuuguggauaugugguaacggacaaacaaaauaauauacuaaaacuaaaagggaagacugcuauuggagcacgacuuuuuaaagaaggugaagcagcagcagaucgacgugcauucaggacuacaagaagacgccucgcgaggagacgauggaggcucggacucuuagaagaaauauuugacgaagaaauggcuaaaguagacuccucauuuuuuagaagacugaaagaaucagauuacucaccaaaagauucccguaaacaauucaacuccauaguuuuugaaagcagugaagcagauaaagacuucuacgauaaauauccaacuauauaucacuugagaaaugcgcuaaugcacgacgaccaaaaacaugauuuaagagaaauuuuucuugcaguucaccauauaguaaaauacagaggaaauuuccuacgcgaagacucuguaaaggccuuuaaagccgcuaaauuuacacuacaaggcgaagauggaauaggaccagucgacaaacuuaaugacuuacucaaagaaaucuauaucgaggcagcuccagaacuugcaacggauaaccuuucaaagauugaagaaauaauaaaagauaaaaaacucuacaagcaagacaaacuaaaacaaguugcaacuuuacuaacaaaagaagccgauacaaaagacaaagcaaagcuuaacaaagacguagcaaagcaagucgcaaaugcauucaugggauauaugauaauauuugauacaauauucaaccuuucggauguugacucaaaagauuauaaaguuaaauuuagcgaugcaaauauugacgagaaacuugauacauuaacuucucuacuuacagacaaacaaacagaauuuguccuagaauuacaaaauauauauaauacuauaguccuuaacgaaauugucccugacggcaaaagcuuauccgaaaguaugguuaagaaauaugacgaucacaaggaggaccuaaaguuauuuaaagcauaucuaaacucccuuacagacguaaaaaaaguaaaagagcuaaaagcagcauauguauuguacguuaauaacagaaaagcgaaccuacuagccgcaaaaaaacuacuuggaaaaaaagcugauaauaugaacaauuuugaaauuuucuccaaauuuguagcagauaaucuagaugacucagaacuagccaauaagauaagagcacgucuugacuuaggugaauuucuacccaaacaacgaacuaaccaaaaugggguaaucccauaccaauuacaccaaguugaacuaacacaaauacuugagaaacaaggcaaauacuacccauuuuuaaucgcaccuaacccagucgaaucacauagaaacaaugcacccuacagaauaagugaacuuguauccuuccguguaccauacuaugucggaccauuaauagacccuaauaaugcagaaucagaacaagacaaagcaaacucgagcuucgccuggaugguacgccaaaaacaaggacaaauaaccccuuggaauuucgaagaaaugguagacacaaccgaaucugcgaauaaauuuaucaaaaggaugacuacaaaagauacuuaccuccucggcgaagacguacuucccgcaucaagccucauauaucaaaaauucguaauacucaacgaauuaaacaauauaaagguuaauggaauaaaacucacuucugaagaaaaacaccagauauuugaugaacuuuuuaaaguacaaaaauccguaagucuaaaaaaccuuguaaacuuccuaacagcacacggcugcguagcgccaaaugucacuggcuuauccgacggaacaaaauuuaauucuucuuauucaacguauauagauuaccggaaaauauuuggcgccgagauugacaacaaagacaaacaagcggacuucgaaaaaaugauagaguggucaacaguauuugaagauagaaaaauuuucaaaagaaaacuugaagaaauuaccuggcucacaccagaucagauaaaacaagucucaaguaaaagauacagcggguggggaagacuaucuaaaaaacuacucacgcaaauaacagacgaaaaugguguaaauauccuacaaagacuauggaacgaaagugagaaccuuaugcaaauacuaagcgacccaguaauaaaagaaaaaauuguagcagccaauagcucuuuuacaaaggcaacggacauggaagauauauuagcugaagcuuacacaucuccacaaaauaagaaggcaauacggcaaguaaugcgggucguagacgacauaauagcagcagcccacgguaaaaaacccagccaaauagcaauugaauuugcgcgugaagaucaagacaacccucaaaugaccaaaagucgaaaagcacaauuagaccaaauauaugcaaaaauuagcgacgaauucuuagacaacgcuguaaaaaacgaacuaaaaaauaugaaagauaauaaaccuuuagcuaaagauaaaguuuuuuuauacuuuaaacaaaugggcagagacgcauacacaggagagaaacuaagccucgauaaucuucaagacuaugauauagaucacaucuauccccaauccuucauaaaggacgauuccuucgauaauagaguauuaguacagagagcaguaaacaacggaaaaagugauaauguuccaguccuacuuuucggaaacaaacaagcagcggaucuagguaugacuauaagacaaauguggaaaaaguggcuugaauuagggcuaauauccaagagaaaauucaauaaucuaaucacagacccugaaaaaauaaguuccuacauggcuagcggauucgugaaccgccaauuaguagaaacaucgcaagucauuaaacuaguagcgaacaucuuacaagcaaaacucccugacacagaaauaauagaaguaaaggcuucuuauaacagcauucuaagaaaagaauucaauuuauacaaaucuagagaagugaacgauuaccaccaugcaauugacgcguacuuaaccacuauaguaggcaacuaucuuuaccaaguauauccuaaauuacgacccuacuucguauauggacaguuuaaaaaauuuggaaaagcagaauccaaagaagacgauccagucaagaaaaucaaacaauucaauuuuauuuaccaacuucuaugggguaaagaugacgcgauauguauaucacauacugaucaacaaguuuuuagccguucugauauaaucaauaaauuaaccacagcauauaacuuuaaauacaugaaugucucacaagaaguuuacaccaauagcaauaacguauucaaacagacaguauucccaauaaucgaacgugacacagcuaaaucgagaucucuaauaccaaaaaaacucgaucgaccuacagacauauacggaggauauucaaacaacaacgacgcguaccucgcacuaguaaaaguagacaaaaaaaagggauccgaauacagagucgucggaauaccuaugagagcugcagcgauguuaaaagccucaaaaaauuaugacgaggaucuuagaaaaguaaucgagcccaugguaaugcuugauaaaaauggcaaagcgaaacgaggcauagaaggauuuagaguucucguaggaaaaaugcccuucaaacaagccgucuuagauggagauaagaaauuuauguuaacagguacaaacgacaugccaaaucuaaagcaacucguucuaucgcagcaaaauaugaaauacauauuagacuacauagaugauauagauugcagaaaacauaaauuuggaaacaaaacucaagacggaaauaaaugcuuacuagaaguauuugaugaaauaauacaaauuguagacaaacauuuugaauuauucgacaauagauccuucagagaaaaacuccgcaacucgagaguuaacuuuauaaaccucgcuuuaucuaagaaagcagaagcccuacuugccauucuaaacggacuacaugcuaauaguaugagaacaaccaucaaagaacugaaaauauccgaccuuggacggauccaaucauccgugaucucaccagaagcacaauuaauuuaucagucacccacaggccuuuucgaaaggagaguaaagguuaaagaccuauga

SEQ ID NO: 5559 - RNA, 4176 nt, Artificial Sequence
  Cas9 variant
auggaaaauaaacaauacuacauuggacucgacgugggaacaaauucuguuggaugggcaguuacagacacaaguuauaaccuuuuaagagcaaaaggaaaagauauguggggagcaagguuauucgaaaaagccaauacggcggcugaacgccggacaaaaagaacaagucgaagacgaucagaaagagaaaaagcaagaaaagcaaugcuuaaagaauuauuugcagacgaaauaaaucguguagauccaaguuucuucauacgacucgaagaaaguaaauucuuucuagaugaccgaucagaaaauaacaggcaaagauauacauuauuuaacgaugcaaccuucaccgacaaagacuacuaugaaaaauacaaaacgaucuuccaccucagaucagcauuaaucaauucagacgaaaaauucgauguaagauugguauucuuagcaauucuaaaccuauuuagccacaggggacacuuucuaaacgcaucucuaaaaggagacggagacauacaaggcauggacguauuuuauaaugacuuaguagaaagcugcgaauacuucgaaaucgaacuaccaagaauaacaaauauagauaacuucgagaaaauccuaucccaaaaaggcaaaucacgaacaaaaauacuagaagaacuaagugaagaacuaaguauaagcaagaaagauaaaucuaaauacaaccuaauaaaacuaauaaguggacucgaagcauccguuguagaacuauauaacauugaagacauacaagaugaaaauaagaaaaucaaaauaggauuucgcgaaucagacuacgaagaaaguucgcuuaaaguaaaagaaauuaucggggacgaguacuucgauuuagucgaaagagcaaaaaguguacaugauaugggauugcugucaaacaucauaggaaauucaaaauaccuaugcgaagcaagagucgaggcuuacgaaaaucaucacaaagauuugcugaaaauuaaagaacuauuaaagaaauaugacaagaaagcauacaacgauauguucagaaaaaugacagauaaaaacuacucggcauacgucgguucaguaaauucaaauauagcaaaagaaaggagaagcguugauaaaagaaaaauagaagaccuauauaaauacaucgaagacacagcacucaaaaacauaccagacgacaacaaagacaaaauugaaauacuagagaaaauaaaacuaggagaauuucuaaagaaacaguuaacggcgucaaacggaguaaucccaaaccaacuccagaguagagaacuaagagcaauccuaaagaaagcugaaaacuaucuaccauuucugaaagaaaaaggagagaaaaauuuaacuguuucugaaaugauaauccaacuauucgaauuucaaaucccauauuauguuggaccccuagacaaaaauccgaagaaagauaacaaagcaaauucaugggccaaaauuaaacagggagguagaauacugccauggaacuucgaagacaaagucgauguuaaaggcagucguaaagaguucauagagaaaauggucagaaaauguacauauauaucagacgaacacacucugccgaaacagucacucuuauaugaaaaauucaugguauugaacgaaauaaacaauauuaaaaucgacggagagaaaauaucaguagaagcuaaacagaaaauuuauaaugaccuauucgucaaaggcaagaaagucucucaaaaagauauaaagaaagaauuaauaaguuuaaacaucauggacaaagacaguguacuaucaggaacagacacagucugcaaugcauaccuaucgucuauagggaaauucacagguguauucaaagaagaaauaaacaaacaaagcauaguggacaugaucgaagauauaauauuccuaaaaaccgucuacggggacgaaaaacgauuuguaaaagaagaaauuguugaaaaauauggugaugaaauagacaaagauaaaauaaaacgaaucuuaggcuuuaaauuuucaaacuggggaaaucucucaaaaucauucuuagaauuagaaggagccgacgucgggaccggagaaguuagaagcauaauccaaaguuuaugggaaacaaacuuuaauuuaauggaacuccuaagcucaagguucaccuauauggacgaacucgaaaaacgagucaagaaacuagaaaaaccauuaucagaauggacaauugaagaccuugaugacauguacuuaaguucaccaguaaaaagaaugauauggcagucuaugaaaaucguugaugaaauacaaacaguaauaggcuacgccccaaaaaggauauuuguagaaaugacuagaucagaaggugaaaaaguaagaacaaaaucccggaaagacagacuaaaagaauuauacaacggaauaaaagaagacucaaagcaauggguaaaagaacucgacucaaaggacgaaagcuacuuuagaucgaaaaagauguauuuguauuaccuccaaaaaggacgaugcauguacagcggagaaguaauagaauuggauaaacuaauggaugacaaccucuacgacauagaccauauauauccucgaaguuucguaaaagacgauuccuuggacaaucuaguucuaguuaaaaaggaaauaaauaacaggaagcaaaaugauccaauuacuccgcaaauacaagcaucaugucaaggcuuuuggaaaauucuacaugaccaaggauucaugucuaacgaaaaauacaguagacuaacccgaaaaacccaagaguucagcgaugaagaaaaauuaucauucaucaaucggcaaauaguagaaacaggacaagcuacuaaauguauggcccaaauuuugcaaaagaguaugggagaagacguagaugucguauucaguaaagcaaggcucguaucagaguucagacauaaguucgagcuauuuaaaagcagguuaaucaacgauuuccaucacgcuaacgacgccuauuuaaauauuguaguaggcaacaguuauuuuguaaaguuuacaagaaauccagcaaauuucauaaaagaugcaagaaagaaccccgauaacccuguauauaaauaucacauggacagauucuuugaaagagauguuaaauccaaaagcgaaguugcguggauaggacaaagugaaggaaacuccggcacgauaguaauugucaagaaaacaauggcuaaaaacucgccauuaauaacaaagaaaguagaagaaggacauggaucaauaacuaaagaaacgauugugggagucaaggaaauuaaauuugguagaaauaagguugagaaggcagacaaaacucccaagaaaccaaacuuacaagcauacagacccauaaaaacaagcgacgagagacucuguaauauauugagauauggcggacgaacaagcauaucaaucagcggcuacuguuuaguagaauauguuaagaaaaggaaaacaauacgaucccucgaagcaauaccaguuuacuuaggaagaaaagauagucuaucagaagaaaaacuacuaaacuacuucagauauaaucuaaacgacggcggaaaagauaguguaagugauauaagauuaugccuaccauuuauaaguacaaacucccuggugaaaauagauggauaucuauauuacuuaggagguaaaaacgaugacagaauacaacuauacaacgcguaucaauuaaaaaugaagaaagaagaaguagaguauauccgaaaaauagaaaaagcaguaagcaugucaaaauuugaugaaaucgauagagagaaaaacccagugcucacagaagagaaaaauauagaacuauauaauaaaauacaagauaaauucgaaaauacuguauuuagcaaaaggaugagcuuagugaaauauaauaagaaagacuuaucauuuggagacuuucucaaaaacaagaaauccaaauucgaagaaaucgacuuagaaaaacaauguaaaguacuauauaacauaaucuuuaaccuauccaacuuaaaagaaguugacuugagugauaucggugguagcaaaaguacuggaaaauguagauguaagaaaaacauaacgaacuauaaagaguucaaacucauucaacaauccauaacaggauuauauuccugcgaaaaagaccuaaugacaauauga

SEQ ID NO: 5560 - RNA, 4176 nt, Artificial Sequence
  Cas9 variant
augaaagaaaucaaagacuacauuauuggucuagauauaggaaccaacuccugcggauauguaguaacugacaaacagaacaacauacuaaaauuaaaagguaaaacagcuaucggugcacgacuauuuaaagaaggagaagccgcggcagacagacgagcguuuagaacaacacgacgaagguuagcacgcagaagguggcgauuaucacuccuagaagaaauauucgaugaagaaaugaauaaaguugacccaucauuuuucaggcgauuaaaagaauccgacuacuccccgaaagaccgaagaaaacaauuuaauucaaucguauuugaaucaucagaagcagauaaagcauuuuaugaaaaauauccuaccauauaccaucugagaaaugcucuuaugcaugauaaucagaaacaugaccuuagagaaauauuccuugcuguacaccacauagucaaguaucgagguaacuuccuucgugaagauucaguaaaagcauucaaagcagcuaaauucacucuacaaggugaagauggaauaggucccguugauaaauugaacgaccuccuaaaagaaaucuacaucgaagcugccccagaacuagccacagacaaucuaucuaaaauagaagacauaaucaaagacaagaaacuuuauaaacaagacaaacuaaaacaaauagcaaaucuucucccaaaagcuguagauuccaaagacaaagcaaaacuuaacaaagauauagcaaaacaaguagcaaaugcccuaaugggauauauguuuagguuagacacuuuauuuucauuuacagacguagauguuaaagauuacaaauuaaaauucuccgacgcaaacauagacgaaagccuagacgcacuuacaucucuauuaacagaugcccaaauagaguucguccucgaacuacaaaguauauauaauacaauuguuuuaaacgaaauaguccccgacgguaugucucucucagaaucuauggucaagaaauaugaugaucauaagaaagauuuaaaacuauauaaagaauacaucgacuccuuaucagaucagaagaaagcgaaacaauuagaagcagcguaugcucuauacguaaauuaccguaaagcagaucuacuagcugcuaagaaacuauuugagaaaaagaaaauaggagacaagaaauucguagacgugauauccaauuuugaagucuucgggaaauuuguaagcgacaauuuagaugacucagaauuagcaaauaaaaucaaagcuagacuugaccucggcgaauuucuccccaaacaacgcacgaaccaaaacggaguuauaccauaucaacuccaucaaguagaacuaacgcagauccuagaaaaacaagggaaauacuauccauucuuaauaacacccaacccaguagaaucacaucguaauaacgcuccuuaugaaaucucugaauugguauccuucagaguaccauacuacguaggcccacuaaucgauaaucaauccauaaaagauaaacagaauaaaaacaaauucgcauggaugguacgccaaaaacaaggucaaauuacgccauggaauuucgaagaaaugguggacacgacugaaucugcaaaucaguucaucaaacguaugaccagaaaagacacguaccuucuugcagaagacguucuccccaaaucaucccuaauauaccaaaaauucaugaucuuagacgaacucaaccgaauuaaaauagacggcaagaaauuaaccuccaaacuaaaacacgauauuuucgaaaaauuguucaagaaacagaaaaguauaaaucuagacaaucucaaaaauuaccuacuagcagaaggaaacauacccggccucauagaaggacuuucugacgguauaaacuucaauaauucauuuuccacauacauagacuaccgaaacauauuuggagaugaaauugauaauccaaacaaacaagcagacuucgagaaaaugauagaauggagcacagucuucgaagaccgaaaaauauucaaaagaaaacugaaagaaauaacauggcuuaccccugaacaaauaaaacaaguuucaaguaaaagguacuccggaugggggcgacuaagcaagaaauuacuuacacaaaucaccgaugaaaacggaguaaacauauuacaacgacuauggaaugaaccagaaacuuuaacagaaguccucgcuaauccaguaauuaaacgcaaaauaagcgaagcaaauucauuauucguacaaaucaacaaaguagaaaacauauuagacgacgccuauacuucuccacaaaacaagaaagccauuagacaaguaauccguguuguagaugauauuauagcagcggcacauggcaagaaaccaagucaaauagcuauagaguucgccagaaguucacaaaacaaagcaaaagucccugacacaagaaagaaacaacuagauaaaauauacaauaaaaucucuucggaaauauuagacucuucuaucaaaaaugaacucaaaaauuuaaaaucaaauaaauaucuaagcaaagauaaauuauuucuuuacuucaagcaaaugggacgagaugcauacaccggagauaaauuaucacuagaccaauugcaaaauuacgacaucgaccauauauuuccuagaucguucaucaaagacgacucauuagacaauaggguacuaacucaaaaaccaauaaacgcuaaaaaguccgauuacggaauaccagcacuagaauuuggcaacaaauauguuccagaucuaggcaucaccgucaaagaaauguggaaauuauggcaggaaaacggauuaauaucuaaaagcaaauuaaucaaccuauguaccaaccccaaaaagauaggcuccaaaagagccagcggauucaucaacagacagcuaguagaaacuucccaagucauaaagcuaguugcgauaauacuccaagccgaguucccagacacagaaauaauugaggugaaagcccuacagaauacaacauuacgagaaucauuucaucuauacaagaacagaucugucaacgacuaccaccaugcaauugaugcauacuuaacaacuauuguugguaacuaccuuuaucaaguauacccaaaacuaagaccuuacuucguuuacggccaauucaagaaauuuaaccaagagaaaaauauagauauccugaaaagacucaaaaacuuuaacuuccuacgacaauuaaucuucaauacagaugauaauauauacaucuccggaacgaaagaaauaguuuucaacaagaaagacaucauccauaaauuggaaacagcuuauggcuacaaguacaugaauauuucaagggaauguuaucaagaaacuucgucucuauucaaucagacacuauaugcacacaacucaaguguaaagaacucucuaauacccaaaaagaaaggcuuacccacagaaauauacgguggcuauucagggaacaaagauucauucuuuguccuaguaaaaaucguaaagaaacgaaccaacuuauauagaauaguaggcaucccaacucgcgaauuggcaaaauuaaacagcuccaauaacuacaaucaagcacuaaauaaaauuguugaaucaaaacuaugucuaaaagaaacugagagcuuuaaaauccuaauaaaacgccuccucuauggaacacucauugucgacaacggacagaaauuucgcauaggaucuuuuaaagaaaaacacaacguacaacaacuuguauuacaacucaaaucaaugaaauacaucaaauuuuauaucgacggcggacaaaacuacuucacagauguagaaagaaagaaauuagagaaacaagacagagacaaguguuuauuauacgucuucgacgacauuaugaaugugguuaauaaacgcuucacacuauucgacaugucaaaauaugagaaagauggugauucacugagagaaaaauucaacugucuagauuuuaacgacaaagucuccauuuuaucggauuuauuaaaagcauuccaugccaauagcgacagaacauccauaacaaaacuuaagaucacaaaucuaggaagacaccaggccggcaaaaauggaauaacacuaacaacaaacgcacaaauaauuuaucaguccccaacaggacuauucgagagacgcaucaaaauaaaagaucuauga

SEQ ID NO: 5561 - RNA, 4176 nt, Artificial Sequence
  Cas9 variant
augaaaaaaaucuuagggcuagacuuagguacaaauaguauaggaugggcauuagucaaugaagcagaacaugaacaugaacaaucaucaauaguuaagcuagggguaagaguaaacccacucuccgucgaugaaaaaacgaacuucgaaaaaggaagaccacuaucaauaaaugccgaucgcaccucuaagagaagcgcacggagaaacuuacaaagauucaaacucagacgcaaaaacuuaauaaaucuccuguuaaaacaccacaucauaaguaaugaaaccauccuaacagaaguagggaaaaauacgacucaccaaacucucaaacuacgaucaaaagcuacgcaagaaaaaauaucgcuagaagaauucgcgagaauacuauuaucaauaaacaaaaaaagaggauacaaaaguucuagaaaggagaaaaacgaagaugaaggauucaccauugauggaauggcgaucgcaaaagagcuauacgauaaccaacuuacuccaggacaauacguauauaacauacuccaagacggaaaaaauuauauacccgacuuuuauagaagcgaccuacaagcugaauucgacgacguuuggcaauuccagaaaaaauuuuacuccuccauucuaaccgaugaauucuaccugaaauuaaaaggucaggguaaagaaaauaccaggaaacuauuccuugcaauacaucaaguauacacggcagagaauaaaggaaaacgugacgcagucaaacuacaauauuacaaauggagaucagaagcaguaaaaaaacaacuauccaucgaagaaguagcuuacgucuuggucgaaauuaauaacaauauaaauaaaucauccgguuaccuaggcgcaauaagugaucgaaguaaggcacucuauuuuaauaacgagacgguaggagaauaccucuacggucaauuaguuaaaaauagacauaacucguuaagaaaucaaguuuuuuaucgacaagacuacuuagacgaauuugaaaagauaugggaaacccaagcaaaauuuuaugaugaauuaacaaacgaacuuaaacaggaaauucgagacguaguuauauucuaucaaagaaaacuaaaaucacaaaaacacuuaauaagugacuguuuauucgagaaacaccauaaagcaauccccaaauccucgccacuauuucaagaauucaaaauauggcaaaaucucaauuacuuagaauucgugcauacucaaucaaaagaaaaaauauucuucuccgaacuagacgaugaaacucgacaauuugucuucgccgaacuaaacauucgagggacacuaaaaauuaaagaaauaaaaaaauuaaucggauuagaaacaccaguauauuggaagaguaacuucgacgaaauagaaggaaauagaacaaaucaaguucuguacaauguauaucaaaacauagcagaugacuuaggauauggauucgacuggucaaagaaacaugcguuugaaaucaaugccgaguuacaagcaauauuuaaagacguagguauagacacagcaauauuaaacuucgaugcuucaauagaagaaaaugauuuugacaaacaaaaaucauaucaacucuggcauuuacuauacucagcagaagauacagauaaagcuacagaagaagacaaacuuauauacggaaacauaaacacaaaacugaaaaagcaauuacaucagaaauacggcuucgaggcuaaauacggcaacuugcuggcaaauaucucacuacaacaagacuaugguaaccuuucagcaaaagcuauaaaaaaaauccuaccguauuuagaaucuggaaacucauuuuaugaagcgugcacaaucguuggauauaauccaucgaauagccugacuaaagagcaacaacaaaauagaaaacucaaagacaaacuagaauuauuaccaaaaaacucucuacgaaacccagucguagaaaaaauacugaaccaaaaaguaaaccuaaucaaccaacuaauugaugaauacggaaaaccagacgaaguacguauagaauuagcacgugaacuaaaaaaaagcgcaaaacagagagccgaccuaucgaaacacaucaacgacgccacacucaagaaccagaauauacgcaagacacugcaaaaagacuucggaauacaaaacccaucaaaaaacgauguuauaagauauaaacuauacgaugaacuuaaagauaacggauauaaaacccuauuuacaaacaaauacauaccaaaagaacaacuauuuucuaaagacguugauauagaacacauaauaccaaaggcaauacuauuugacgauucauuuucaaauaaaacauuagcauaucgaaacguuaaucucgccaaagcagacgcaaccgcauuugauuucauaucgagcaagcaucuagacgaccuagacaacuauaaggcacgcguagaaacauuauuccagucaaagagaauaagcaaaggaaaauacaaaaaacucuuaaugacacgccaaaauuuaccagaagacuuuauagaacgggaucuccgcaacucacaauacaucgcaaagaaggcaacugcaaugcuaaaagaaguauuucgaucaguuguaccuacaucaggaagaauaacagacaaacuaagggaagacugggaccuagucaauguaaugaaagaguuaaaucuuccgaaauaccgaacacuuggauuaacagaauucauagaacgaaagaaugguaacaaaauugaacaaaucaucgacuggacgaaacgaaaugaucauagacaccaugcuauggacgcguuaacaguagcguuuaccacacauaaucauauacaauaccugaacaaccuaaauguaacccacggccuaaacggaguagacaccgaucacgaaaaaagcagacuauacgcaaucaaacaagccaucacuaagguauauaucguaggaaaaaccaaaaaaagaaaguucauaccacccauggaaaauuuccggagccacgccaaaaaucaucuagaaggaaucuuaaucucuuucaaaaacaaaaauaaagucguaaccaagaacaaaaacagaaccaaaaccaaaaccaaaggaguguucaacgaaaaaauacaacugacaccacgcggacaauugcacaaagaaaccaucuacggucaugcaaaaaagguuauaguaacaaaagaaaaaguauccucaaaauucacccacgaaaaaauauuacaagucacgaaaccugccuaucgagaagcgcuacuaaaacgacuagcaucauucaaaaacgacccuaaaaaagcuuucagcggaaaaaaugcgcuaaguaagaacccgcuauacuucgauaucacaaguggaaaaaaagucccagacacggugaaauugucauauuucgaaaacucauacguaauaagaaaggaaguaaacagcgacaauuuuaaaaaugaaaagucauuacaaaagguauuagacguaggaaucagaagaauccuggaaaaacgcuuagcugacuauaacggaaacgcuaaagaagccuuuucaaacuuggagaaaaaucccaucuggaaagacaaagaaaaaggaguauguauaaaaaagguaagaauagaagcuuuaaaaaacgccgaaccacuacaugucaaaaaagaucauuuaggcaaaauuauuuuagaugaugagaacaaaucuacaccaguggacuucauauccacaggaaauaaccaccauguugcaaucuaugaagacaaagacggaaaacuacacgauaagguaguuaguuucuacgaaguaguuucaagaguuaaucuuggucuaccuaucaucgauaaauccuucaacucacaccucgauuggaaauuucuuuuuucaaugaaacaaaacgaaauguucguauucccaagcgaagacuuuaacccaaaagaaaucgauauaggaaaucccaaaaauaaugaacucauuuccaaauacuuauuuagaguacaaaaguuuagcaaaguaacauauggaaauagugcagucagagacuauguguuuagacaccauuuagaaaccgaacuaauagauaaaaaggaauuaaaaggcauaacauacuaccaacuaaaaucaauagguaugcuagaaaaacuagucaagguccgcauaaaucauaucggcaagauaguccacauaggugaauacuga

SEQ ID NO: 5562 - RNA, 4176 nt, Artificial Sequence
  Cas9 variant
augaaaacgauauuaggucuggacuuaggaacgaauagcaucggaugggcucuagucaaagaagcagaaaacgaaaaugaaguauccgauauaauaaagcucggaguacguguuaaccccuuaacagucgacgaauuaacaaauuucgaaggagggaaagcauauagcaacaaugcagaaagaacauuaaaacgcggcgcgagacgaaaccuacaacgauacaaauuaagaagagaaaaccuaaucgaaauuuuauuaaagaauggucuaauaaacaaagauacagcauuaacagaaguaggaaaagaaacaacgcaucaaacacucaaacucaggagcaaauccgcuaacgaaaaaguuucacuagaggaucucgcaaaaaucuuacuaagcauaaacaaaaagcggggguauaaaucaucgagaaagguuaacgcggaagacgacggaguagcaauugacggaauggaagucgccaaacuacuguacgacgaaaacaugacacccggagaauacguuuugaggcuacuggaaaguggaaagaaacauuuaccagacuucuacagaagugaucuacaagaagaguucaaccuaguuuggaagaaacaaagugaguucuauccccuaauauuaacaaaagaacucuucuuugaacuacacgggaaaaauaaaagucaaacaugggcaauaugcaaagaaccacuuggcauagucggagugaaauuaaaaggcucggcaaaagaacaaaaauuugcgcgauacaggcuacgaaaagaagcucuaacacagcaaauagaacuggaacaccuagcaauaguauuacaggacauaaacaaugauucuaauaaaaguuccggcuacuuaggggcgauaagugaucgcagcaaagaauuauuuuucaauaaagaaacuguaggacaauaccaauacaaacaacuacaaaaagauccaaacacaagccuuaaaaaccaagucuucuaucgccaagacuaccuagaugaauuugaaguuauuuggcgaaaucaagcaaaauucuacccacaacuaacaaacgaacuaaaacaagaaauccgagacguaguaauauuuuaccaaagaaaacuaaaaucacagaaaaaucuaaucagcuucugucaauucgaaucaacccaacaaaauuacguggaaaaagaaacaggaaaaacaaaaauacgaacaauaggcagaagaguaauuccuagguccucacccuuauuucaagaauuuaaaauuuggcaaaguuugaacaaucugaaauucguaaauucagaaucuaaccaaauaauacaauucaucgaauuagaagaugauguuaagaaaguaguauucgaugaacuaaauuuaagaggcgaucuaaaacccaaccaaguccucaaaaucuuauccaaauacaugaaaauaggaaaacuaacacaauggaaaugcaacuuagaagaaauagagggcaauaggacaaauagugcacucuauaaugucuuucaaaugauagcagaagaagaaggcuacggauuuaauugggguaagaaaagcgcucuugaaauaaaaucggaauuaaaggcaauauucaguaguauaggcauaaaugauucaauacuugauuucgauuuuucuaagaaacuugaucaacaacucaguuaccaauuauggcauuuacucuacagcgcagaagagggaaauucuaaaauuaccgaagaagacaaauuuacauauggaaacacaggggucgcauuaaagaagaaacuacaucuuaaauuuggauucaaaccagaauacaguacauuaauaucgaacuuaagauuuacuucagacuauggaaauuuaaguagcaaagcaauaucaaaaauuuuaccauuccuuagagaugguucagauuauucaaaagccugucaauaugcaggcuacaaccacucgaacucucuaucugccgacgaacuggauaauagggaacuuaaaccaaaauuagagcuucucaagaaaaauucacuaagaaauccgguaguagagaaaauccuaaaccaaaugguaaauguuguaaaccaaguaauagacaauuacggaaaaccagacgaaguucggauagaacuagcuagggaacuaaagaaaagcgcuaaagaaagaucacaaaugacgaaaaauauaucggacgcuacacgacgaaacgccgaaaucaagaaauauuugucaaaagaauuugggauaccuaacccaacaaaaggagacguaaucagauacagauuaugggaagaauuagcaucaaacggguacaaagauuuauuccgcgauaaauauauccccaaagaaaaacucuuuuccaacgaaauagauauagaacacauaauaccuaaagcacuacuauuugaugacagcuucaguaauaaaacacuagcauucaaaguugauaaccuuaagaaagcagaccgaaccgcauuugacuucaugucaacugauuuuucaaaagauguugacagcuauaucgguagaauagaaacauuacacaaagacggaaaaauaagcucaucaaaauacaagaaauuaaugauccccaaaagcaaauuaguagauggguuuauagaaagagaccugagaaauacacaauacauagcuaaacaagcccguaaaauguuauuggaaguuuuuaaaacugucguuccaaccacagggaaaaucacugacaaacuaagagaagacugggaccuaaucaauguuaugaaagaacugaacuuccccaaauauaaagcauuaggacucacuaagaaaauagaaagauuugacguugggucagaaaagaucaaaucaauaaacguuauagagggauggagcaagagaaaugaucacagacaucacgccauggaugcauuagcaguagcuuucacaacacauaaccacauccaauaucuaaauuacuuaaacgcacgcaaagauauucaccacgaaaugcacggaacuauaaaaucaauagaaaaucaaaucaucgguaaagacgucauggguaaaagacguuucauuccuccaauaagcgaucuaagaaugaaagcaaaauuacagauagaaaguauuuugauaucguuuaaaaacaaaaauaaaguaguaacgugguccgucaacaaaacaaaauuaaaagguaaagauaacuacaacaaacgaagacagcuaacaccacgagggcaacuacauaaagaaacaguguauggcaaaauaaagcugaucgaucccaaaccauuaaaacuaaacaauaaauucacuuuaguuagagccagcaugauaguggacaaaguccacagagagauaguacuucaacacuuauccaaauacgauaauaacagcgagguugccuuugauucaaagaccaucaaaauagacccaauccugauagaaggaauuggacuaaaagaaguagugugcuacgaagacgucuuuaaaauaagaaagaaaauaaguggugauaauuucaaaaacgaaaaacaccuagaaaaaguaauagacgaaaaaguaaaacaaauauuaaaagaccgggucauaaaguuucagggcaauuuuaaggaagccuuuucaaaucuagaagaaaaucccaucugguuaaauaagaguaaagggaucgcaguuaaaaguguagcuauaaaggggguaaauaaugcagaaagccuacacgaggggaaggaucauuucggcgaccaaauacuugacaaaaacaagaaacaaauaccuguagacuuuguauccacuggaaacaaccaucaugucggaauauaugaggacaaagacggcaaucugcaagaacgcguugugagcuucuucgaggcaguaacaagagucaacgaaggccuacccauaauagacaaaacguauaacucugacauaggauggaaauuuaaauucacaaugaaacaaaaugaaauguucguauucccuucagaugauuuugacccuaaugaauuugaccuaacagacgguaaaaaugcagcaaaaaucucacccaaccuauaccgaguacagaaaauagcaaccaaaaacuauauguucagacaccaccuagaaacuguagucacaaacgaccuugaguucacauacaaauccauccgaucuacuggaugguuaagaaaucuaguuaaaguaagaauaaaccauuuaggcgaaauuguauauguaggugaauacuga

SEQ ID NO: 5563 - RNA, 4176 nt, Artificial Sequence
  Cas9 variant
augaaaaaaauacuaggacuagaccuagggacgaccucaauagguugggcccucguaaaugaaaaagaaaacaacgaagaacuaaguucuauaauucgacuaggaguacgggugaacccacucacuguugaugaaaaaagcaacuuugaaaaaggcaaagacauuacaacuaaugcagauagaacgaaauguagaucagcuagacgaaacuuacaacgauuuaaacuacgaagggaagcacuagccgacugucuaaaacgacacggucuaaugacugacgaaacccccuugugcgaaacgaauaacucaaucauauuuaagaccuauaguaacagagcaaaagcagucugugaaaaaauagcuuuagacgacuucgugagaguccucuucaugaucaauaaaaaaagaggauacaaaaguagucgaaaauuaaacacagaugacgaagguacauuaguagaugguauggacguugcaaaauuauuauacaacgaacaaauuacaccaggugaauaucuacuacgacucuucaaaaaaggaaaaaaaaccaggccagacuuuuauuuaagugaccuaaaagccgaacuagaaagaauaugggacuuccaaagaacguucuauccagaaauauuaugcaaugcacuaaaagaagaccucaaagggaaaucacgaacccaauccucagcaauuuucuaugcaaaauacaagguuagcacggcuaaaaucgcagguaaagacaaaagacuacaagagcuaacguggagaacagacgcgcuacgaaagcaacuaaccauagacgaagucgcauaugucauaugcaguauaaauggcgaaguuaauggcaguucucaaaggcuuucaaugauuucagaucggaguaaacuacuauacuuuaaccaccaaacaauaggacaauaucuaaugcaacgauuagaagaaaaucccaacgcaggcuuaaaaaacauuauauuuuaccgacaagacuaugaagaugaauucaacgauauuuggaacagccaagcgaccuaucauaaagaacuaacgccagaguuaaaaaaagaaguaaaagacauaauauucuaccaaagaggccuuaaaaguugcaaauggcugauaaauuauugugaacuagaacaugaagaaauagaaguuaaaacaccugaaggcaaacugagaaaaauaacaauagguagcaaaacauguccuaaaagcucaccucuauuccaagaauuuaaaauauggcagguuuuaaauaauuuacaaguuaguccacucaauucacgaagaaaagcaaaaagaaaaaaagacgaagaacccagccuauucucagacgaggauaugaacacagcauguagguacuuaaacgaagaggaaaaacugacgcuauuuaaagaacuaucaauaaaaaaggagcuaaagaaaaaagacgcauuaaaacuauuguuugaaaacuauaaagaauuagaucuaaauuauaaaguuauaaguggaaacguuacuauggcaaacuuauacagagccuuucaagacauuauaucuuuaacaggcaacggagaauuugacuuccaagcaaugccagcggaagaagcugaaaaaacaguagaggaaauauucgggggucuaggauauaaaacagcuuuuuugcacuuugaugccagcuuacaugacaaagaauuugaacggcaaccggcauaccgacuguggcaccuccucuauucuuacgcuggagaccaaucaaaaacgggaauagaagcauuaguaaaacgcauacaagaauuauguggauuugaaccagaauacgcuagaauucucgcaaacaucuccuuuauaccagacuacggcaaccuuaguucuaaggccaugcguaaaauccuacccuacaugcaagacggauacgaguauucugaagcaugcagcaaagcuggguacaggcauucagcaaguagccugacaaaagaagaaauuaacaaaaaaaauuauaaaacucauuuagaugagauuaagagaaacagcuuaagaaacccuauugucgaaaagauacuuaaccaaauggucaauguaguaaacuccguaauagauacuuauucaaacaucgaugaaaucagaauagaaauggcacgcgaguuaaaaaaaucaaagccagaaagggaagacaugagcuucgcuauaucgaaagccacaaaagagacagaaaggaucaaaggaauacuagaacaagaguuuaagauacaacauguaacuagaaacgacauaauucguuaccgauuauaugaagaacuaaaacccaauggcuacaaaacacuauacucaaauacauacaucccaagagaagaccucuucucuaaaaaauucgauauagaacacauuauaccaaaagcaagauuauuugacgacagcuacuccaacaaaacauuagaacuacgagacauaaauauagaaaaagguaaucaaacugccuacgauuuuguucucaguaaauacggagaagaaggacuguacaaauaugaacaacgcguagaagaauuuaaaaagaauaacgaacaagcuggcacaaaauguagaaaauuacugaugagagaagccgauauaccuucagauuuucucaauagggauuuaaaugauucacaguauaucgcaaaaaaagcacaugaauuauuaagagaaauuguuccuaccguaacugcgacaacaggaagcauaacaaauagacuaagggaagacuggaaacucguuaaugucaugaaagaguuaaacugggaaaaauacgauaaauuaggccuuacugaagaguauaaagacaaagauggaaacaccguaagacauauaaaagauuggacaaaaagaaacgaccaucgacaccaugcaauggacgcccugacaauagccuuuaccaaaccuucauucauucaauacuuaaauaaucucaaugccagaaguaacagagguggcucaauauauggaauugaacaaaaagaacuugaaagagaaaauaacaaauugguauucaucccaccgauagauccaaaaauauuccgaaagcaagcgaaagaacauuuaucgaacauauuaauaucaauuaaagcuaaaaacaagguaguaacuaaaaacguuaacaagacuaaaaguaaaucuggaacaaauagaaagguacaguuaacaccccgcggccaauuacaucuagagaccguuuacggcaaaauuagaacuuacaaaacugaggaaauuaagguuggaacuaaacuaacagaagagcuaauugcaaaagucgccgauaaaaagauuagagaagcccugaugcaacgccuaucagaauacggaggcaacauaaaaaaagcauuucaaaauauaucaaaacauccaauaugguuaaauggaucccauaccaaacauguaccagaaaaaguaaagauaguuuuuuucgaggacguauucacaauaagaaaagcaauaacaccagacauaaaaauagauaaaguuauagacagcaaaaucagacgcauauuacaagaacgacucaacgaauuugggggggaagcuucaaaggccuuuucaaaucuagacgaaaaucccauaugguucaaccgagacaagggaauagcuauuaagucuguaaaaauaagaggaauagcuaaaggcacagcaauaagggugaagaaagauauccacggaaaaaccauuaucggcaacaacggauauccaguugcuaaugauuauguaaacaccggcaacaaucaccaugucgccaucuuuagggauaaagauggaaauuugcaagagcacauuguaaguuuuuacgaagcaacagccagagcgauucaaaaccucccaauaguagaccgaaauuacaauagcgaaaaagauuggaaauuccuauucucaaugaaacaaaacgaauacuuuguauuuccaaauccaaacacaggauuuaacccaucugaaaucaguuuaaaagacgaaaaaaacuacgcauuaaucagucccaaucuuuucagaguccaaaagcugagucacuacuauuacguauuuagacaucaccuagaaacaaacguggacacgaaccuacaauuaaaagauauaaccuggaagagaauaacagcaguaaauaaccuaacaggcgcaguuaaaguacggauagaccaccuaggacgaauuguugaugugggagaauacaaguga

SEQ ID NO: 5564 - RNA, 4176 nt, Artificial Sequence
  Cas9 variant
augaagaacuaccauaucggauuagauauaggaaccagcucaguaggauuugcugcuagagaugaugauaauaaccuaaucagaguaaaagguaaaaacguaauaggagcacgacucuuuucugaaggacaaaccgcacaagaacguagaauggcacgaacgucuaggagacgauauaacagaagaaaauggcgauuacgauuauuagaugagauauuucacgacgaaauaauccacaaagacgcagaguucuucaaucgcuuaaagcaauccuuccucucaccaaaagacgaaagaaaacaauacuucggcagccugcuuuucccagagacuggugacucagaauauuaucauaaugguaaccaaacaauauaccaucugcgacauagacuuauaacucaagaugaaaaagcagauauaagagaaaucuacuuagcccucagacacauaauaaaguacagaggcaacuuccucgaugacacuccaguuagcagcuucgaagcaucagaucuaaaacuagccaguuucguacccacaauaaacgaucuauucgaaaccauugacguuaacuaugaauuuucaauggauaacaucaaugaaauagaagacauuuuauuaaacaauaaacuucgaaacucagacaagucaaagcaacucaccgaccuccuaacugaaccaauugugaauauagaugacaaaagucuugaaaaacaauuuaauaaagagagaacagauauauccaaggaaaucgcuaaguccgugguaggguccaagaugaacguuaauaaacuacuuaguuuugaaagcuccgaaggaucaaaaauagcuuucaguuuuucggaugcauccucagaggacaaaaugauggaacuaucagauauccucgacgauagccgcaugaauauauuaaacauccuuaaaguaaucuacucaagaguccgccugaaccaaauaauaccaaguggaaugggacuaucggaaucaaugguagcagcguacgacucucauaaacaacaauuaaaagaccuuaagacacuacuuaacguucuaccuuucaaugaacgcuacgcaguaaaaaucgccuacgccgcuuacauaggaaauaucgacaaacaaaaauucacuaaaagcgaaauuaaggcaaucgacaaauugaaagagaaaagcgcaauaaugaacguacuagacuuuaaauccggccauauaacuaacgaagaacuaucaaacgucauaaaagccguaauuguugauaaauaccuaaacgaugaagauuucgaauaccacggaauaguagagaaaauaaaccaagauauuagcaauggaagcuaccuacugaaacaacgcaacaaccaaaauggaaacauuccccaccaacuccaucaaauggaauuagaccaaauuauagaaaaucaaucaaaguacuaccacuuucuuggagaacucaacccaaacucuaacagaaaucacauagcaaaauacaaaauuucagaacuuguagccuucaggguaccauacuacguaggaccacucauuacgccagaagaacaagagaaaaccuccggagccagcuucgcauggaugaaaagaaagaaagacggugcaauaacuccuuggaacuucgaagaaaaagucgacaaagaagaaaccgcguccagauucauaaaaagacugaccguuaaagacacauauuuacugaacgaagaugucuuaccugauaauagccuacuauaugaaaaauucaaagugcuaaacgaacuaaacgucguaaaagcaaacaauaagcgucucacaguagaagagaaacaaggagcauuugacaauuuauucaagaaaaugaaaacaguaacagcaaaaagauuaaagaacuaccuaguaucaaaucacaaccacaucaacaguguagaaauaacaggacucucagauggagacaaauuuaacaauagcuuaucaacauacauagacuucaagaaaaucuucggagacaaaaucgacaacccaggccuacuagaugauuucgaggacauaauagaguggucaacagucuuugaagacagaaaaaucuuugaagaaaaagugagaaaagauauaucauggauaagugaaagcgaaauaaagucaguaguuaguaaacgauauucuggcuggggucgauuaagcaagaaacuauuaaacugcauaacaaacaaugagggacgaaacaucaucgacgaauuaugggaggaaucagaaacauuuauggaagcaguaucaaaaccagaaguaaaagaacaaauagacggaaucaauuccgacuucauaaagaauacagauauagaaucaguccucgcugacgcauacacauccccucaaaacaagaaagcaaucagggaaacucacaaacuuguaaaagacauacaaaaagcgauggguggccaagccccggcaaguauaucuaucgaauuuacacguaauccacaagacaaaggacaacuaacacgaagccgacacuccgaaguaucaagaaaauacaaagagaucagcaaagaaauaucgaaaacucuaaacgaugaacuaaaaaguaagaaaaauuccauggauguggacaaauacuaucucuacuucaugcaaaugggcauagaucuguaugaugguucaucaauagacaucgaugauuugaauaacuaucaaauugaccacauaauaccccaaaguuuuuacaaagacgauucguucgacaauagaguacuaacucauuauagcaacaaccaaaagaaaggaaauaacaccccacucaacggccuaaacauaaacgauaaaacaagggccauuuggaaucacuugcgagaccucggcuuaauaaccaaaaagaaauacaauggccucacacuaaaagguauggaccaauuaagcaaauauacaaaacaugguuuuaucagaagacagcuaguagaaaccagucaaguaauaaagcuagucgcaaacauacuauccgaugaguucucaacagaugauacuaaaauuauagaagucaaagcuaaaaugaacucacaaauacgacaaguauuuaaucucuauaaaguaagagaauugaacgacuaccaucaugcgguagaugccuaucuaaccacguuuaucggaggauaccuauacaaccgauaccccaacuuaagaaauauguucguauacggcgacuucaaaaaguuuucagccgauguagacaaucuaaagacuuuuaacuuuuuacacgaaauuacaaauccaucagacaaauuugaagaucgaauauucgacgaaaaaucaggagaacuaauacuagacagaaaacacgcaaucgaaacuauuaagaaaauauaucaauacaaauauauguuaaucacuagagaaguauccacgaaaaauggacaauuaagugaucaaaccguuuacucagcaaaaagaauuaauaauguaaaagcccccauucccguaaagaaagacuuuaacccagaacuauacggauuccgaaccggaaacguagaucaccacauggugauugucaaauauccaaagaaagauagcuacgauuauaaaguggugggaauaccacuuagauucguacaaaaacucaaagaaacgaaagauaauaaagauuacgaaaaucuauuaaaucaaauugugcaaaugaaacugaacagaaagaaacaggacuuuauaguaguaguggacaacguaauguacggacaacuuauucaggacgggggacagaaauucacccuagguucaaguacuuacagauauaacgcaaaacaacuuguaaucgacaauggauaucuaaaacuaauagccgacgaaagauauaaaaauagccuaacagaugaagaaaaaucaaaccaauacauaacauuauauaaugaaauccuaaaggugguaaauggacgauucgacguauuugauguaaacucuuuucgaaagaaauuaaauaacggaguagauaaauucauaaaacuuaacacagucgauaaacgaauaaucauaaugaaaauacuauccggacuccacuguggaccaucaaucguccccuuaaaagaauuaggucuuacaacgccucuaggccaacuacaaucaaccucaggaauaucucucucggaaaacacuauaauuauuuaccaaucaccaucaggcuuauucgaaagaaaaguuagacucggcgaucuguga

SEQ ID NO: 5565 - RNA, 4176 nt, Artificial Sequence
  Cas9 variant
augaaaaacuaccacauaggacucgacauaggaaccucaucaguuggcuucgcagcacgagaugaugacaacaaccuaauaaggguaaaaggcaaaaacguaaucggugcccgauuauuuucagaagguaagaccgcacaggaaagaaggauaucuagaaccucccgcagacguuacaacagacgaaaauggcgacuacgauuacuagaugaaaucuuccacgaugccaucguacacaaggacgcagaguucuucaaccgauuaaaacaaucaucacuaucuccaaaagacgaacgcaaacaauauuuuggaucucuacucuucccggaagucggagauggggacuauuuccgagaugguaaccaaaccaucuaucacuuacgacaccgccuaaugacacaagaugaaaaagcagacauaagggaaguguaccucgccuuaagacacauuauaaaauacagagguaauuuccuagaugauaccccaguaucaucguucgaagcauccgaucuuaaacuagcuaguuuuguaccaacuuuaaaugaucuauuugaaacaauaaacguaaacuacgaauuauccaucgacaacguaaaucaaauagaaaauauucuauuaaacaauaaguuacgcaacucagauaagucuaaacaacucaccgacuuaauagccgaaccaguuacaaacauagaugacaagucuuuaaagaaacaauuugauaaagaaagaaaagauauaucaaaagaaauagcaaaagcagucgucggaucaaaaaugaacguuaacaaauuacucagcuucgaaucaagugaugggaguaaaauaucauuuuccuucagcgaugcaucaucugaagauaaaaugcucgaacuuucugacauuuuagaugauucaagaaugaacauuuugaacguacuaaaagugauuuacucacgagugagacuuaaucaaauuauacccucaggaaugggacuuagugaaucgaugauagcagccuaugaccuucauaaacaacaacuaaaggaccuaaaaacccuuuuagacgucguaccauucaacgaaaaguaugcagucaaaauagcauacgcggcuuauauaggaaacauagauaagcaaagauuuacaaaagcagaaguaaagacuauagauaaauuaagagauaagaaaagcauuacaucaguauuagauuuuaaaagcggacacauaaccaacgaagaacuaaacaaugugauuaaagaaguaaucguugauaaauacuuaaacgacgaaaccuucgaauaccaugauauuguagagaaaauaaaucaagauauaucuaauggcaacuaccuacuaaaacaaagaaauaaccaaaauggaaacauaccucaucaacuccaccaaauggaacuugaucaaauuauagaaaaacaaucuaaauacuacccauuccuuggaaaacugaacccuaacagcaaacgaagccauauugccaaauacaaaauaucugaacucguagccuuccguguacccuauuauguaggaccuuuaauuacuccagaggaacaagagaaaacuucaggugccucauuugcuuggaugaaacgcaaagaagacggagcaauuacuccauggaauuucgagaaaauggucgauaaggaaagcacagcguccagauuuauaaaaagacuuacaguaaaagauacuuaucuccuaaaugaagacguuuugccugacaacucacuacuauaugaaaaguucaaaguauuaaacgaacuaaacguagucaaagcgaauaauaagagauuaacuguagaagaaaaacaaggcgccuuugacaaccuauucaaacaaaugaagacaguaacggcuaaaagacuaaagaacuaucuuguuucgaaucauaaccauauuaauucaguaaaaaucacaggucuuucugacggagaaaaauucaacaacaguuugaguguauauaucgauuuuaagaagauauucggcgacaaaauagacgauuccaaauuauuugacgacuuugaaaacaucauagaauggucaacaguauucgaagauagagacauuuucgaagaaaaaguucgcaaagauaucaguuggauaagcgaaagugaaauaaacgcagucgugucgaaaagauauucaggauggggacgacuaaguaagaaacuacuaaacggaaucacgaacgaugaaggaagaaauaucaucgacgaauuaugggaagaaagcgaaaccuuuauggaagcaguuucaaaaccagaagucaaagagaaaauagaugaaauaaauucaaauuucaucaaaaauaccgauauagaauccguucuagcagaugcuuacaccaguccccaaaauaagaaagcgauaagagaaacauauaaauuaguuaaagacauccagaaagcaaugggcggacaagcucccucuucaauaucaaucgaguucacuagaaauccucaggacaaaggcgaacuaaccagauccaggcacagcgaaauugcaaagaaauacaaagaauuaucgaaagaaguuagcaagaaauuaaaugaugaacuaaaaucaaagaaaaacucuauggacguggacaaauacuauuuauacuuuaugcaaaugggcauagauuuauacgaugguacuuccauagauaucgaugaucuuaacaauuaccaaaucgaccacauaguaccacaaucauuuuacaaagacgacucauuugacaaucgcguacuaacacacuacagcaacaaccaaaagaaaggaaacaauacuccucuuaacggacuuaacauugauucuaacacaagggaaguauggaaccaucucaucggccuaggauuaauuacaaaaaggaaauacaacaaccucacacuaaaaggaauggaccaacuuucaaaauauacaaaacauggcuucaucagacgucagcuaguagagacaagccaagucauuaaauuaguagcuaacauccuauccgaugaguauagcaaagaugauacuaaaaucauugaaguaaaagcuaaacucaacucacaaauacgacaaguauucaaucucuacaaaaucagagaacuaaacgauuaccaccacgcacucgacgcauaccuaacuacauucauaggaggauacuuauacaauagauacccaaaccuaagaaacauguuuguauauggagauuucaagaaauucucagcgaaaauagauaaccuagaaaccuuuaacuuccuacacgauaucaccaaucccagugauaaauucgaagacagaauaauagaugagaaaaguggugaaguaauccuagauaggagacacgcgauagaaaccaucaagaaaauauaccaauauaacuauauguuaauaaccagagaaguaucaacuaaaaacgggcaacuuuccgaucaaacugucuauuccgcuaggagaauuaacaaagucaauucaccaauaccaguaaagaaagauuccaacccagaauuauacgguuuucguaccggcaacguagaccaccacaugguuauaguuaaauaccucaacaaagacaaauaugauuacaaaauuauaggaauaccacuacgauuuguacaaguacucaaaaauucuaacgacaacacagaauauaaaaacauccuaaauaaaauuguccaaagcaaacuaaaaggaaaaucgacugacuuucgaguuauccuagacaacguuauguacggacaacuaauacaagacggcgggcagaaguuuacccuaggaucaucuaccuacaaauauaacgccaaacaauuaguaauaaauauggaugauauucgaauacucguagacaacagauacuucaacucucuaucagaugaugacgcuaguggagaguucauaaaaauuuauaaugaaaucuuaaaaguaaucaaugcccgcuucgaccuuuucgacaucaauaaauuccgagaaaaacuaaauaauggcaaagaauacuuugaaaaucuauccauagacgagaaaaaccaaguacuccuaaaaaugcuaaguggucuacauugcggauccgcaaauguacccauaaaagaacuagggcuaacuacaccacuaggaaaauuacaaauaccuagcggaauaguacuaucagaagaugcaauagucauauaucaaucacccaguggcuuauuugaacgaaaaaucagacuaaaagacauuuga

SEQ ID NO: 5566 - RNA, 4176 nt, Artificial Sequence
  Cas9 variant
augaacuuacguaauuacccaggagaauacucgauaggcuuagacaugggcacugggagcguaggauggagcguaguagaugaaaaaggcaauuuauugcauuuuaaaaagaaaccuacaugggggagcagacuuuuugacuccguaaugccagcuagugaagcacgcguacaucgaggacaaagacggcgcuaugaaagaagaagauggagauuggauuuauuacaaggccuauucaaaaaugaaaugaacaaaguugauccagaguucuuuaugcguuuaaaccaaucaagaacuauagaaggagauccaaucuuuacaaaaucauuuaccaaagcagacuacuacgacagguuuccgacaauauaucauuuacgagccuauuugauggaaagcaacgagccagcugacuuacgguuaauuuaccuagcaaugcacaacaucaucaaacauagagguaauuuccuucgcgaagaggagaaaagucucagugccaaacacgcagacaguaagaaagcuguaacacaauuuguagacgcucuaaaagaaugguguuucaguaggggguaugaauuuggaaaagauccagcaaaaucuauugaaaaaugcuugucugauagcaaaucauccagaucacaacuagcaagugaaauugccaaagcccuagcugugucgaccgacgcggcugcagcagauaagaaauuagcagauaauuuagcuaaagccaugguagguuugcaaugugaguucaaauauguauucggagaguucgauugcgaaaguacaaaguuagcacuuucagacgacgaaaaacuagaacuuuuaagggccgcauguccugaugacagcgucgaacuacucgacgcacuaugugcaguauauucagcauacguauuacaaggucuacuaaguuaugcaccuggccaaacaauaucucauaauaugaucgcaaaauacgacuuauauaaaacugaucugaaaacuuuaagagcauuagugagggaauaugcaccuggagcauacgaugaguucuuuagaggagcaacuuaccacgacgcaaaccccgacgauucuaguaaagauuauaguuacgcagaugcggaaggauacacagcuuacaauuuacauaaacugagcuaugaugacuuugcaaaggcaguaaagaaacuauuaggugguacagaugcugucaccgaugaaagauauuuaaacaugauggaaagauuugaaaaacagcaauuucuucgaagacuaaaaaccagugacaacggugccaucuacuaccaauuacacuuagaagaauuaacugcaauaaucaaaaaucaaggacgauuuuauucuuuccuaaaagaauaugaaggaaaauuugagagcuuaguuagcuuucgaauaccauauuauguaggaccacuuacaagugucaaugcagcccaagauucccauaaucauaauagauuccaaugguccgaaagaaaaccaggaauggaaagagaaguaauuaccccauggaauugggauacuauaauagauaaaaauaaaagugcagagaauuuuauaaugcguaugacuggagauuguacauauuuagcaggcgaaaaaguauuaccaaaacaaucacuauuauacgaagaauuuugcguauuaaaugaacugaauggaguaagguggucagaugacggagaugacuggcaacgauuugaugcugcccaaagagaagguauaguacgagaguuauuucacaaauacaggagggucacauacaaaauguuagaagauugguuaguaagagaaggcgaugcaaaccacccgauaguaaaaggaggucaaggggaaacaggauuagaaagcaaaauggguagcuaccuauucuuugcgaaaggaauuuuuggacuaggagaguuaaguccggcugaauauccugcaauagagaaaaugauaaaauggaauacacuuuuugaagauagaucaauauuaaaagaaaaauuagaggacgaguuuggagaaagagguaauggcauguuggaugcaucacagaucaaagcaauauguaagaaaagauucacugguuggggaagacucagugagcaauuucuuacgggacugaaaguagaaagucccgccggucgagcgguaaguauaauggauguacuacgugaagggaacccauguucugaaagaagacagggugagacugugguuaugauggaagcacuucgcgacgaaggacugggcuuccaaaagaaaauagacgaacauaaccguaauuauuacggccaacauggaaaagauuuaggagugaaugagcuaccuggaagcccugcgauucgcagaucacucaaucaagcaauccgaaucguugaagaaauagcaucgauagccgggcaugcuccugcuaauaucuucauugagguaacucggggagaagaugcuggaaagaaagggaaacgaacugugaaaagaugggauaaaauuggagaagcacuaaagaaauuaaaagaggaaggaguggcaguagaaguaauggacgacuucaaagaacaaaaagcuauaaacgcgaauuuggaugaaagacucagcuuguacuuaaugcaaaauggaaaaugucuauauucaggaaaagcaauaaaccuagaaaaacuacuugcaggaucaggagaauacgaaguagaccauauaauuccuagagcguauaucaaagaugauagcauugaaaauaaagcucuuguacugagagaagaaaaucagcacaaaacugaucaauuauuaauagacaaaaguaucagauggaaaaugagagaaacauggagucagcuacaugacgcuggacuaauaggagauaagaaauaucauaacuuacuacggaguaacauaaacgagaaccaacuuagaggauuuauugcgagacaauuaguagagacuucucaaaugguaaaacuugcgcaagcacuacuugaagcacguuuugccaaugaagaaacaagaauaguaccgguuaaagcgucaaugagccacaaucuacgcgaagcggcagaccuugcgaaaugccgagaagcuaacgacuuccaccacgcacaugacgccuucuuagcauccaggauagguuuauucguacaaaugagacauccaggaauauacgaaaacccaauaggguacagccacguaauaaagaaauauguucaagaacaaucugaagucuucaagaaaacucacagaaugccugggagugccggauucguuauaaacaguuuuaugucaucaggcuucgacaaagauaccggagaaguauucaaagacucaugggaugcugaagcggagguagaugguaucagaaaagcauugaacuauagacaaugcuauauaucacgaaugccacaacaagacacaggugcauucuggaaugcaacggucuacucuccaagagacccgaaaauggggccaaaauuagcccuuucuacaaaacagggacucgacccaaaauuauauggcgguuuuaguucacaacaauuugcuuauuucuuuauauaugaagccaaaaagaaaggaaaaccaacauuccgauuuucacaagugccaguaugguuagcagcacgaauugaggcaaacccgcuagcgcuugaagaauacgcaagaggacuagcaaaaggagagggccuugaauuuguaucaauacagagaccaaaaaucuauaagaaacaacucauagaaguaaacggggauaaacucauaauaacaggagcgaaagaggucagaaguggagcagagcuagcguucaaccaagaugaaauaucagcaauaucaauguguucaaaauuaagagcagcagaagcgggucuagacggcgcauucucagaggaaguaagugcaauauggaaucgcauaagcaacgcaccagugcaaaguugugggcguuuacuaagacaacuaacacuacccaaauaccaguccaacuuugacucaaguuccaacgaagaaaaagcggcaguaguauuggguuuaauagcccuauuaaauggaaacaaucgaauagucgaccuaucagggguuggaggaaguagccaugcuggagcuaugaugaugaguuauccuaaacuauuagacgacccuaaagugccauuuuucauaauugaucaaagugucacaggcauguuugaaagaaaaacucgcguuggacuauga

SEQ ID NO: 5567 - RNA, 4176 nt, Artificial Sequence
  Cas9 variant
augaagaaaauacuaggacucgauuuaggcacuacaagcauaggcugggcucuagucaacgaaaaagaaaauaacgaagaacaauccaguaucauacgauugggaguaagaguuaacccauugacagucgaugaaaaaucgaauuucgaaaaaggcaaagauauuacaacaaacgcagacagaacaaaaugcagaucagcaagacguaaccuccaaagauuuaaacugagaagggaagccuuagcugacugccugaaaagacauggauuaaugacagaugaaacaccccugugcgaaacaaauaacucaauaauauuuaaaacauauucaaaccgagcgaaagccguuugugagaaaauugcuuuagacgacuucguaagaguauuauucaugauaaacaagaaacguggauacaaaucaucaagaaaacuuaauaccgacgaugaaggaacucuaguagacgguauggacguagcgaaacuauuauacaaugaacaaaucacaccaggagaauacuuacuaagauuauuuaagaaagggaagaaaacaaggccugauuuuuaucuaagugaucucaaagcagaacuugaaaggauaugggacuuucaacggacauuuuacccagaaauccuaugcgaugcauuaaaagaagaccucaaagguaaaagucgcacgcaaucauccgccauauuuuaugcuaaauauaaaguaaguacagcaaaaauugcuggcaaagacaaaagacugcaagaacucacuuggaggacagacgcccugagaaaacaauuaacaauugacgaaguagccuauguaauauguucuauuaauggagaaauaaacggcagcagccaacgcuuaaguaugauuucugaucgcucaaaacuauuauacuucaaucaccaaacaauaggacaauaucuaaugcaaagacuugaggagaacccaaaugcaggucuuaaaaauauaauauuuuaccggcaagauuaugaagacgaauuuaaugauauauggaauagccaagcaacauaccauaaagagcuuacacccgaauugaagaaagaacuaaaagacaucaucuuuuaccaacggggauuaaaaagcugcaaauggcuuaucaauuauugcgaacuggaacacgaagagauagaaguaaaaacacccgaagguaaauuaagaaaaauaacuauagggagcaaaacaugcccaaaaucuagucccuuguuucaggaguucaaaauauggcaaguacuuaacaaccuacaaguuagcccauugaacucacguagaaaagcaaaaaggaagaaagacgaggaaccgucacuauucucugaugaagauaugaacacagcaugucgcuacuuaaacgaagaagaaaaacuuacacuauuuaaagaauuaaguauaaagaaagaacucaaaaagaaagacgcacuaaaauuacuguucgaaaacuauaaggaacuagaccucaauuacaaaguaauaaguggcaauguaaccauggccucccuauacagagccuuucaagacauuauaagccuaacaggcaauggagaauuugauuuccaagccaugcccgcagaagaagccgagaaaacaguagaagaaauauuugguggguuaggauacaagacagccuuuuuacacuucgaugcaagccuacacggaaaagaguucgaaagacaaccagcauauagauuauggcacuuacuauacucauaugcgggugaccaaaguaaaacuggaauagaagcccuagugaaaagaauacaagaauuguguggcuucgaaccagaauacgcacguauacuagcaaacaucucauucauaccggacuacggaaaccuuuccaguaaagccaugagaaaaauucucccuuauaugcaagauggauacgaauacucggaagcaugcuccaaagcuggauauagacauagcgcuaguucacuaacaaaagaagaaaucaacaagaaaacauauaaaacucaucuagaugagauaaaaagaaacucccucagaaauccaauaguagagaaaauacuuaaccagaugguaaauguaguaaacagcgucauagacacauacgggucaauagacgaaauucgaauugaaauggcuagagaacucaagaaaucgaaacccgaacgcgaagacaugucauucgcgauaaacaaagcuacaaaagaaacggaacgaaucaaaggaauacuagaacaagaguucaaaauucaacacgucacccguaacgacauaauacguuauagacuuuaugaagaacuaaaaccuaauggauauaaaacacuuuacucuaacacauauauaccgagagaagauuuauucagcaagaaauucgacauugaacacauaauaccaaaagcuaggcuauuugacgacagcuacucgaacaaaacccuggaauuaagagauauaaacauugaaaaaggaaaucaaacagccuacgauuucguacuaagcaaauauggcgaagaaggacuauauaaauacgagcaaagaguagaagaauuuaagaaaaauaacgagcaagcaggauccaaaugucgcaaauuacuaaugagagaagcagacauucccuccgacuuccucaacagagaccuaaacgacagucaauauauagcaaagaaagcacacgaacuccuaagggaaauaguaccaacaguaacagcaacuacagguagcauuacaaaccgauuaagggaagacuggaaacuuguuaauguuaugaaagaacucaauugggaaaaauacgauaaauuaggccuaacagaagaauacaaagacaaagauggaaauacuguacgacacauaaaagacuggacuaaaagaaaugaccaucgacaucacgcaauggaugcauuaacaauagcauucacaaaaccgagcuuuauacaauacuuaaauaauuuaaaugccagaucaaacaaaggagggucuaucuauggaauagaacaaaaagaacuagaaagagaaaacaacaaauugguauuuauuccaccuauagauccaaaaauauucagaaaacaagcuaaagaacaccuaucaaauauccugaucucaauaaaagcuaaaaacaaaguuguaacgaaaaacguaaauaaaacaaaaaguaaaucaggaacaaaccgcaaaguacagcuaacaccucgaggucaacuccaucuagagacaguauauggcaaaauaagaacauauaaaacagaagaaaucaaaguaggaacaaaacugaccgaggaauuaauagcaaaaguugcagacaagaaaaucagagaagcgcuaaugcagcgccucucugaauauggugguaacauuaaaaaggcuuuccaaaauauaucaaaacauccgauauggcuaaacucaucacacacaaaacauguaccagaaaaaguaaaaauagucuucuucgaagauguauucaccauucgaaaagcaauaaccccugacauuaaaauagacaaaguaauuaauuccaaaauaagaaacaucuugcaggaacgacucaaugaguuuggcggagaagcagcgaaagcauucagcaacuuagaccaaaauccaauaugguuuaacaaagauaaaggaauagccauaaaauccguuaaaaucagagguauagcaaauggaacagcaauaagaguuaagaaagauauacauggaaacacuauaauaggaaacaauggauacccaaucccaaaugauuacgucaauacaggaaacaaucaucauguagccaucuuccgagacagggacggcaaccugcaagaacacaucgucuccuuuuacgaagcaacagcccgagcaauccaaaaccuuccuauagucgaccgcaauuacaacucagagaaagacugggaguuccuauuuuccaugaaacaaaaugaauauuuuguuuucccaaacccaaacaccggauucaauccauuagaaauagacuugcgaaacgaagaaaauuacgcauuaaucagccccaauuuauuccgaguacaaaaauugucccauuacuauuacguauuuagacaucaccuagaaaccaauguagauacaaauuuacaauuaaaagacauaacauggaaacgcauaaaagcaauuaauaaucucaccggcguaguuaaaguucgaaucgaccacuuaggcagaaucguagacguaggugaauauaaauga

SEQ ID NO: 5568 - RNA, 4176 nt, Artificial Sequence
  Cas9 variant
augaaaaaacgaauagacgauuauauacugggacuagauauagguacuaacucaugcgggugggcugucacagacaaaaaaaauaaccuacucaaacuuagagguaaaacagccaucgguagccaccucuucgaagaaggacacaccgcagccgaucgaagaggguuccggacaacccguagaagauuaaaacgacguaaauggcgacuaagacuacuagaagaaauauuugcagaaccuauggccgaagucgauccgggauuuuucgugagauugcaccaaucauggguaaguccucuagacaaauccagaaaaaaauaccaagccauuguauucccaacugcuaaagaagaccaagaauacuaccaaaaauauccaacuauuuaucaccuacgagacgccuugaugacucaagacagacaauucgaucuucgggaaauuuuucuugcaauccaccauauaguuaaauacaggggaaacuuucuccaggauacggcagucaaagauuuugaagcauccaagauagaaguaggucccauccuaacaaauauaaacaaugcauucgcagacaaaauaguagaaggucaggaccuaauugaauuaaacgucgcaaaugcugccgaaauagaggcaguaaucaggggaaaagaugcagacaaaacacucuauaaaauggauaaagucaaaaaaauugcuaaacuacuaacagauagcacagcaaaagagcaaaaaaacguagcuaaacaaauagcaaacgccaucaugggcuauaagacccaacucgaaacuauauuaggaaaagaaaucgauaaaaacgacaaagcgcaaugggaauucaaacucucagacgcagaugauaaguuagacgccuuacuaccugacuuagacgaaagugaccaaacaguagucgcagaaaucgaaaaacuuuuuagcgcgauaacacuuucuaccauaguagaugaaaacaaaucucuaagccaaaguaugguagaaaaauauaacaaacaccaucaagacuacaaacugcuaaaggcguauaucgagaguuuaccagaccgugcacaagcaaaaaaauuacuccuagcguaugaucuuuauguaaacaauagacauggacaucuccuagaagccaaaacagaguuuaaacaagauagcacuuuaacaaaggaggacuuuuacaaaacuguuaaggacaacuuagacgacagugaauuagcacauaaaauagcacaggaaauugcagcggauaauuuuaugccaaaacaaagaacuaacagcaauggaguaauaccauuccaacuacaccaaaucgaacucgauaaaauaauagcuaaucaaagcaaauacuaccccuucuuagcugcugaaaacccaguagaagaccaucgcaaacaagcgcccuacaaacuagaugaacuaguacgauucagagucccguauuauguaggcccaaugauaacugcagacgaacaagaaaaaacaagcggaaaaucuuucgcauggaugguucgaaaagagcaaggacaaauaacccccuggaauuucgaacaaaaaguagaccgacaagaaucggccaacaaauucauaaaacgaaugacaaucaaagauaccuaucuucucggugaggacguacuccccgcuaacaguuuacuauaucagcgauuugagguacuaaacgaauugaauaacauaagggucaacggaucccgcauuucaguagacuuaaaacagcagauuuucaacgacuuauuugaagagaaaaaaaccguuaccgaaaaagccuuaauauccuacuuaaagcaaaaucuccaucuacccacaguugaaauaaaaggacucgcggacccaacaaaauucaacucuagcuuagcaucauauuaccaccuuaaaaacuuacacguuuuugauaaagaauuagcagacccacaauaccagaaagaauucgaaaaaauaauugaguacagcaguauuuucgaagacaaaaaaauauuucaagauaaauuacaugcagaauucaaauggcuaacaccagcacaauucaaagcuaucaguacuuggcgacuacaaggcuggggacgacucucaagaaaauuacuuguagaacuucacgauacuaauggacaaaacaucaucgaacaacuaugggauucacaaaaaaauuuuaugcagauuguaaccgaaccugacuucaaagaagcaauugcuaaagaaaaucaaaauaucacacaggaaaauggcgucgaagaaaucuuagccgacgcuuacaccuccccugcuaauaaaaaagcaauacgacaaguuguaaaaguaguagcagacgucgucaaagcagcuuccgguaaggcuccggcacaauucgccauugaauucacccgugauccggauaaaaacccacaauugagccacauacggggaaccaaauuauuaaaggcauaucaagaaaccgccggugaacuuguagaccagaaccucacaaauagccuaaaagaagcuaugacaaguagaaaacuccugaaagacaaauacuuuuuauauuucaugcaaacgggucgggaugcauacaccggaaaaaaaauaaacauagacgaaguaucaacaaacuaucaaauagaccacauauuaccacagaguuuuaucaaggacgauagcuucgauaaucgugucuuaacagcaacaccgcucaacgcagaaaaaagcgaugacguucccuacaaacgauuugcgaauaauuauguuucagaucuaaaaaugacaguaggagaaauguggaaacauuggcaaaaagcuggaauuauaaauaaacacaaacucgguaauuuacuucuugacccagauagacuaucaaaauuccaaaaauccggauucaucaaccgacaauuaguugaaacaucacagaucguaaaacuaguaucgguaauacuucagaauaaauauccagacgccgaaaucauaacaguuaaagcuggugauaacucugcacuuaggcagcgacuagauuuauacaaaucucgagacguaaaugauuaucaccacgcaauagacgccuauuuguccauaguaugugguaauuuuuuauaucaaguauauccaaaauaccgacccuauuucguauauggccaauucaaaaaauucucccaggauccagaccuccaaaaagaucuaauaaaacacuuuaaaggcuucaccuucauguggccacuauuacaaaaagauaacagugaacgaaaagcacuagaagaaauaaaagaaaauaacucagaccgaauaguuuucuauaaacacccagacauauucgacaaguuaaggaaagcuuauaauuauaaauacaugcuagugucaagagaaacgagcacugaaaguagcagcauguuuaacaugacgauauacccuagaggagaaagagauagaaaaaaaacaagaaaauuaauacccaaagggaacggucuagacccaaaaauuuacggaggcuauucagguaacacagaugcauauauggucaucguuaaaauagaaaaggccaaagagucaauauacaaagucauaggaauuccuaugagagcauuagcgggacuuaaacaagcaaaaaaucaaggaaacuauaaggaagaacuacacaaaguagucgaaccacaaauaaugcuagauaaaaaugggaaaccaaaaaggggcguggaaggauucagaguaguaaaagaccacguaccauucaaacaaguaguccuagacggagacaaaaaguuuaugcuguauucugcgaaauaugaaacuaaugcuaaacaauuaacguuaucccaagaaacaaugcgcauuguuacagacaaucuaaaaaaaucagaggaccaagauaaacuacuaguuaaagccuaugacgaaaucuuacagaaagucgaccaguaccuaccgcuauucgauguuaauaaauuuagaaauagucuucaucucggcagagcuaaauucuuagaucucgccguaaaugauaaaaagauuacacuaucaaauauauuaaacggacugcacgauaaucuuguaguaccaaaucuaaaaaauauaggaauuaaaacacccuuugguuuaaugcaaaguccaaguggcaucacauuaucaucuaaugcaauauuaaucuuucaaaguccuaccggacuauucgaaaaacguguaagaaucgccgaccuauga

SEQ ID NO: 5569 - RNA, 4176 nt, Artificial Sequence
  Cas9 variant
auggagaacaaacaauauuacauuggacuggauguaggaacuaacucaguaggaugggccguaacagacacaucauacaaucuacuccgagcaaaaggaaaagacauguggggggcaagauuguucgaugaggcgaaaacugcagucgaaagaagaaccaaacgaaccagccguagaaggucagaaagggaaaaggcaagaaaagcaauguuaaaagaacuauucgcggacgaaauuaacaaaguagauccaaauuuuuucauaagauuagaagaaaguaaauuuuuucuagaugacagaagugaaaauaaccgccaacgauacacgcuuuucaaugaugcaaaguucacagacaaagacuacuacgagaaguacaagacaauuuuccacuuaagaucagcccuaauaaauucugacgaaaaauucgacguacgucucguauuuuuagcaauccuaaaucuauucucacaccguggucacuucuuaaacgcaaguuuaaagggagacggugagauucaaggaguagauaucuucuacaaugauuuauacgaaguaugugaagaguuugaaauagauuugccacagauaucaaacauugacaauuuugaaaaaaucuugucccaaaaaggaaaaucuagaacgaagauauuagaagaauuaagcgaagaacuuucgauaagcaaaaaagaaaaaauaaaauacucccuacuaaaacugauaugugguaugaaaaucaaagugguagauaucuacgcagacgaggacauacaagaagaugauaaaaaaaaagaucucggguuuagagagagcgauuacgaaaagaguucccuagaaguaaaggagauaauaggcgaugaccacuucgaauugauagaaagagcaaaagcaguacacgauauaggacuacuagcaaacaucaucggaaacucaaaauacuuaugugaagcaagggucgaagccuacgacaaccaccacaaagaucuccaaaaaaucaaagaacuuuuaaaaaaauaugacaucaaggccuacaccgacauguuuagaaaaaugacagacaaaaacuacuccgcauauguuggcucuguaaauucuaacauagcuaaagaaagaagaaguguagacaauagaaaaauugaagacuuauaugaauauauaaaaaaaaucgcccuaaagaauauaucagacgauaacgaggacaaaauagaaaucuuaaaaaaaauagagacaggcgaauuccuaaaaaaacagcugacagcaagcaacggcguaauacccaaucaacuacaaagucgugaauuaagagcaauauuaaaaaaggcagaaaacuaccuaccauuccucaaagaaaagggcgaaaaaaacuugacgguaucagaaaugauuauacaacuauucgaauuccaaauaccauacuacguaggaccauuagacaagaauccaaaaaaagauaaaaaugcuaacaguugggcgguaauaccaucagguggaagaaucuuaccauggaacuuugaagauaaaguagacguaaaaggauccagaaaagaauucauugaaaaaauggucagaaaaugcacauaucuaagcgaagaacacaccuuaccuaagcaaucacuuuuguaugaaaaauuuaugguacuaaacgaaauaaauaauauaaaaauagauggugaaaaaauuaguguagaggccaaacaaaaaauauauaacgaccucuucaugaaaggaaaaaaagugucucagaaagcgauaaagcaggaguuaauaucucugaauauaaugucaaaagauagcguucucucugguauagacacuguguguaaugcauaccuaaguagcauagccaaauuccgcggaguguuugacgaaaauguaaacaaccaaaguacaaucgacaugaucgaagacauaauauuucuaaaaacaguauauucagacgagaaaagauucgucaaagaagaaauagucgaaaaauacggagaugaaauagauaaggauaaaauaaaacgaauuuuaggcuucaaauuuucaaauuggggaaacaucaguaaaucauuuuuagaacuagagggagcagauguagggacuggagaaauacgaucgauaauacagaguuuaugggaaacaaauuucaauuuaauggaauuacucucaucaagauuuaccuauauggacgaacuagaaaaaagaguaaaaaaacucgaaaaaccuuuaagcgaauggacgaucgaagacuuagacgauauguacuuaagcucaccugugaaaagaaugauuuggcagagcaugaaaaucguagacgaaauucaaacagucauuggauacgcaccaaagcgcauauucguagaaaugaccagaucagaaggugaaaaaguuagaacaaaaucaagaaaagauagauugaaagaauuauacagcgcaaucaaagaagauuccaagcaauggguaaaagaauuagaugcaaaagacgaaaguuacuucagaaguaaaaaaauguauuuguacuaucuacagaaaggaagaugcauguacagcggagagguaauagaauuagauaaauuaauggacgauaaccuuuaugauauagaccauauauauccaagaaguuucgugaaagacgauucacuagacaaucuaguacuaguaaaaaaagagaucaauaauagaaaacaaaaugauccuauaacgccacaaauacaagccagcugucaaggcuuuuggaagguauuacacgaacaaggcuucauuaguaaugaaaaauacucucgacuaacacgaaagacacaggaguuuuccgacgaagaaaaguuaucauuuauaaacagacaaauaguagaaacaggacaggcaaccaaaugcauggcucagauacuucaaaaaaguaugggagaagacgucgacguaguauucucaaaagcuaggcucgucucagaauuucgacacaaauucgaauuauucaaaucucgccucauaaacgauuuccaccacgcaaaugacgcuuaucuaaacauaguuguaggaaauucguauuuugucaaauucacaagaaacccagcuaauuuuauaaaagacgcaagaaagaauccugacaacccugccuauaaauaccauauggacagauucuucgaaagagauguaaaaucaaaaucagaaguugcauggauuggacaaagugaaggaaacgcaggaacgauugcaauaguaaaaaaaacaaugaguaaaaauuccccgcuaauaacaaaaaaaguggaagaggggcacggcagcauaacaaaagaaacaauuguagguguaaaagaaaucaaauuuggcagaaacaaaguagaaaaagccgauaaaacgccaaaaaaagccaaucuacaagcauacagaccaauaaaaacgagcgaugaaagacucuguaauauauugagauacggaggaagaacuaguauauccauaucgggauauugucucguagaauauguaaaaaaacggaaaaccauucguucacuagaagcuauuccaguauacuugggcagaaaagauucgcuaucugaagaaaagcuauugaauuacuuuagauauaaccucaaugacgggggcaaagauagcgucuccgacauacgacuaugccuaccauucauauccacaaauagcuuagucaaaauagacggauaucuauacuacuuaggaggcaaaaacgaugauagaauccaacuguauaaugcuuaccaacuaaaaaugaagaaagaagaaguagaauauauuagaaaaauagaaaaggcagucagcauguccaaauucgaugaaauagacagggaaaaaaauccuguccuaacagaagagaaaaacauagaauuauacaauaaaauacaagacaaauuugaaaacaccguauucucaaaaagaaugaguuuagugaaauacaauaaaaaagauuuaucauucggagacuuucuaaaaaacaagaagucgaaauucgaggaaauagauuuagagaaacaauguaaaguacuauauaauauaaucuuuaauuuaucaaaccuaaaagaaguagacuuaucagauauaggagguaguaagucaacaggcaaauguagaugcaagaagaauauaaccaacuauaaagaauucaaacugauacaacaaucaaucacgggacuauauucuugugaaaaagaucuaaugacgauauga

SEQ ID NO: 5570 - RNA, 4176 nt, Artificial Sequence
  Cas9 variant
augaaacgcaacaacgacuauuauauaggacuagauauggggacaaacucaguaggaugggcaacaacaaauccccaaggcagacuacuaagauucaacaagaaagauauguggggaucacgacuauucgaagaagcuaaaacagcggcaaaaaccagaacauucagaaccucuagaagaagauacgacaggguucgacaaagaauugaauuuuugcaagacauuuucgcaccuauaauagcgaagaaagauuuugaauuuuucaugagauugaaagaaucaaaauuucaccuagaagauaaaaagacagauggaaaauuugcacuauuuaaugaugcagacuucacugauguugaauacuuugacagguauccaacgauauaccaccuacgugcagcgcuaauuaaaccuaaccauauaacagaucccagacuccuauaucuggcaauacaucacauuaucaaaaacaggggccacuuuuuauuugcggguacagacauggaauccauaagaucauuccaaauagucuauacgcaacucuccgaacauuugaaaucaauuaaucuagacuucgaacuaccaguagaugcacaagacaaauuugcagcuauuuugcuaaacgaaaaauuaaacaaacgggacaaaaagaaacaacuaaaagaacuaugcccucauaaagauaaaagacuugaauacgccuuuaacgcaaucauaggaggaaaaaccaaacugaaagacauauucgggguagaagaauaugacgaaggcacuaagaaagcaguugauuuugaaaaagccgacuacgacgaagacaaagaugaaauagaaucaguaauaaaagaaaacauacacgugcucaaugcacuuaaagcaguauacgacuggacuauauuaaccaacauccuaggagauuaugcauacauaagcgaaucccaagucgccuuauaugaagcccacaagaaagauuuaagaauauugaaaucucuaaucaagaaauacgcaaaaagccaauacgcagaugccuuccgacacgaaaauguuaaaggaaacuacgcaaacuaugucggaucaacaaauuaugauaacaaacaaccaguuaucgacaacccaucgguaacgcaagaagacauaaacaaauacuucgcggauauccuauuaagcauuacuccagacgaauccgacagagaaucauaucaauacaucacagagagauuacacaaaggcgaagcauuaccaaaauugcgaacaaaagcuaacaguguauuaccacaccaaauacacaaaauagaacuagagaaaauacuugcaaacgcggccaaaaacuuuccauucuugcaagaaaaagacuccucuggauacaccgccgcacagaaaauaguuaaaauaaugauguuccgaauugaauacuacguaggaccgcuaaacacauaucaucauguagaucaaggaggacacgccuggaugguccgaaaagcugaaggaaaaauuacaccuuggaauuuugacgaaaaaguagacaaagaggcuucagccgaaaaauucauaagaaauaugacgaauaaaugcaccuaucuuauaggaaaagauguuauuccaaaacaaucacuucuauauucgcgauacaaaguacuaaaugaauuaaacaaccuaaaaguuaacggagccccaauaucaguagcgcuuaaacagaaaauauacgaagaacuuuuuaagaaacaaguaaacguuacuuucaaccaauuaaaaacauuuuuaaaaacgcaaggagaagaugccgaugaaauaauauuaucaggcguagaugaagcugcacacaaauucacuaacaauuuacaaacuuaccacaaauucagagcgauucucagagauaaaauagaguucgaaccccaacguucaaugguagaagacaucauaagauggaagugucuaaugggcgacgacaucacuauguggaaacauaaaauugaaaaagaauacggugaucaacucagcgaagaacaacucaagaaaauaacaagauuaaacuuuaacggauggucacgcuuaucgcaagaauuucuaacagacguaccuggaguagacauagaaaguggagagguauacucagggauaauggacgcuuuauggcgaaccaaugaaaauaucaugcaacuccuaagcagucgcuucacauucgcagcagaaguaaagaaacaaaaucaagguaccggaagaauugagaaaauaacauaugacgaagucaugaaagacaccuauuuauccccugcaguaaaaagaucgguuuggcaagccaucacccucguagaagagaucagaaaaaucagaaaagcggacccgaaaagaauauucguagaaaugacuagacagccagaugccaagaaagaacguaaacuuucacgcagaacacaacuauuaaaugcauauagagccauaggcaaugauaucgcagaauacgaaaaagaacacguaagcacauuaaucacccaauuagaaucgaagaaagaugaagaucuccgaaggaagaaacuauaccuauacuuuacgcaaaugggaagaugcauguauacuggggaaagaauagacuuaucaaguuuauuacgagauacuaauuccaacauuuaugacaucgaccauauauaccccaggucacuuaccaaagacgacuccuuagauaacaccguauuauguaagaaagaaauaaaucuuaagaaaggaaacaaauauauacacaggguauucacugacaaagagcucaagaaacaauaugguuauuggaaagcauugaaagagaagaaauuaaucuccgaacguaaauucaguagauuaaugagaacaacagaccugacagcugacgaauuagcaggauuuauuucacgacaauuaguagaaacaagucaaaugguaaaagcaaccgcagauauuuuagagaaaauuuacccgaauguaacuaucguuuauguuaaagcuagaacgguuucagauuucagacacgacuacgaacuaccaaaaguccgagcacuuaaugauugccaccacgcacaugacgcauauuuaaauaucguagucggaaaugucuauuaugaaaaauuuaccaaaucaccauuuagauucauagcgaaucaaaaagggaaaggagacaucaaauacaauuuauacagacuauucgauaaagauguaaaaguaggagauagaauuaucuggaacgcaaaagaagaccuagcaagaguuaaagcaacauuagagagagacacaguaaauguggugcguaugccagucgaacagagaggccaauucuuugaugcaacaauacagaagaaaggaacgacgaaaaacaugcuaguucuaccacuuaaaggaagcgacgaacgacuucaagauaccucaaaauauggauauuauguccggcccaguggaaugucguucaugguaguacaacacgaaguuaaaggaaaaucacgagucacaauagaaccugcuuuauuaguauauaaaaacaaacuuaaaagugaagacgauuacgcaaaauacugcgaagacguucucaaauuacaaaaaccaaaaguucuguucaaaaacauaaaauuuggaucgaagauacuauucgacggcuacccauuccuacugaaaggaagaacggaaaacagaauaauaauggcagacgcccaaaguuuauuucuugguaaucaagaacucaaaauacuaaagagaguaacaaaaauauccgacgauauagaccauaaaguugaaucacgaauaaaaauaacagacgaagaauggacaaccuuauggaaaaguguaguugagcagauaguuacugguaaauuucgaaauagacuaggcaccuuaaacgguauacugcaggguagaaaaauaaaauuauccaaagaugaagaggccagacugaacgaacuagauaguaaggaucaagaaacauuccucagucagauacuauuagaaagguuuuuacaauuuagcacagaagagaaaacuagacuccuauuacaaguuauaucauucucaggaaacacaacaggaguggaucuacgacuaauagguggcaguucuggaacagguacaauaaaaacuaacaaaaacaucacagaccacagcguuauccucauuaacgaaucacccacaggauuauucaccaacagaacgguuuuaaaccaaccuuga

SEQ ID NO: 5571 - RNA, 4176 nt, Artificial Sequence
  Cas9 variant
augaaacggaacaaugauuauuacauuggucuagauaugggaacaaauagugucggaugggcuaccacaaauccacaaggacgccucuuacgcuucaacaagaaagacauguggggaucacgauuauuugaagaagcgaaaacggcugcaaaaacaagaacauucagaacaucaagacgaagauacgacagagugcgacaacgaauagaguucuuacaggauauuuuugcgccaauaauugcaaagaaagauuucgaguucuuuaugcgacugaaagaaucgaaauuccaccuagaagacaagaaaacugauggcaaauucgcacuuuucaaugaugccgauuucacagauguagaauauuucgauagguauccaacaauuuaccacuuaagagcagcucuuauaaaaccuaaccauaucaccgacccuagacuauuauauuuagcuauucaucacaucauuaaaaaccgaggacauuuccucuuugccggaacugauauggaauccauacgcagcuuccaaaucguauauacacaauuaucugaacaccuaaaaaguauaaacuuggauuuugaauuaccaguagacgcacaagauaaauuugcagccauccuauuaaaugaaaaacucaauaaaagagauaagaagaaacaauuaaaagaacuaugcccacacaaagacaaacguuuggaauaugcguucaacgcaauaauaggggguaaaacaaaacuuaaagauauuuuugggguagaagaauaugacgaaggaacaaagaaagcaguagacuuugaaaaagcugauuacgaugaggauaaagacgaaauugaaagcguaaucaaagaaaacauacauguauugaaugcucuuaaagcgguauacgauuggacgauauuaacaaacaucuuaggcgacuaugccuauauuucagaaagccaaguagcacuauacgaggcacacaagaaagaccucaggauccuaaaaucauuaauaaagaaauacgcaaaaagucaauaugcagacgccuucagacaugaaaacgucaaagggaauuaugccaauuaugucggaucuacaaacuacgauaacaaacaaccagugauagacaaucccucagucacccaggaagacaucaacaaauauuucgcagacaucuuacuuuccauaacgccugacgaaucagacagagaaucuuaccaguauauaacagaaagauuacauaaaggagaagcccuaccaaaauuaagaacaaaagcaaacucgguauuaccacaccaaauacacaaaauagaacuagagaaaaucuuagcaaacgccgccaaaaacuuccccuuuuuacaagaaaaagacuccagcggauauaccgcagcucagaaaauagucaaaauaaugauguuucgaauugaauacuacgucggaccccuaaauacuuaccaccacgucgaucaagguggccacgcuuggaugguaaggaaagcagaagggaaaaucacaccauggaauuuugaugaaaaaguugauaaagaagccagugcagaaaaauuuauaagaaauaugaccaauaaauguacguaccugauuggaaaagauguaauaccaaaacaaucacuacuauauagcagauacaaaguccuaaacgaauuaaacaaucuaaaaguaaauggaguuccuauaucuguagcauuaaaacagaaaauauaugaggaacuauuuaagaaacaaguuaaugucacauucaaucaacucaaaacuuuccuuaaaacacaaggugaagaugcagaugaaauaauacucagcggaguugaugaagcugcccacaaauuuaccaauaaccuacaaacauaccauaaauucagagcaauccuuagggauaaaaucgaauuugaaccacaacgauccaugguugaagauauaauucgauggaaaugccuaaugggagaugacauaacuauguggaaacauaaaauugaaaaagaauacggagaucaacucucugaagaacaacuuaagaagaucacacgacucaacuucaacgguuggucaagauuaagucaagaauuucuaacagacgugcccggaguggacauagaaagcggagaaguauauaguggcauaauggacgcccuauggcgcacaaacgaaaauauaaugcaauuacuaagcaguagauucacauucgcagccgaaguaaagaaacagaaccagggcacaggaagaauugagaaaaucacauacgacgaagucaugaaagauaccuaucuaucaccggccguaaagcgaucuguguggcaagcgauaacccuagucgaagaaauaagaaaaauaagaaaggcggaccccaaacgaauauucguagaaaugacaagacaaccagacgccaaaaaggaacgaaaauuaucucgacguacacaauuauuaaaugcguaccgagcuaucggaaacgacauagcugaauaugaaaaggaacacgugucaacacuaauaacacaauuagaaucaaagaaagaugaagaucuaagaaggaagaaacucuauuuauacuucacacaaaugggaaggugcauguacacgggggaacgaauagacuugucaucucuuuuacgagauacaaacucaaacauauacgauauagaccacauauauccgaggagucuaacaaaagaugacagccuagacaauacuguacucugcaagaaagagauaaaucuaaagaaaggaaauaaauacauccaccgaguuuuuacagauaaagaacuaaagaaacaguauggguauuggaaagcacuaaaagaaaagaaacuuauuagugaacgcaaauuuucacgccucaugagaacaacggaucuaacagcagacgaacucgcuggcuuuauuucaagacaacugguagaaacaucacaaaugguaaaagcaacagcugauauucuagagaaaauuuaccccaacguaacaaucgucuacguaaaagcacgaaccgucucagacuuccgacaugauuaugaacuaccaaaaguuagagcucucaacgacugucaucaugcccaugacgccuaccuaaacaucguagucggcaauguguacuacgaaaaauuuacaaaaucuccauucagguuuauagcuaaccaaaaaggaaaaggugacauaaaauauaaccucuaucgacuauucgacaaagacgugaaaguaggagacagaauaauauggaaugcaaaagaagauuuagcacgaguaaaagccacauuagaacgagacacaguuaacguuguaagaaugccagucgaacaacgcgggcaauuuuucgaugcaacuauacaaaagaaagguacaacuaaaaacaugcuaguacugccuuuaaaaggaagcgacgaaagacuacaagauacaucuaaauacgguuacuacguacgaccaagugguaugucuuucaugguuguccaacacgaaguaaaaggaaaaucccgaguaaccauagaaccagcauuacuuguauacaaaaacaaacugaaaucagaagaugauuaugcaaaauacugcgaggacguauuaaaacuacaaaaaccaaaaguauuauuuaaaaacauaaaauuuggcucaaaaauauuauuugacggauauccauuucuccuuaaagguagaacugaaaaccgaauaaucauggccgacgcucaaagucucuuucuagguaaccaagaacucaaaauacuuaaacggguaacaaaaauaagugaugacauagaccacaaaguugaaucacgcauaaaaauaacugacgaagaauggacaacguuauggaaaaguguaguagagcaaauuguaacuggaaaauuuagaaauagacuaggaacccuaaaugggauacuucaagggcguaaaauaaaacugagcaaagacgaagaagcaagacuaaacgaauuagauagcaaagaccaagagacuuucuuaagccaaauauuacuagaaagauuuuuacaauuuaguacagaagagaaaacuagauuauuauuacagguuaucucauuuuccggcaacaccacagguguagacuuaagacuaauaggagggucgucaggaacuggcaccaucaaaacaaauaaaaacauaacugaccauuccguaauccuuauaaaugaaagucccaccggauuauuuacaaauagaacagugcuaaaucaaccauga

SEQ ID NO: 5572 - RNA, 4179 nt, Artificial Sequence
  Cas9 variant
augaaaagcauacucggacuugaucuaggcacaaccaguaucggaugggcacuuguaaaagaaucggaaaacgacaacgagaaaagugaaauagugaaacuggguguacgauuaguuccucuaacaacugacgaacguacagauuucgaaaaaggaaaaucaauuacgaccaacgcugaucgaacaaguaaaagaucaaugagaagaaaucuacaacgauacaaacuucgaagagaagcgcuaguaagcgaacuaaagaaagaacacuggauagaugaaggcuaucguuucucggaagauggcccaggaucaacguuuuccacucugcguuuacgagcaaaagcagcugaagaggagauaucacuacaagaucuagcuaaaguacuccuacaaauaaauaagaaacgaggauauaaaagcucgaggaaauuaaauagcgccgaagacggacaagcaauagacgguaugucaguggcaaagguauuauaugauaggggccuuacucccggugaauacgucuaucagcgaauguuagauggacaguaugcaauuccggaauuuuacaaaagcgacuuacaagcugaauuugacaaaauauggaacuuacagaaaucauacuacccagaauuaacagccgagcucuaugacaaauuaaccgauaaaaacaagucucaaacaugggcaauaugccgugaugaacucggaguacaaggauuuaaaucuucauuuaccgggaaagaaagauuaaaagaagcauauuuuaauagacaacaggcuucuaaacaaaaaguagauuuagaaguuuuaaccuguguucuccaagacauaaacggacaaaaagcgagucuuucugguuuauuaucugcaauaagugacagaucaaaagaacuguauuucaacaggaugacaguagggcaaauguuagugagacaaauacaagaagauccaaaucgcucacuucgaaauacaguguuuuaucgucaagacuacauugacgaguuugagaaaauauggucaguucaaaguagauuucaucccgaacuaacucaagaacguaaaaagaaauuaaaagacauuauaauauuuuaccaacgcccauugaaaucgcaaaaaggucuaauuagccucugugaauuugaaucccgugagguagauauaucaguggacggcguaauaaagaaaaagaaaauaggaccucgaguaugucccagaagcaguccuuuauuucaagaguucaaaguauaucagaccgugaacaacauuuuagucaacggugaaccacuugaugauaaugauagagaaaaauuagugggagaacuagcguucagagagaaaaugaaaggacaagaugugcugaaacuauuauauaaaacaaguaaagggaugagaaucaacuuugaagaaguagaaggcaacagaacaauggcaacaauucuaaaagccugugagaaaauaguagaaggacuaggguacgacacccgagacuuaagcaaaauaacagccucagaaaaaguaagccgaauagaagaaauuuucgccaaagaaggauuuaaaucugacuuucuccauuucgauaguucgcugcccucaccagaguucgaaagccaagcaucguacucacucuggcaucuguuauacaguuacgaaaacgacaaaucaguaucaggaaaugaaucuuuaguagagaaaauuaagaaauuaugcucaauggacgaagcuagcgcuaaaauauugucgggauguacauuucuuucagauuaugggucauuaucagcacgcgccaugagaaaaauacuaccuuauaugaaagaugggcuagaauacucugcugcaugugcaauggcuggauacaggcauucaaaaagauccuuaacaaaagaagaauuagauucacgaguuuacguagaucggcucgaauuacucccuaaaaauaguuuacguaauccaguaguagagaaaauacucaaucaaaugauaaaugucguaaauucaguuguagauacauauggaaaacccgacgaaauaagaauagaaauggcucgagaacuaaagaaauccgcuagcgaaagagaaaaagcacaaaaagauauagcugcagcgagcaaaguaaacgaaucaauuguagcaaccuuaaaagguucaccauuuuucauagacagucccucaagaaaugacauuauaagauauagguuaugggaagaauuaaaaccaaacggauacaaaacccuauauuccgggacuuauauacccaaagaaagauuauucagcaaagauuucgauauagaacauauaaucccacaagcccuucuauuugacgacuccuucgcaaacaaaacuaucgaaagucggcaaugcaauauugagaaaagcaaccgaacggcaauggauuauguaaaaaguaaauaugacaguuucgggguacaagcauauauagacaggguaaaagguuuaacaggaguaucaaaaacaaagauuacaagauuauuaauggaauccaaagauauaccagaagacuuuauaaauagagaauuaagagacucacaauacauugcgcgaaaagcacgcgaaauucuagaaucaauggucaaguucguagucccuacuaccggaagugugacagcucgcuuacgagaagauuggcaacuugugaaugucaugagagaauuaaacugggacaaauaugaaaaauuaggccuaacaucuuuucgcgaagauagggauggaagagaaauuccaguuauugaagacuggacuaagagaaaugaucauaggcaucacgccauggaugcguuaacaauugcuuuuacuagaaggcaauucauucaauacuugaaccaccuaaaugcaaagauagauacaguugauaaaacugauauagauuuaagagauuauaaucuagaagauauauccuuugacggauugagagauggagacaaauucgggauaguuaaagcccuacagaaaaaguaucuauauaaagaugacaaacaaaaauacagauucguaccaccuaugcccuuagacgaauuuagaaucgaagcuaaacgccaaaucgaagacguauuagucaguuucaaagcuaaaaauaaaguauguacuaaaaauguuaauacaacaaaaguucgagguggucaacaaagaaaaauacaacuaacuccuagaggaccguuacacgaagacaccauauaugggaaaagacuacaauauguaacaaaagaagaaaagguaggcgggaguuuugacgaagcaaagauagcuagugucugcaaaaagucauauagagaagcucuuaugagaaggcucauggaaugcggaggagacccgaagaaagcauucacagggaaaaauagccuugagaaaaacccggucuggguugaugaguuccacucaggagaaguuccccucagaguaagaacaguuucaauggcuagcguauauacuguaagaaaaagugucggucaaucuuuaaauauugaaaaaguauuagacaaacacauuaaggaaauucuucgggcucgacuagaagaauauggaggaaacgccucaaaggcauuuucgaauuuagacgaaaaccccauauggcuaaauaaagaaaaaggaauagcaguuaaaagaguaacaaucgauucaggcaaaaaucccaucccccugagauccaaacuagacaaagauggacaaaucauauacggcgaaggacaaaauccacaagaaucugauuuuguuguaccugguggcaaccaucacgcugcaauauacagaacgccaucaggaaaacuacaagacgugguagugucauucuacgaagcaguaaguaggaaaaaccuaggauuagaaguaauagaucgaaauuuuaagaaagacgaagguugggaguuucuauuuacuuuaaaacaaaaugaguacuuuguauucccaaauccagcaaccggauucucaccagaagauuacgauuugaccgacccagcaaacaacgcaaucauaucaccuaaucuuuaccgggugcagacgguaagcguaggugauuauagauuuagacaccaucuagaaacaacgguagaagauaaugaaaaacuaagagauauagcuuggaaaagaauaggcccaucuggcuuaguaggagcugucaaaguaaggauagacaauuugggacgaauauuagccguaggagaauaugauuga

SEQ ID NO: 5573 - RNA, 4179 nt, Artificial Sequence
  Cas9 variant
auggaaaacaaaaacuacucaauuggacuagacauaggaacuaauucaguuggaugggcugucauuacagacgauuauaaaguaccuucuaagaaaaugaaaguauucggaaauacagacaaacauuuuauaaagaaaaaucuuauaggagcacuauuauuugacgaaggugcaacagcagaagaccgaagauuaaaaagaaccgcuagaagaagguacacacgccguaaaaauagacuacgauaccuucaagaaauauucagcgaagaaauaaguaaacuugacagcucguucuuccaucggcuugacgauucguuccucgucccaaaagacaaaagaggcucaaaauacccuauauucgcaacauuagaggaagaaaaagaguaucacaagaaauuuccuaccauauaucacuuaagaaaacaccuagcagauuccaaagagaaaaccgaccuaagacucauauaccuagcgcuagcacauaugauaaaauacagagggcacuuucuauaugaagaauccuucgauaucaaaaauaaugauauacagaaaauauuuaacgaguucauaagcauauacgacaacaccuuugaagguucaucguuaucuggucaaaaugcacaaguugaagccaucuucaccgacaaaauuagcaaaucagcuaaaagagaaaggguauuaaaacuuuucucagaugaaaaaucaacgucauuauuuagcgaauuuuuaaaacuaauaguuggcaaccaagcagacuuuaagaaacacuuugaucucgaagaaaaagccccauuacaauuuagcaaagacacauacgaugaagaucucgaaaaccuccuuggacaaauaggcgauggauucacagacuuauuucuaguugcuaagaaauuauacgacgccauauugcucaguggaauacuuacaguaacugaccccagcaccaaagccccacuuagugcuucaaugauagaaagguacgaaucccaccaaaaagaccuagcagcucucaaacaauucaucaaaaacaacuuaccaaaaagauacaaugaaguauuuagugaccaaucaaaagauggguacgcuggguacauagauggaaaaaccacacaagaggcuuuuuacaaauacaucaaaaacuuacuuaguaaauuugaaggagcagacuauuuccuagauaaaauagaacgagaagauuuccucagaaaacaacgaaccuucgacaacgggucaauaccgcaucaaauacacuuacaagaaaugaacgccauacuaagaagacaaggagaacauuacccauuuuuaaaagaaaacagagagaaaauagagaaaauuuugaccuucagaauacccuacuauguaggaccacucgcuagaggcaauagagacuucgcuuggcuaacaagaaauagcgaccaagcuauaagaccguggaauuuugaagaaauugucgauaaagcauccucagccgaagaauuuauaaauaaaaugacaaacuaugaccuauaccuaccagaagaaaaaguacuaccaaaacauaguuuguuauaugaaaccuucgcuguauauaacgaauuaaccaaaguaaaauuuauugcagaaggucuacgggacuaccaauucuuagacaguggacaaaagaaacaaauaguaaaucaacucuuuaaagaaaaacgaaaagugaccgaaaaagacauaauccauuaucuacacaaugucgacgguuaugauggaauugaauuaaaaggaauagaaaaacaauuuaaugccagccuaaguacauaucaugaccuacugaaaauuauaaaagauaaagaauuuauggacgaucccaaaaacgaagaaauacuugaaaacauaguucacacgcuaaccauauucgaagacagagaaaugaucaaacaaagacuagcacaauaugauucaauauucgaugaaaaaguaaucaaagcucuaacaagaagacacuauaccggcuggggaaaacuaucggcaaaauuaauaaacgguauaugugacaaacaaacuggagauacaaucuuagauuacuuaauugacgauggaaaaauaaauagaaacuucaugcagcucauaaaugacgacggucucagcuuuaaagaaaucauccaaaaagcccaagugguaggcaaaaccgacgacgucaaacagguaguacaagaacuaccaggaucaccagcaaucaagaaaggaauauuacaaucuauaaaaauaguagacgaauuaguaaaaguaauggguuacgcaccagaaucuaucguaauugaaauggcacgagaaaaccaaacuacggcccguggcaagaaaaacucacagcaaagauauaaacguauugaagacucacugaaaaacuuagcaccaggccuagacucaaacauccuaaaagaaaauccuacugacaacauacaacuacaaaacgaucgacuguuuuuauauuauuuacaaaacggcaaagauauguacacggguaaacccuuggauauagaucaacugucaaguuacgacaucgaucacaucauaccacaagcauucauuaaagacgacucaauugacaaucgaguacuaacaaguucuaaggacaacagaggcaaaucagacaauguaccgucucuagaagucguacaaaagagaaaagccuuuuggcaacaacugcuagacaguaaacugaucagcgaacgcaaauucaauaauuuaacaaaagccgaacguggcggccuagaugaaagagauaaagucgguuuuauccggcgucagcuagucgaaacuagacaaaucaccaaacacgucgcccaaauauuagaugcaaguuuuaacaccgaaguaaaugaaaagaaccagaaaauacguacuguuaaaauaaucacccugaaaucaaaccugguaagcaauuuucgcaaagaauuugaacuuuacaaagucagagaaauaaaugacuaucaucacgcacacgacgcauaucuaaaugcaguagucgcaaaagccaucuuaaagaaauauccaaaacuugaaccagaguucguauacggggacuaccaaaaauacgaccuaaaaagauauauaaguagauucaaaccaucuaaagagauagaaaaagcaacugaaaaauauuucuucuacucuaacuuauuaaacuucuucaaagaagaaguacauuacgcagauggaauaauaguaaaaagagagaauauagaauacagcaaagauacuggagaaauagcuuggaacaaagaaaaggauuuugcaaccaucaagaaaguauuaucauacccacaaguaaauauagucaagaaaacggaaauccaaacacacggccucgacagagguaaaccaaaaggucucuucaacucaaacccauccccaaaacccagugaggauucaaaggaaaaucuaguuccaaucaagcagggcuuggacccucgcaaguacggaggcuaugcugguaucucaaacucuuacgcaguucuaguaaaagccauaguagaaaaaggcgccaagaaacaacagaaaaccauccuagaguuccaaggaauuucaauauuagacaaaaucaauuucgaaaacaauaaagagaacuaucuccuaaagaaacgauacauagaaauacuaagcacaaucacauuaccgaaauacagcuuauuugaguucccugauggaacccgaagaagguuagccucaauacuaucaacaaauaauaaacgaggagagauccacaaaggaaaugagcuagucuuacccggcaaauacaccacauuacuauaccaugcuaaaaacauaaacaagaaacucgaaccugaacaucucgaauacguagaaaagcauagaaaugauuuugcaaagcuauuagaaugcgucuuaaauuucaacgacaaauacguaggagcccucaaaaacggggaaagaauaagacaagcauucaccgacugggaaaccguugacauagaaaaacuaugcuucucguucauugggcccgaaaauucaaagaacgcaggauuauuugaacucacaucccaagggagcgccucagauuucgaauuucuugguguaaagauuccuagauaucgagacuaugccccaucaucgcuauuaaaagccacacuaauucaucaaucgauaaccggauuauaugaaacuagaaucgacuuaucaaaauuaggugaagauuga

SEQ ID NO: 5574 - RNA, 4179 nt, Artificial Sequence
  Cas9 variant
augaacaauaauaacuauucaauuggauuagauauaggaacgaacucuguaggaugggcuguaauaacagacgauuacaaagucccaucuaagaaaaugaaaguacuaggcaacaccgauaaacacuucaucaagaaaaaucuaauaggggcacugcuguuugaugaaggugcaacugcggaagauagacgauucaaaagaaccgccagaagaagauacaccagaaggaaaaaccgacuaagauaccuacaagaaauauuuucagaagaaaugaguaaaguggauucuagcuucuuucaucgcuuagacgacucauuccuaguccccgaagauaaaaggggaucuaaauacccaauauuugcuacccuagcagaagaaaaagaauaucauaagaaauucccaacaauauaccaccugaggaaacaucuagccgacucaaaagagaaaacugaccuaagacuaauauauuuagccuuagcccacaugauaaaauacagaggacacuucuuauacgaagaaucuuucgauaucaaaaauaacgauauacagaaaauauuuuccgaguucauuucuauauacgauaauacuuucgaaggaucaucacuauccggucaaaaugcacaaguagaagcuauuuuuacagauaaaauaagcaaaucagcaaaacgcgaaagaauacuaaaacuauuugcuuaugaaaaaucaacugaucucuucucugaguucuuaaaauuaaucguaggcaaucaagcagacuucaagaaacacuuugauuuagaagaaaaagccccucuacaauucucgaaagauacauacgaugaagaucucgaaaacuuguuaggccaaaucggagacgauuucgccgacuuauuccuaguugcuaagaaacucuacgaugcaauucuacugagcggcauacuaacaguaacugauucuagcacuaaagccccgcucagcgccucaaugauagaacguuaugaaaaucaccaaaaagaccuagcagcacuaaaacaauucauccaaaauaaccuacaagaaaaauacgaugaagucuucucagaccaaucaaaagauggauacgcaagauauauaaauggaaaaacaacacaagaggcuuucuacaaauacauuaaaaaccuauuaaguaaauucgaggguucugauuacuuuuuagacaaaauagagcgagaagacuuccuacgaaaacaacgaacuuucgacaacggaucaauaccgcaucaaauccaccuacaagaaaugaacgccauaauacggcgccagggcgaacacuauccauuucuuaaagaauacaaagaaaagaucgaaacuauauuaacauuuagaauaccauacuacguaggaccucuagccagagguaaucgaaacuucgcguggcuaacucguaacuccgaccaagcaaucaggcccuggaacuucgaagaaaucguugaccaagcaucaucagccgaagaguucauaaacaaaaugacaaauuacgaucuuuaccucccagaagaaaaaguuuuaccuaaacacucacuuuuauaugaaacuuuugcaguauauaaugaacuaaccaaagucaaauuuaucucugaaggacucagagacuaccaauuccuggauagcgggcaaaagaaacaaauagucaaucaacuguucaaagagaaaagaaaaguaacagaaaaagacaucauccaauacuugcauaacguagauggauacgacggaaucgaacucaaagguauagaaaaacaauucaacgcaucccuaagcaccuaccacgauuuacuuaaaauaauuaaagacaaagaauuuauggacgacccuaaaaacgaagaaauacuugaaaauaucguacacacacuaacgauuuucgaagacagagaaaugauaaaacaacgauuagcucaauaugcauccauuuuugauaagaaaguaaucaaagcacuuaccagaagacacuauaccggauggggaaaacuaucagcgaaacuuaucaacggaaucugugauaagaaaacagguaaaacgauacuagauuaccucauagacgauggcuauaguaaccgaaacuucaugcaacuaauuaacgacgacggacuuaguuucaaagacauaauacaaaaagcacaaguaguaggaaaaacaaaugaugucaaacaaguaguacaggaacuuccaggcaguccagcaauuaagaaaggaauccuacaaucgaucaaauuagucgaugaacucguaaaaguuaugggccaugcacccgaaucaauuguaauagaaaucgcccgggaaaaccaaaccacagcacgagguaagaaaaauucacaacaacgauacaaaagaauagaagacgcucucaaaaaucuagcaccaggacucgacucaaacauucuaaaagaacacccaacagauaacauacaacuacagaacgauagacuauuucucuauuauuuacaaaaugggaaagauauguacacaggagaagcacuugacauaaaucagcuaucaucauaugacauagaccacauaguaccucaggcuuuuauuaaagacgauucccucgacaacagaguucuaaccagcucaaaagacaaucguggaaaaagugacaauguaccguccuuagaaguaguacagaaaagaaaagcauucuggcaacaacuuuuagacaguaaacuuaucucagaacacaaauucaauaacuuaacaaaagcugaaagaggaggcuuagacgaaagagauaaaguaggauucauaagacgccagcuaguagaaacuagacaaaucacaaaacacguugcucaaauacuagaugccagauucaauacagaagucaacgaaaaagacaagaaaaaucgaacaguaaaaauaaucacucuaaaaagcaauuuaguuaguaauuucaggaaggaauuuaaacucuauaaaguuagggaaaucaaugauuaucaucacgcacaugaugcauaccuaaaugccgucgucgcgaaagcuauacuuaaaaaguacccaaaacuagaacccggauuuguauauggagauuaccaaaaauaugacauaaaaagauacauauccagaucaaaagacccgaaagaaguagaaaaggcaacagaaaaauauuucuucuauucaaauuugcuaaacuucuuuaaagaagaaguccacuaugcugauggaacaaucguaaaaagagaaaauaucgaauauucaaaagauacaggagaaaucgcguggaacaaagaaaaagauuucgcaacaauuaagaaaguacuaagccucccccaaguaaauauagucaagaaaaccgagauacaaacacauggacuugaucgggguaaaccacgcggccuauuuaacucgaacccaucaccuaagccuucagaagaucgaaaagaaaaucuggucccaaucaagcaaggacuagauccaagaaaauacggagguuacgcuggaauaucgaacucuuacgccguacucguaaaggcaauuauagaaaagggagccaagaaacaacagaaaacaguucucgaguuccaaggaauaagcauacucgauaaaauaaacuuugaaaagaacaaagaaaauuaccuucuagaaaaaggcuacauuaaaauucucucaacaauaacccucccaaaauacucuuuauucgaguucccagaugggacacggagaagacucgcgucuauacuaucuaccaacaacaagagaggagaaauacacaaaggaaacgaauuaguaauaccagaaaaauacacaacauuacuauaccacgccaaaaacauaaauaaaacacuagaaccugaacacuuagaauacguagaaaaacacagaaacgacuuugcaaaacuccuagaauacguuuuaaacuucaacgacaaauacgucggagcacuuaaaaacggagaaagaauccgccaggcuuuuauugacugggaaacaguagacauagaaaaguuauguuucucauucauaggcccacgaaauucgaaaaaugcaggacuauucgaacuaaccucacagggaucagcaagcgacuuugaauuucucggcguaaaaauucccagauacagggacuacacaccuucguccuuacugaaugcaacauugauucaccaaucaauaacuggacucuaugaaaccagaauagaucuaucaaaauugggagaagacuga

SEQ ID NO: 5575 - RNA, 4179 nt, Artificial Sequence
  Cas9 variant
augaaaaacuaccacauaggacuagauauaggaaccaguuccguaggcuucgccgcaagagaugacgaaaacaauuuaauacgaguaaaaggaaagaacguaauaggcgcuagauuauucgcagaaggaaaaacagcccaagaacgaagaauggcuaggaccucaagaagacgauauaacagacggaaguggagacuaagauuguuaaaugacauuuuucacgacgaaauagugcauaaagauaaagauuucuuuaauaggcuaaagcaaaguaguauuaguccaaaagacgaccgaaagaaauacuuugguucucuccuauuuccagagcuaagugacucggaguucuaucauaacggaaaccaaacuaucuaucauuuaagacaccgauuaaugacguccaaugaaaaagccgauauaagagaaaucuauuuagcacuacgacauauaguaaaauauagaggcaacuuuuuggaugacacgcccgucagcucuuuugaagccucagacuuaaaacuugguucauucauuccuacauugaaugaucuauucgaaacaauagacguaaauuacguguuuaauuccgaaaacacaaaccaaaucgaaagcauccuacucaauaacgaucuccgcaacagcgauaaauccaaacagcuaguagauuuauuauaccguaacguuuccgauguagacgacaaauccuuagaaaaacaauuuaacaaauucagaaaagacauuucaaaagaaauagcaaaaucauuuguaggauccaaauucaacguaaacaaauugcuugcuuaugaaacagacgauggaagcaaaaucucccuaucuuucucugacgccucuucugaugauaaaaugcuagaauuagcagacaaccucgaugacgaacgaauuaauauacucaacgcacuaaaggucaucuauucaagaguucgucuuaaccaaauaauacccaacggcaugggacucucagaaucaaugauagcaagcuaugaacuccacaagaaacaacuaaaugacuuaaagaaauuguuaaacguacuaccuuuccaugaaaaauaugcaguaaaaguagcauacgcagcauauaucggaaacauggaugcacagaaauucacucaagcagaacugaguacaaucgaaucacuaaaagaaaaagacaguaucaagaaagucauagacugcaaaacaggucauauaacgaaugaaagucucauauccguuauuaaccaaauaguaguuaauccauauuuagaaaacuccgacuuugagcuaauagauauuguaaagaaaauagaucaagauaucaaaaauggcgaauaucuauuaaaacagcgaaauaaccaaaacggcaauaucccacaccaauuacaccaaauggaaauggaucaaaucauagaaaaacaaagcaaauacuacccauuccuuggcgaacuaaaccccaacgaaaaccgacgucacaucgcaaaauacaaaauuucggaacucguagcguuuagaguucccuauuacguaggaccauugauaaccccagaagaacaagcaaaaacauccggggcuagcuucgcuuggaugaaaaggaaagaagacggagaaauuaccccuuggaacuucgaccaaaaaguagacagagaagcaacagccucaagauucauaaaaagacuaacagucaaggacacuuaucuguucaaugaagauguuuuaccagauaauucacuccuauaccaacaauucaaaguacuaaaugaguuaaacguaguaaaagucaacaacaaaagguuaucgcaagccgaaaaacaaggagcauucaacgaccucuucaaagucaccaaaacagucaccgcaaaaagacuuaaaaauuaucucguauccaacuuuaaccaucuagacacaauagaaauuacaggacuaucagacggcgaaaaauuuaauaauggacuaacaagcuauguagauuuucagaaaauauuuggcgauaaaauaaauaaccucgaauuaauggacgacuuugaaucauuaauugaauggucaaccguguucgaagaccgacauauuuuugaagaaaagguuagaaacgaaauaaacuggauuagugaaagcgaauuaaaacaauuaguagcaaaaagguauucgggauggggacgacucucaaguaaauuacugguuggcauaaauaacgaugaaggucgcaauauaauagaacaauuauuugaaacaagcgaaacauuuauggaggccauaucaagaccugaaguuaagaaacaaauagaugaaauaaacuccgauuuuaucaaaaacacagauaucgaaagcguauuagcagacgcauauaccucuccacaaaacaagaaagcaauuagggaaacguacaaaaucguaaaagauauacaaaaagcaaugggcgggaaagccccugaaucaauaucaauagaguucacccgaaacccagaagacaaaggugaacuuacucguaguagacacucagaaaucucuagaaaauacaaagaauuaucaaaagaaaucagcaaagaacuaaaugaugaguuaaaaucuaagaaaaacagcauggacauagauaaauauuacuuauauuucaugcaaauggggaaagaccuauaugauggaaaaucaauagauaucgaugaucuaaauaacuaccaaauagaccacauaguaccacagucuuuuuauaaagacgauucauuugacaacagaguguuaacuuauuauacaaacaaccagaagaaaggcaauaacacaccccuaaauggccuaaacauaucaaaugaaaccagaaaauuauggagccaccuccaugacuuaggucugauaagcaaacgaaaauaucuaaaccucacuaugcaagguuuagacucauuaucaaaauacacaaaacacgguuuuauuagacggcagcuaguugaaaccucccaaguaauaaaacugguagcuaauauccuaagcgacgaguucucagccgacaacaccaaaauaauugaaguuaaagcaaaaaugaauagccaaaugagacauaguuucaaccucuacaaaauccgagaacuaaacgauuaccaucacgcucuagaugcauacuuaacaacauuuauaggaggcuaucuauauaauagauaccccaaacuccgagguauguucguauacggugauuucaagaaauucgacguaaaugacgccaauaacguaaaaacccugaacuuuuuacacgauauuacuaauccaagugauaaauucguaaaccaaaucuacgacgaacaaucaggagaauuaauucuagauagaaaacacgcgaucgaaacaauaaagaaaauauaccaauacaaauuuaugcuaauaacacgugaaguaaguaccaaagacgacaaacuaagugaccaaacaguauauucggcaaaaagaauaaacaacguugcaagcccgauaccaguuaagaaagauucaaauccagaacuauauggauuuagaacaggcaacguagaccaccacaugguuauaguuaaauacccaaagaaagauucuuuuguauacaaaguuguuggcauacccaucagauucaugcaagaauuacgaagcucuaaaaaccaaagugaauaugaaaacacacuaaaccaaauaguacaagcaaaauuaaacagaaagaaauuugacuuccgaguagugguugacaauguuauguacggccaauuaauucaagauggaggccaaaaauuuacccuugguagcuccacauauagauacaacgcuaaacaacucguccuugauauggauucacucaggauauuaagcgacgaaaaauacagaaacucauuaacugacgaugagaaaaauucagaauuuauuaacauauaucaacaaguacucaauguaguaaacgaaaaauucgacguuuucgacgucaggggcacacgagauaaacugacaaaaggauuagacaaauuccuaaacaucacaucgaaugacaaagagauuguacucuuaaaaauacuaucaggucuacacugcaaugccgcccgaguaaaaauaaacgaaauagggauaaauacuucauuuggcgagcuacaaaccacucacggaauuguucuaucagaaaacuccuauauaauauaccaaucucccucaggacuauucgaacguaaagucagacuaaaagaucuauga

SEQ ID NO: 5576 - RNA, 4179 nt, Artificial Sequence
  Cas9 variant
auggcaaauaaaacuugguaccuagguuuagauauaggaagcgcaagcguaggcugggcagcaacggacacgggauauaaaauaauacguaaaaacaagaagcgauuauggggaguuagacuguucgaagaagcuaaaaccgccgaagaucgaaggggauaccggucaaguagaagaagauuagcacgcagaaaauggagauuaaacuugcuagaagaguuauuuacaagcgagguaaaaaaaguagacgaaaauuuuuucuuaagauuaaaagaaucgcaauaccauuacgaagauaaaacgcacaaggugccauacgccauuuucaaugacaaagacuauacagacaaagauuacuauaaagacuacccaacaauauaccaucuaagaucaaaacuaaugacugaagaaaauccagacauaagaaagguuuuccuagcaauccaucauaucaucaaaaaccgcggacacuucuuacuacaaggacaaucauuuaaagauggcaaccuaaauaaucucauaaaagaacucuuagaauuggauauauuacaugucggguuugaaguaacagaagaagucguagacaaaauagcagauauaaguuuggagaaaaagacaucgaaagauaaacuuaacgacaucaaagaacuauauccuaaagaaaaacaacuuuuagaaguuuucaggcucauauucggaggcaaaacaagucuagauaaacuauuugcuauagacgaauauaaagaacuggacgcagcuauaaagaguguaaguuucaaagaaaaaauuuaugaagaaguuagacacgauuaugagcaaguccuaucaaauuauauagagcuucucgacuuggcaaaacuaguuuacgauaguauaauucuuucagacauaaagaaagaggguaaaacacuaagcgaaagcaaagucgaauuauucgaaaaacauagagacgaccucuugaaacuaaaaaauuuaguaaaaaacgacucaaaacuaucagaagacaaaaaaguugaacuuuacgcacuaauauuuaaagaagauaaagacaaagguacaaacuacguuaacuauauaagaaagagcgaagaaggaaaagggugcaacuacgaagauuuuaaaaaguuucuuguaaaagaauuagcaaaacuagaagaaaguuccguaaaaacugaaauaauaaaggaccucgaacuggaacaauuucucccgcuacaaaggaccaaagacaauagugucguaccauaucaaauccauaaagaggagcuugugaaaauauuagacaaugcagcuagauaucauaguuuccuuaacgaaaaagacgaaaguggcuauaauguaagagaaaaaguuauacaauuauuagaauuucguauucccuacuauguggggccauugaauaguagcaaaaaagcaaaagagggaggauucgcauggaguguacgaaauacggguuacgaaaacacaccaguuacaccauggaacuacaguaaaguuaucgacgaaagugcgucagcagaaaaauucaucaccaaccuaacgaacaaaugcacauacuuaaaaggagaggacguucugccaaaaaguagucuauuauacucagaauucgcauuacugaaugaacugaacgcuuuaaaauaugacgguaaccgaaucucucuugaagcaaggaacaccaucauagaaaaauuauuuaaacagcaaggaaagaaagugacuaaaaccucaauuaaaaauuuacuaaaagccgaaggauauauagauggaaaaggcgaaauaacaggcauugacauuacagucaagaacgacuuaaagucauauagagacuuuaaaaaaauauuaggaaauaaauucaauuccgaacacguagaaaacauaauauuauggaucacacuauauggagaaagucgaaaacugauaaaggccaaaaucgaaucaguauacggagaaguauacucaaaagaugagauaacuaaaaugagcagauuggucuauaaagacuggggcagauucagccguaaacuucuaaccgaauuggucucgaaaaaauuauacaaugaagaaacuggagaaugccugaacaucauaggagcaaugagacaaaacaacauacuguucauggaacucuuagcagacagauuugacuacaguaaacaaauagucgaauuuaauaaagaauuacaagaagacgugaccgaaauugcaccagaaauauuggaugaccucuacguuagcccagccguaaaaaggucaaucuggcaaacaguaaggauagucgaagaacucaaaaaaauaauaggaugcgcucccgccaaaauuuucgucgagaccacacgcagcaaccaagagaaaaaaaaaccaacagacaguagaaagaaacaacuggaacucgcauacaaagccguaaagaaagaugucaaagaguuagaaaaagaaauuggcacaauaaauuucgauguacuaaacgauagacuaaguucaguugaaccaaguaaacuaaaagcaaaaaagcucuaccuauacuacacucagcuaggaagauguauguauagcgaagagccuauuaauauuucugaauuauucgacaauaauaaauaugacauagaccauaucuacccccaguccaaaaucaaagaugacucauucaccaauacgguacuuguuaaacgcgaaucaaacgcugcuaaaacugacagguacccucuaggcucugacauccaaacacccucuaacaggagguucuggaaguucuuaaaggaaaaaggacugauaucggaugagaaauacaauagguuggugcgaacugaagaauucucugaugaagaacuuucagguuucauagcacgucaacucgucgaaaccucacaaucaguuaaagccguagcuucaauacuaggagaacuaaacccagaaacuucuaucugcuauaguaaagcagaaaacguaaguagcuuuagacaaaacuucgguaaaauaaaaaagggugaccgcgauagcaaaaacaacgaucaacuaauaaaagucagagaaaucaaugauuaccaucaugcaaaagaugcauaccucaauguaguaguaggaaauguauaugauacaaaauucaccagaaacguuuuuaacuuuauaaaagauaaaaaagacggacgcaaauauucacuaaauaaaguuuuuuaugaaaacguuagugacuccaaaaccguugcaugggaaauggauaaaaccauacaccaaguagaaaaaguaaugaauaauaacaacauaaugguaacgagaagaaccucagaacagaaaggaggccuauuugacgcaaccguauacaaagcaaaaguagcggcgaaagcaaaagauggcguauacuauccauuaaaaaccucaaacagcguagucaaagacguugcgaaauauggaggauacacgucaauaggaaucgcauauuacaguaucuucgaauacacgaucgucaauaaaaaaggagaagagaaaauaacaagaauaaucccaauuccaauauauauaagccaaaauaucaaagauaguacugcucuaauugaauuuggaaaaagccaaauuuuuugucgagcauacgaaaagauaaaagacuuuaaauuacuguaccguaaauugugcauagguucuaaaauaaacauaaacaacuaccaauacuacauaggaggaaaaagcgaugaaagauucuauuacgacucagcaauucaaguuacguuagacaaaaaaagcgagaaauauuugaaaaucuuaucuaaauaccaaaacuggaaaaaagaaaacaaagacggagaacuaugggaaaacaucacaaaagaaaacaauauagaacuauauaacaaacuuguggaaaaaaugaauagcgaaauauucacaaaaaaaaaaagcaacaaauacaaugaacuuaacagugaggaaauuagaaacaacuuuauaaaaauauccguagaagagcaagcuaaaguacuucucgaaauauuaaaccuacuaacaaauaagaaauccauauuugaccucaaaucaauugacauaaaagcagcacgugggaagauuucuuuuaaccuuaccucacucauccaauucuccaucauagaacaaaguauaacgggguucuacgaaaaagaaaucaccauaauuggagacaaaggaaacgacauggagaauaauaacaguuga

SEQ ID NO: 5577 - RNA, 4179 nt, Artificial Sequence
  Cas9 variant
augaacaacaacaacuauucaauaggauuggacaucggaaccaauagcgugggaugggccgucauaacugaugacuauaaaguaccaucaaaaaaaaugaaaguacuagguaacacagacaaacauuucauaaaaaaaaaucuaauaggcgccuuacuauucgaugaaggaaccacagcggaagaccgcagacuaaaaagaacagcgcgaagacgauauaccaggcguaaaaacagauuacgauaccuacaagaaauauucucaccagagauaaguaaaguggacucaucauucuuccacagacucgacgacucuuuucuagugccagaagauaaaagaggauccaaguauccaauuuuugcaacacuugcagaagaaaaagaauaccauaaaaacuucccaacaauauaucauuuaagaaaacaacuagccgacucuaaagaaaaagcagauuuaagacuaaucuauuuagcacucgcccauaugaucaaauauagagggcauuuucuauaugaagaaagcuuugauaucaaaaauaacgacauacaaaaaauauuuaacgaauucaucucaauuuaugauaauacuuuugaaggcucaucucucagugggcaaaacgcccaaguugaagccaucuuuacagacaaaauaagcaagucagcaaagagagaaagaguuuuaaaauuauucccagacgaaaagucaacaggacuauuuucagaauuccuuaaacucauagucggaaaccaagcagaauuuaaaaaacacuucgacuuagaagaaaaagccccucuacaauucuccaaagacacuuacgacgacgacuuagaaaaucuacuaggacaaauuggagauggcuuugcagagcuauuuguagcagcuaaaaaauuauacgacgcaauacuacuaagcggaauuuuaacgguaacagacccaaguacuaaagccccacucucugcgaguaugauagaaagauacgaaaaccaccaaaaagaccucgcggcuuuaaagcaauuuauacaaaacaaucuacaagaaaaguaugacgaagucuucucagaucaauccaaagauggauacgccggauauauuaauggcaagacaacacaggaggccuuuuacaaauacaucaagaauuuacuaaguaaauucgaaggaucggacuauuuucuagauaaaauagaaagagaagauuuccuuaaaaagcaacgaaccuucgauaaugguucaauuccacaucaaauacaucuucaagaaaugaaugcaauaauccgcagacaaggugaacacuauccauuccuacaggaaaauaaagaaaagauaaaaaaaauauuaacauuccgaauucccuacuauguagguccauuggcaagaggaaauggagacuucgcauggcuuacuagaaacagugaucaagccauccggcccuggaacuucgaggaaauuguagaucaggcauccagugccgaagacuucauaaacaagaugacaaacuaugaccuuuacuuacccgaagaaaaaguacuaccaaagcacagcuuacuuuacgaaaccuucgcuguauauaaugaacuaacgaaaguaaaauuuauagcagaaggcuuaagagacuaccaauuccucgauucuggacaaaaaaaacaaauagucaaucaacuauuuaaagaaaaacgaaaaguuacggaaaaagacauaacucaauaucuacauaacguagaugguuaugacggaauagaacuaaaagguauagaaaaacaauuuaacgcaucuuuaaguacauaucacgauuuacucaagauaauuaaggacaaagcauucauggacgaugcugaaaacgaagcuacacuugaaaauauaauacacacacuuacaauuuuugaagacagggaaaugauaaaacaaagacuagcacaauacgacucacuguucgaugaaaaaguaaucaaagcucuaauaaggcgccacuacacaggaugggguaaauuauccgcaaaacuuaucaacggcauuugcgauaaaaaaacgggaaaaacaauccuugauuacuuaauagacgauggauauucuaaucgcaacuucaugcaacucauaaacgaugacggacugucauucaaagauauaauccaaaaagcccaaguaguaggaagaaccaaugacguuaagcaaauaguucacgaguuacccggaucuccagcaauaaagaaaggcauccuucaaucaauaaaaauagucgacgaauuaguaaaaauaaugggucauacucccgaaucaauaguaaucgaaauggcacgagaaaaccagaccacugcgagaggcaaaaaaaauucccaacaaagauacaaacgcauugaagaugcauuaaaaaaccuagccccgggacucgacagcaacauuuuaaaagaauacccaacugauaacauccaauuacaaaaugacagauuauucuuauauuaccuacaaaacggcaaagacauguacacuggagagccuuuagacaucaaccagcuuaguaguuacgauaucgaccauauaguaccucaggccuuuaucaaagacgauagucuagacaauaggguccuaaccagcucaaaagacaaucgaggaaaauccgauaacguuccuagucuugaaguuguccaaaaaagaaaagccuuuuggcaacaacuucuggacaguaaauugauuagcgaaagaaaauucaacaaucuaaccaaagcagaaagaggcggccuagacgaacgagacaaggucggcuuuauucguagacaauugguggaaacaagacagauaacaaagcacguagcacaaauauuagacgccagauuuaacaccgaaguuacagaaaaagacaaaaaaaaucgcaauguaaagauuauaacgcuaaaaagcaaccuagucaguaauuucagaaaagaauucaaauuauacaaaguacgagaaaucaacgacuaccaccaugcacacgacgcauaucuaaacgcaguaguagcaaaagcaauauugaaaaaauacccuaaauuagaaccagaauuuguauacggugacuaccaaaaauacgaccuaaaacgauauauuucuaggucaaaagaucccaaagauguugaaaaggcuacagaaaaauacuuuuucuauagcaaccuucuaaauuucuucaaagaagaaguucauuaugcggacggaacaauuguaaagcgagaaaacauugaauacaguaaagauacaggugaaauagcauggaauaaagagaaagauuucgcaacuauuaaaaaagugcuaucacuuccacaaguuaauauuguaaaaaaaacagaaauacaaacacauggacuugauagagguaaaccacgcggccucuuuaauuccaauccaagcccaaaaccgagcgaggauagcaaagaaaaucuaguaccaauaaaacaaggcuuagacccucggaaauacggcggguaugcaggcaucagcaacagcuacgcagucuuaguaaaggcaauaauagaaaaaggcgccaagaaacaacaaaaaacgguauuagaauuccaagguaucucuauucuagauaaaaucaauuucgaaaagaacaaagaaaacuaccuacuagaaaaagguuacauaaaaauucuaucaaccauaacucuaccuaaauacucacuauuugaauucccagaugggacaagaagacgacuagcaagcauccugagcaccaauaacaaaagaggagaaauucauaaggguaacgaacucgucauaagcgaaaaguauacaacucucuuauaccacgccaaaaauauuaauaaaacuuuggagcccgaacaccuugaauacgucgagaaacauaggaacgauuuugccaaguuacuugaaagcguauuagauuucaacgacaaauauguaggagcauuaaaaaacggagaaaggauucgacaagcauuuaucgacugggaaacaguagacauagaaaaauuaugcuucagcuucaucgguccgagaaacuccaaaaacgcaggauuauucgaacucacaucacaaggaagugcaucagacuucgaauuccuaggaguaaaaauuccacguuauagagacuauacaccaucaucucucuuaaacgcaacauuaauacaucaaagcaucacaggacucuacgaaacaagaauagacuuaucaaaacuuggugaagauuga

SEQ ID NO: 5578 - RNA, 4179 nt, Artificial Sequence
  Cas9 variant
augaauaacaacaacuauucgauuggcuuggacauaggaacuaauucaguaggaugggcaguaauaacagaugauuauaaaguacccagcaagaaaaugaaaguacuagguaauacagacaaacauuucaucaagaaaaaccuaauaggugcauuauuauuugaugaaggagcgacagcagaagauagacguuuuaaaagaacagcacgcagaagguauacuaggcggaaaaauagacuucguuauuuacaagagauauucucugaggaaaugagcaaaguagacaguaguuucuuucauagauuagacgacucauuccuaguucccgaagacaaaagagggucaaaauacccuauauuugccacguuagccgaagaaaaagaauaccauaaaaaguucccgacuauauaucaccuaagaaaacaucuugcagauuccaaagagaaaacagaccuaagauuaauauauuuagcguuagcucauaugauuaaauaccgaggacauuuccuauacgaagaaucuuucgauaucaaaaacaacgauauucagaaaauauucucagaguucaucagcaucuacgauaacacauucgaaggcaguucacugagcggacaaaacgcacaaguagaagcaaucuucacagauaaaauaucgaaaagcgcuaaacgagaacgcauccuaaaacuguucgcauacgaaaaaucaaccgaucuauucucagaauuucuaaaacucauaguaggcaaccaagccgacuucaagaaacauuuugauuuagaagaaaaagcaccauuacaauuuucaaaagauaccuaugacgaagauuuagaaaaucuacucggacaaauaggggaugacuuugcagaucuuuuucugguugccaagaaacuuuaugacgccauccugcuaucagggauacuuaccguaacagauucaucaaccaaagcaccacugucagcuucuaugaucgaacgcuacgaaaaccaccaaaaagaccuagcagcauuaaaacaauucauacaaaauaaucuacaagaaaaauacgacgaaguauucucugaccaauccaaagaugguuacgcaagguacauaaauggcaaaaccacccaagaggcuuuuuacaaauacaucaaaaaccucuuaucaaaauuugaaggcagugacuauuuucuggacaaaauugaacgagaagacuuucuaagaaaacaaaggacauuugauaacggauccauaccgcaucaaauacacuugcaagaaaugaaugccauaauacgacgccaaggcgaacauuacccauuucuaaaagaauauaaagagaaaauagaaaccauucucaccuuuagaauacccuacuacguaggaccgcuugccagagggaacagaaacuuugcauggcucacccguaacagcgaccaagcgauaagaccauggaacuucgaggaaauuguagaccaagcaucauccgccgaggaguucauaaacaaaaugaccaacuacgaucuauacuuaccagaagaaaaaguucuuccuaaacauucacugcuauacgaaacauucgcaguauacaacgaguuaacaaaggucaaauucaucuccgaaggacuacgugauuaucaauuucucgacagugggcaaaagaaacaaauagucaaccagcuauuuaaagaaaaacgaaaaguaacagaaaaagacauuauacaauaucuccacaacguugacgguuaugaugguaucgaacuaaaaggaauagaaaaacaauucaacgcgagucuuucaacauaccaugaucuauuaaaaauaauaaaagauaaagaguuuauggacgaucccaaaaacgaagaaauacucgaaaauauaguacauaccuuaaccaucuuugaagauagagaaaugauaaaacaacgacuugcacaauaugcaucuauauucgacaagaaagugaucaaagcgcuaacgagaagacauuauacugguugggggaaacuuucagcuaaacuuauaaauggaauaugugauaagaaaacaggcaaaacaauacuagacuaccucauagacgacggauacaguaacagaaacuucaugcaacucauaaaugacgacggcuuaucauucaaagacauaauacaaaaagcacaaguugucggcaaaacaaacgacguaaaacaaguaguacaagaacuaccaggcagcccugcaaucaagaaaggaauacuacaauccaucaaauuaguggacgagcuaguaaaagucaugggacaugcgcccgaaucuauagucauagagauugcuagggaaaaccaaacuaccgcccgagggaaaaagaauagccaacaacgauauaaacguaucgaagaugcgcucaaaaacuuggcaccaggauuggauucgaacauuuuaaaagagcaccccacagacaauauacaacuccaaaaugaucgacuauucuuauacuacuuacaaaacggaaaggauauguauacaggagaagcccuagauaucaaucaacucucaucuuaugacauagaucauauagugccacaggcuuucauaaaggacgacaguuuagacaaccgaguacucacaucaaguaaagacaaucgaggaaaaagcgacaacgugccaagucucgaaguaguacaaaaacgaaaagcguucuggcaacaauuauuagacuccaaacucauaucggaacauaaauuuaacaaccucacaaaagcagaaagaggaggacuagacgaaagagacaaaguaggcuucauacggcggcagcuaguagaaacacgacaaauuacuaaacacguggcacaaauucucgacgccagauuuaacacagaaguaaaugagaaagacaaaaagaauagaacuguaaaaauaauaaccuuaaaaucaaaccuuguauccaacuuccgcaaagaauuuaagcuauacaagguccgcgagauaaacgauuaucaccacgcacaugacgcuuauuuaaacgcaguuguagcuaaagcaauacucaagaaauacccuaaacuagaaccagaauuugucuacggagacuaucaaaaauacgacauuaaaagguauauaucuagaagcaaagacccuaaagaaguagaaaaagccacugaaaaguacuucuuuuauucaaaucuacuaaacuucuucaaagaagaaguucauuacgcagacggaacaauaguaaaacgugaaaacauagaauauucgaaagacacaggcgaaauagccuggaauaaagaaaaagauuuugcaacaaucaagaaaguccucagccuaccacaaguaaacauugucaagaaaacagaaauacaaacacacggacuugacagaggcaaaccccgaggacucuuuaacuccaauccaagccccaaaccuuccgaagauaggaaagaaaaucuaguaccaauaaaacaaggacuugauccccgaaaauacggcggauaugcagguauaucaaauucuuaugcuguccuaguuaaagcaauuaucgaaaaaggagccaagaaacaacagaaaacaguacuugaguuccaggguauaucaauacuagacaaaauaaacuuugagaaaaacaaagaaaauuaccuacuagagaaaggguauauaaaaauacucucuacuauaacucuacccaaauacuccuuauucgaguuccccgaugguacucgccggcgcuuagccucaauauuaucaacuaacaauaaacgaggagaaauacauaaaggaaacgaacuuguaauaccagaaaaauacacaacucuauuguaccacgcuaaaaacauaaauaaaacacuagaaccagaacacuuggaauacguugaaaaacaccgaaaugauuucgcaaaauuauuagaguacguccucaauuucaaugauaaauacgucggugcacucaaaaacggagaaagaaucagacaagccuucauagacugggaaacaguagauauagaaaaacuaugcuucucauuuaucggcccaaggaacaguaaaaacgcaggacucuuugaacuuacuucacaggguucugcguccgauuuugaauuucucggggucaaaaucccaagauaucgugacuacacaccaucaagccuccuaaaugcaacacuaauacaucaaucaauaacuggacuuuaugagacuagaauagaccuuucaaaauuaggugaagacuga

SEQ ID NO: 5579 - RNA, 4182 nt, Artificial Sequence
  Cas9 variant
augaaaagaguuacugaagauuauauccuuggauuagacauuggaacuaacuccuguggaugggcagugaccgauaagaaaaacaaucuauuaaaauuaagaggaaaaaccgcaauagguagccacuuauuugaagaaggucauacggcagcggaucgcagagguuuccguaccaccaggagacgccuuaaaagaaggaaauggagauuaagacuacuagaagaaauauuugccgagccuauggcaaaaguagauccaggauucuucguucgauugcaccaaagcugggucucaccacuagauaaaagccguaagaaauaccacgcuaucgucuucccaacggccaaagaagauaaagcauucuaccaaaaauauccgacaauauaccaccuaagagacgccuuaaugacacaagauagacaauuugacuuaagagaaauauuccucgcaauacaucauauagucaaauucagaggaaauuuccuucaagacacaccagugaaagauuucgaagccaguaaaaucgaaguuggaccaauacuuucaaaaaucaacggugcauuugcugagaaaauaguugaagaucaagacccaauugaacuaaacguagcaaacgcagcagaaaucgaagcaguaauuagaggaaaagacgcggacaaaacccucuauaaaauggauaaagucaagaaaauagcaaaauuacucaccgacaguacagcaaaagaagagaaaaacgucgccaaacaaaucgcaaaugcaguaaugggauauaaaacacaauuugaaacaauuuugggcaaagaaauagauaaaucugauaaagcacaaugggaguucaaauuaacggacggagaugcagacgauaaauuagaagcauuauuaccagaucuugacgaaaaugaccaaacgauaauugcagaaaucaagaaauuauuuuccgccauuacacuuaguacuauaguugaugaaaacaaaucccuuagccaaagcaugguggcaaaauacaauaaacaccaccaagacuacaaauuacuaaaagccuacauagacacacuacaagaccgcucuauugccaagaaacuacuacuugcuuaugaccucuacguaaauaaccgccacggucgacuacuagaagccaaaacugaguucaaacaagaugguacacucaccaaagaagauuucuacaaaacuguaaaagauaaccuagacgauagugaacuugcacgaaaaaucgcacagaaaauugcagcagacaauuuuaugccaaaacaaagaacaaauagcaauggaguaauaccauuucaauuacaucaaauagaacuugacaaaauuauagccaaucagucaaaauacuauccauuucuagcagcugaaaauccuguugaagaccacagaaaacaagcuccauauaaacuagacgaauuaguacgauuuagaguaccauauuaugucggucccaugauuacaccagaugaacaagagaaaacgagcggaaaauccuuugcauggaugguucgcaaagaagacggucaaauaacaccuuggaacuuugaacaaaaaguggauagacaagaaagugcuaacaaauucauaaaacgaaugacuaucaaagacacauaccuucuuggagaagauguacuaccagcuaacucucuacuuuaccaaagguucgaaguauuaaaugaacuaaauaacauacgaauaaacgggucacgaaucucaauugaccugaaacaacaaauauuuaacgacuuauuugaagagaagaaaacgguaacagaaaaaucucucacgagcuaucuuaaacaaaaucuacauuuaccaacaguugaaauaaaaggucuagcagauccaacaaaauucaacucaucgcuugcaaguuauuaucaucuuaaaaguuuacauguauuugacaaagaacuugcagacccccaguaccaaaaagauuuugagaaaauaaucgaauacuccucaauauuugaagauaagaaaauauaucaagauaaacuccaugcagaauuuaaauggcuaacuccagaacaauucaaagcaauuucaacauggcgauuacaaggcuggggacgacuuucuuguagacuacugguagaauugcaugacaccaaugggcaaaacauuauggaacaacuaugggauucccagaaaaauuucaugcaaauagucacagaaccagacuuuaaagaugcgauagccaaagaaaaccaaaacguaacacaaguuaacggaguagaagaaauauuagcagaugcauacaccagccccgcaaauaagaaagccauaagacaaguuguuaaagucguagcagaugucguuaaagcagcaggaggcaagaaaccggcccaauuugcgauagaauuuaccagagauccugacaaaaacccgcaauuaucacacauuagagguacaaaauuacuaaaagccuaccaagaaacagcuggugagcuaguggaccaaaaacuaacggacucuuuaaaagaagcuaugaccuccagaaagcuccuaaaagacaaguacuuccuauauuucaugcagacagggcgugaugcauacacaggcaagaaaauaaauauagaugaagucacaacuaauuaucaaauagaucacauacuaccccagagcuucauuaaagacgacagcuuugacaauagaguacuaacagcuaccccauuaaaugcugaaaaaucagaugauguaccauauaaacgauuugcgaacaacuauguuucagaucuuaaaaugacggucggagaaauguggaaacacuggcaaaaagcaggaauaauaaacaaacacaaacuugggaaccucuuauuagacccugaucgucucaacaaauuccagaaaaguggauucauaaacagacaacuugucgaaaccucccaaaucguaaagcuaguaagugucauacuacaaaacaaauaucccgacgccgaaauaauaaccguaaaagcuggagacaacuccgcucugcgacaacgacugaauuuauauaaaagcagagacguaaaugacuaucaccacgcaaucgacgccuaccuuuccaucauuuguggcaauuuccuauaucaagucuauccaaaauauagaccauauuuuguguauggaaaauauaagaaauuuagucaagauccagauuuacaaaaagaccuaauaaaacacuucaaaggauuuacauuuauguggccauuacuacaaaaggauaacucugagagaaaagccccagaagaaaucaaagaaaacaacucagaacgaauaguauucuauaaacauccggauauauucgacaaacuaaggaaagcauacaauuacaaguacauguuagucagcagagaaacuacaacugaaucaaguaguauguuuaagaugacaaucuucccccguggagaaagggaccguaagaaaacuagaaaauuaauaccaaaagggaauggcuuagacccaaaaaucuaugguggauacucaggaaauacggacgcuuacaugguuauaguaaaaauagacaaagcuaaagaaucuauauauaaagucaucggcgucccuaugagagcacuaacaagacucaaucaagccaagaaacaaggaaauuaucaagaagaacuacaccaaguacuagaaccacagauuauguuagauaagaacggaaaaccaaaacgagguguaaaaggauuccgcguuauaaaagaccauguacccuuuaaacaaguaguucuagacggagauaagaaauucauguuguauucagcccaguacaaaacaaacgcuaaacaacucgcacuaucacaagaaaccaugagaauagugacagauaaccucaagaaaggugaagaucaagauaaacugcuugucaaagcauaugacgaaauucuucaaaaaguggacuguuauuuaagccuguuugauaccuccaacuuuagaaacggacuccauuuaggacgaaauaaauucauagaucuugaaguaaaugacaagaaaaucacacucagcaacaucuugaacggccuacaugacaacaugguacuuggaaaucuaaagaauaucggaauagggacccccuuaggccaaaugcaagaaaaauccgggauaacucuaucacccgaagcaguacucauuuuccaaagcccgaccggacuuuucgaaaaacgaguaaaaauagcagaccucuga

SEQ ID NO: 5580 - RNA, 4188 nt, Artificial Sequence
  Cas9 variant
augaaaaaagaaauuaaggacuacuuuuuagguuuagacgugggcacaggaagugugggaugggcaguaacagacacugacuacaaauuacucaaagcaaaccgaaaagaccuauggggaaugagguguuucgagaccgcugaaaccgcggaaguaagaagacuacaucgcggcgcgagacguagaaucgaaagaagaaaaaaaagaauaaaacuauuacaagaacuguucucgcaagaaauugcaaaaaucgacgagggcuucuuccagagaaugaaagaauccccauuuuacgccgaagacaaaaccauauuacaagaaaacgccuuauuuaacgacaaagacuucacagacaaaacuuaccauaaagccuacccaacaauaaaccaucuuauaaaagcguggauugagaauaaaguuaaaccagacccaaggcuccuuuaucuagcuugccacaauaucaucaaaaaaagaggccacuuccucuucgaaggagacuuugacagugaaaaccaauucgauacauccauacaagcauuauucgaauaccuuagagaagauauggaaguagauauagacgccgacucacaaaaaguuaaagaaauuuuaaaagacucaagccuaaaaaauucagaaaaacaaucaagacucaacaagauccuaggauuaaaaccgagugacaaacaaaaaaaagccauaaccaaucuaauaagcgguaacaaaauuaauuucgcagacuuguacgacaacccagaccuaaaagaugccgagaaaaacagcaucucguuuagcaaagacgacuucgacgcguuaucggaugaccuagccaguauacuaggugauuccuuugaacuauuacuuaaagccaaagcaguguacaacuguucaguacuaucuaaaguaauaggugaugaacaauacuuauccuucgcaaaaguaaaaaucuacgaaaaacacaagacagaccuaacaaaauuaaaagcuguaauaaagaaacauuuuccuaacaacuauaaaaaaguguucggauauaaucaagacaaugaauccaaaaacaacuauucaggcuacguaggaguguguaaaacaaaaaauaaaaaacuggucauuaauaacaguguaaaucaagaagauuuuuauaaauuucuaaaaccaauacuuagcgcaaaaucagaaauuaaagaaguuaacgacauccuagcggaaauagagacuggaaauuuuuuaccaaaacaaauaucaaaaaguaacgcugaaauacccuaccaauuacguaaaauggaauuagagaagauacuguccaaugcagaaaagcacuucucauuccucaaacaaaaggacgaaaaagguuugucacacucagaaaaaauaauaaugcuuuuaacauucaaaauaccauacuacaucggaccaauaaacgacaaucacaaaaaaucauucccugauagauguuggguaguuaaaaaagaaaaaucacccucaggaaaaacgaccccauggaacuuuuuugaccacauagacaaagagaaaacagcggaagaauuuaucacuuccagaaccaacuucuguacauaccuaaucggagaaucaguccuuccuaaaaauucucuucuauacucugaauacacaguucuuaacgaaauaaacaaccuucagauuaucauagacggaaaaaacauaugugacacaaaauuaaaacaaaaaaucuacgaggaccuauucaaaaaauacaagaaaauaacccaaaaacaaauaagcacguucaucaaacacgaagguauaugcaauaaaacagaugaagucauaauuuuagguaucgacaaggaaugcaccucuagccuuaaaucuuacaucgaauuaaaaaauauuuucggaaaacaaguagaugaaauuagcaccaaaaacauguuagaagaaaucauucgaugggcaaccauauaugaugaaggagaaggaaaaacgauuuuaaaaacaaaaauaaaagccgaauaugguaaguacuguucugacgaacagaucaaaaaaauccuaaaccucaaauucagcgguuggggcagacuaucacgcaaauuccuagaaacuguaacuagcgaaaugccaggcuucagcgaaccaguuaauaucauuacggcaaugcgggaaacccaaaauaaccuaauggaauuauuaagcagcgaauucaaauuuacugaaaacauaaaaaaaaucaacucagguuucgaggaugcagagaaacaguucagcuacgauggccuaguuaaaccucuauuucugucgccaucuguaaaaaaaauguuguggcaaacauuaaaacuaguaaaagaaauaagccauauuacccaggcuccuccaaaaaagauauuuaucgaaauggccaaaggagcagaacucgagcccgcaagaacaaaaacgagacucaagauacuucaagaccuuuacucaagcuguaaaaacgacgccgacgcauucuccuccgaaauacaauaccuaagcggaaaaaucgaaaacgaagacaacuuacgauuaaggagugauaaacuauauuuauauuacacacaauuagguaaguguauguacuguggaaagccuauagagauaggacacguauuugacacauccaacuaugacaucgaccacauauauccacaaagcaaaaucaaagacgacaguauaucgaacaggguacuaguuugcaguaguugcaacaaaaacaaagaagauaaauauccucucaaaucggaaauacaaaguaagcaaagaggauucuggaauuuuuuacagagaaacaacuucauuucguuggaaaaguuaaaucgccucaccagaacuacgccaaucagcgacgacgaaacagcgaaguuuauagcgcgacaauuaguugaaacaagacaagccacgaaaguggcugcaaaaguacuagaaaaaauguucccagaaacaaagaucguguauuccaaagcagaaaccguaagcauguuuagaaacaaauucgacauaauuaaaugcagagaaauaaaugacuuucaccaugcccacgaugcuuaccucaacauagugguaggaaacgucuauaacacaaaauucacaaauaauccguggaauuucauuaaagaaaaaagagacaacccaaaaaucgcugacacauauaacuacuacaaaguauuugacuacgacguaaagcggaacaacauaacagcaugggaaaaaggaaaaaccauuauuacagucaaagacauguugaagcgaaauacaccuauauacacacggcaggcagcaugcaaaaaaggaggacucuucgaccaaacgauaaugaaaaaaggacuaggccaacauccauugaagaaggaaggcccauuuucaaauauaaguaaauacggaggcuacaauaaaguuagugcagccuauuacacacuaauagaauaugaagaaaagggaaacaaaauacguucauuagaaacuauaccucucuaucuaguaaaagauauacaaaaagaccaagacguacuaaaaagcuaccuaacagacuuacuaggaaaaaaagaauucaaaauccuaguccccaaaauaaaaauaaacagccuguuaaaaauaaacggauucccaugccacaucacagggaaaacgaaugauucauucuuacugcgacccgccguacaauucugcuguagcaacgaugaagucuuauacuuuaaaaaaauaauucgauucagugagaucagaucacaacgugaaaaaauuggcaaaacaauaucuccguacgaagaucucagcuucagaucauauauaaaagaaaaccuaugcaaaaagacaaaaaacgaugaaaucggagaaaaggaauucuaugaucucuuacaaaaaaagaauuuagagauauaugacauguuguugacaaaacauaaagauacaauauauaaaaaaagaccaaacucagcaacaauagacaucuuagucaaaggaaaggaaaaguuuaaaagccuaauaauugaaaaccaauucgaagucauacuagaaauauuaaaacucuuuagugcaacacgcaacgugagugagcuacagcauauaggaggaucaaaguacuccggggucgccaaaauagggaacaaaauaucuucauuagacaacugcauccuuauauaucaaucuaucaccggaaucuuugaaaaaagaauagauuuacuaaaaguauga

SEQ ID NO: 5581 - RNA, 4188 nt, Artificial Sequence
  Cas9 variant
augaagaaagaaaucaaagauuauuuucuaggacuagauguaggaaccggaagcguaggaugggcagucaccgacacugacuauaaacuacuaaaggccaaccgaaaagacuuauggggcaugagauguuuugaaacagcugaaacagcugaaguuaggcgacuacaccgaggagcaagaagacguauagaacgaagaaaaaaaagaaucaaacuauuacaagaacucuucucacaagaaauagcaaagauagacgaagguuuuuuucagcgaaugaaagaaucgccauucuaugcagaagacaaaaccauacuacaagaaaacacgcuuuucaaugacaaagacuucaccgauaaaaccuaucacaaagcauacccaacaauaaaccaccucaucaaagccuggauagaaaauaaaguuaagccagacccacgacuucuauacuuagcaugucacaauaucauuaaaaaaaggggucacuuuuuauucgaaggagauuuugacagcgaaaaccaguuugacacuaguauccaagcucuauuugaauacuuaagggaggacauggaaguagauauagacgcagauucacaaaaaguuaaagagaucuuaaaagacucaagucugaaaaacucagaaaaacaaucacgauugaacaaaauacuaggccuaaaaccuucugauaaacaaaaaaaagccauaacaaaucucauaaguggcaauaagauaaacuucgcugauuuauacgacaacccagauuuaaaagaugcagaaaaaaauagcaucagcuuuagcaaagacgacuuugacgcacuaagcgacgacuuagcaucaauccucggagacucauucgaacuccuacuaaaggcaaaagcuguauacaauuguucaguccuaucaaaagucauaggggaugaacaauaccuuucguucgcaaaaguuaagauauaugaaaaacacaagacugaucucacuaaacuaaagaaugugauaaaaaaacacuucccaaaagacuauaagaaaguauuugguuacaacaaaaaugaaaaaaacaauaacaacuacuccggauacguuggaguauguaaaaccaaaucgaagaaacucaucauaaauaacagcguaaaucaagaagacuuuuacaaauuucugaaaaccauacuaucugcaaaaucugaaauuaaagaaguaaacgauauacuaacggaaauagaaacugguacuuuccucccaaaacaaaucaguaaaucaaacgcugaaauaccauaucaacuccgaaaaauggaauuagaaaaaauauuaagcaacgcggaaaaacacuuuagcuuccucaaacaaaaggaugaaaaaggacucucacauucagagaagauaaucauguuacucaccuucaaaaucccauauuacauaggccccauuaaugauaaccacaaaaaauccuuccccgaccgguguuggguuauaaaaaaagaaaagucaccuucuggaaaaacaacaccauggaacuucuucgaccacaucgacaaagauaaaacagcagaagccuucauaacaagcagaacaaauuuuuguacauaccugguaggagaaucaguauuaccaaaaucauccuuacuauacagcgaauacacagucuuaaaugaaauaaacaacuuacaaauaauaauugacggcaaaaauaucugcgacauaaaacugaaacaaaaaaucuacgaagaacucuuuaaaaaauauaaaaaaauaacacaaaaacaaauaaguacauucaucaaacaugaaggaauauguaacaaaacagaugaaguaauuauacugggaauagacaaagaaugcacauccagucuuaaaucauauauagaacuaaaaaauauauuugguaaacaaguagaugaaauuagcacaaaaaacaugcucgaggaaauaauacgaugggcaacgauauacgaugaaggggaagguaaaacaaucuuaaaaacaaaaauaaaagcagaguacggaaaauauugcagugacgagcaaauaaaaaaaauacugaaucuaaaauucucagguuggggaagacuaaguagaaaauuucucgaaacaguuacaagugaaaugccugguuuuagcgaaccuguuaauauuaucacggcaaugagagaaacacaaaacaaccuaauggaacuucuauccagcgaauucaaauucacugaaaacauaaaaaaaauuaauucaggauuugaagaugcagaaaaacaauuuagcuauaacggacuaguaaaaccauuauuuuugucaccaagcguuaaaaaaauguuauggcaaacacuaaaguuaguaaaagaaauaagccacauuacccaagccccuccuaagaagauauucauagaaauggccaaaggagcagagcucgaaccugcccgaacaaaaacacgcuugaaaauacuccaagaucuauacaauaacugcaaaaacgaugcugaugccuucaguagugaaauuaaagaucuaucaggcaaaauagaaaaugaagacaaccucagacucaggagugauaaacuauaccucuacuacacgcaacuuggaaaauguauguauugcggaaaaccuauagaaauaggccacguguucgauacuuccaauuacgacauugaucacaucuacccacaaucuaagauaaaagacgauuccauaucaaauagaguuuuagucuguucuucaugcaauaagaacaaggaggauaaauauccccuuaaaucugaaauacaaucaaaacagagaggauucuggaacuuuuuacaaagaaacaauuucauaucccuagaaaaacuuaaccgcuuaacaagaacaacacccauaucagaugaugaaacugcaaaauucauugccagacaacuaguggaaacaagacaagcuacgaaaguggccgcaaaaguacucgaaaaaauguucccggagacuaaaauagucuauagcaaagccgaaacaguauccauguucagaaacaaauucgacaucauaaaaugcagagaaauuaaugauuuccaccacgcucacgacgccuaccucaacauagucguaggcaauguuuauaacacaaaauucaccaauaacccauggaauuuuauuaaagaaaaacgagauaacccuaaaauagcggacaccuauaauuauuacaaaguauuugacuacgaugucaaaagaaacaauauaacagcaugggaaaaaggcaaaacaauaaucacagugaaggauaugcuaaagcgaaauacgccuauuuacacuagacaagccgcuugcaaaaaaggcggauuauucgaccaaaccauaaugaaaaaaggacuuggacaacauccucucaaaaaagaaggggcauuuucaaacauauccaaauauggagguuauaacaaagugucugcagccuacuacacucuaauagaauacgaagaaaaagguaauaaaauuagaucacucgaaacuaucccccuauaucuagucaaagauauccaaaaagaucaagauguacucaaaagcuauuuaacggaucuacucgguaaaaaagagauaaaaauacuaguucccaaaauaaaaauaaacucccuccuaaaaauaaacggcuucccgugucacaucacuggaaagaccggcgacucuuucguguuacggccugcaguucaauucuguugcaguaaugacgaaguacuauacuucaaaaaaaucauccguuuuaaugaaauaagaucacaacgugaaaaaaugggaaagacuaucucaccuuaugaagaccuaucauuuagaucauauauaaaagaaaauuuauguaagaaaacaaaagcagacgaaauaggagaaaaagaauucuacgacuuacuccaaaaaaaaaaccuugaaauuuacgacauguuacuuacgaaacacaaagacacaauuuauaauaaacgacccaacagcaccacauuaggaaugcuaaccaaaggacgguaugaauuuaucaauuuaaaaccaaaagaccaaaucauugucaugcuagaaaucuuaaaauuguucuguacaacucgagaagccauagacuuaggacuaauaaaagguaaaccagcagccggagucgccacccuuggaaaaaaaauaucgaaccccgauaauugcauccucauauaucaauccauuaccgguaucuucgaaaaaagaaucgaucuacucaaaguuuga

SEQ ID NO: 5582 - RNA, 4188 nt, Artificial Sequence
  Cas9 variant
augggagauacaguuaaaaacuaccacaucggacuugauauaggaacauccagcguaggauuugcagcgagagacgaugacaauaauuuaauacguguaaaagggaaaaacguaaucggaacaagacuauucuccgaggggcaaacagcacaagaaagaagaauggcccgagcauccagaagaagauacaacagaagaaaauggagauuaagguuauuagacgaaaucuuccaugacgaaauaauccacaaagacgcagaauuuuucaacagacuaaaacaaucuagucugucaccaaaagacgaaagaaaacaauacuucggcucauuacuauucccagaaguaggugacuccgaauacuaucacgacggaaaucaaacaauuuaccauuuacgucauagacuaaugacucaagacgaaaaagcagacauccgcgaaauauauuuggcacuacgacauauaaucaaauaccguggaaacuuccuagacgauaccccaguaagcucguuugaagcgucagacuuaaaacuugcaucuuucguacccacccucaaugaucuauucgaaacaaucgauguaaauuaugaguuuucuauggauaauauaaaugaaaucgaagauauccuacugaacaauaaacuaagaaauucugacaaaaguaaacaauuaccggauuuauuaacagaaccaauaguaaacaucgacgacaaaagucuagaaaaacaauuuaacaaagaaagaaccgauauaucuaaagaaauagccaaauccguaguagggagcaaaaugaacguaaauaaacuacuuucuuuugaaagcagcggcggcuacaaaauagccuuuaguuuuagugaugccuccucagaagauaagaugauggaauuauccgacguccucgaugauucccgcaugaacauacuaaacauacuuaaaguaauauacucacguguaagacucaaccaaauaauaccaucaggaaugggauuaucugagaguaugguagcagcauaugaucuccacaaacaacaacuuaaagauuugaaaaaguuacucaacgugcuuccauucaacgaaagauaugcagucaaaauagccuacgcggcguacauaggcaacauagacaaacaaaaauucaccaaaucagaagucaaaacaauagacaaacucaaggagaaaagugcuaucaugaauguacuagacuucaaaagcggccacaucacaaacgaagaauuaucaaacguaauuaaaguaguaaucguugauaaauaucuaaacgaugaaaauuuugaauaccauucaauaguggagaaaauaaaccaagauauauccaacggaucauaccuacuaaagcaacgaaacaaccaaaaugggaacauuccccaucaauuacaccaaauggaacuggaccaaauaaucgaaaaccaaucaaaauauuauccuuucuugggagaacuaaauccaaacucaaaccgaaaccauaucgcaaaauacaagauaucggagcuaguugcauuuagagugccuuacuauguaggaccauuaauaacgccagaagaacaagagaaaacaucaggagcaaguuucgccuggaugaagcggaaagaagacggagcaauaacaccguggaacuucgaagaaaaaguagacaaagaagaaacugcaagcagauucaucaaacgauuaacagugaaagacacauacuuacugaacgaagauguccuaccagacaauagccuucuuuacgaaaaauucaaaguauugaaugaauuaaaugucgugaaagcaaacaacaaaaggcucaccguagaagaaaaacaaggcgccuucgauaaucuuuucaagaaaaugaaaaccgucacugccaaaaagcuaaagaauuacuuaguguccaaccauaaucacauuaauucaguagaaauaacuggccuaucggauguagauaaauucaacaacagcuuaaguacauauauugacuuuaagaaaaucuuugacgauaaaaucgauaauccagacuugcuggacgacuucgaagauauuaucgaauggucaacagucuuugaagauagaaaaaucuucgaagaaaaaguccgaaaagacauaucauggauauccgaaucugaaaucaaagcagugguuuccaaaagauauuccggguggggaagauuaagcaagaaauuauuaaauggaauaacaaauaaugaaggucgaaauauuaucgaugaauuaugggaagaaucggaaacauuuauggaagcugucucuaaacccgaaguaaaggaacagauagacggaauaaauagcgauuuuaucaaaaauaccgauauagaauccguguuagcagaugcauacacuagcccacagaacaagaaagcaauaagagaaacacauaaauuaguaaaagacauacaaaaagccaugggcggacaagcaccggccucaauaagcauagaguucacacggaacccacaagauaaagggcaacuaacgagauccaggcauucagaagucucgcgaaaauauaaagaaauuucaaaagaaguaucaaaaacacuaaaugacgagcuuaaauccaagaaaaauagcauggauguagacaaauacuaccuuuacuuuaugcaaaugggaaucgauuuguaugauggcucaaguauagauaucgaugaucugaacaacuaccagauagaccauauaauaccccaaucauucuacaaagaugacucguuugacaauagaguacuaacgcacuacucgaacaaucaaaagaaaggaaauaacacaccgcuaaacggauuaaauauagaugacaaaacaagagcaauauggaaccaccuacgggaucuaggcuuaaucacaaagaagaaauacaauggacuaaccuuaaaaggaauggaucaacuaucaaaauacaccaaacacgguuucauaaggaggcaacuuguagaaacaucucaaguaauaaaacucguagcaaacauauuaucggacgaauuuucaacagaugauacaaaaauaauagaggugaaagcaaaaaugaacucacaaauacggcaaguauucaaucucuauaaagucagagaacucaacgauuaccaucacgcaguugacgccuaucuaacgacauuuauaggcggauaccuuuacaacagauauccaaaucuccgaaauauguucguuuacggagacuuuaagaaauuuagugcagacguagauaaucuaaaaacauuuaauuucuuacacgauauuacgaauccuucagauaaauuugaagauagaauauucgaugagaaaagcggugaacucauucuagaccgaaaacacgcgauagaaaccaucaagaaaauuuaucaauacaaauacaugcugaucacaagggaaguuucuaccaaaaacggacaauuaagugaccaaacaguauacucugcaaaaagaauaaacaacgucaaagcacccauacccguaaagaaagacaguaauccugaauuauaugguuuuagaacagguaacguagaucaucauaugguaauaguaaaauacccaaagaaagacucauacgauuauaaaguaguaggaauaccacuacgauuugugcaaaaacuuaaagaaacgaaagauaacaaagacuacgaaaaccuauuaaaccaaauaguacaaaugaaauuaaaucgaaagaaacaggacuuuauuguuguaguagauaacguaauguacggucaacuaauacaggacggcggagaaaaauacacccucggcagcucaacauauaaauauaaugcaaaacagcuaguuauaaacauggauaaaacucggauucuugaagauaaccguuacuuaaacagcuuagaugaaggagaaguaucagagaaauuaguaaacauauauaaugacauaaugaaaguugucaauucacgauuugaucucuuugacauuaauaaauuuagagaaaaacugaacgacggcuuaaauaaauucaaaaauauaaguaacgaacaaaaagaagagacauuauuaaaaauccuuuccgguuuacacuguggcucagcaaacguucccaucaaagaacuaggacuuacaacaccccuaggaaaacuccaacucccaaguggaauagucuuaucagaagaggcagucguaaucuaccaaucuccuaguggucuauucgaaaacaaagucagacucaaagaucuguga

SEQ ID NO: 5583 - RNA, 4188 nt, Artificial Sequence
  Cas9 variant
augaaaaaagaaauaaaagauuacuuccuaggacuagauguaggaaccggaucaguaggaugggcaguaacagacacggauuacaaacuauuaaaagcaaacaggaaagacuuauggggaaugcgcugcuucgaaacagccgaaacugcagaggugagaagauuacacagaggggcaagaagacgaauagaacgucgaaaaaaaagaaucaagcuauuacaagaauuauuuucccaagaaaucgcaaaaacugacgaagguuuuuuucaacgcaugaaagaaagcccauuuuacgccgaagacaaaacaauauuacaagaaaacacuuuauucaaugauaaagauuucgcggauaaaacauaccacaaagcauauccaacuauuaaucaccuaauaaaagcauggauugaaaacaaggucaaacccgauccgcguuuacuauaucuugccugucacaauauuauaaaaaaacggggacacuucuuauucgaaggugacuucgauagugaaaaucaauucgacacuucaauucaagcacuuuucgaauauuuaagagaagacauggaaguagauaucgaugcggacagucaaaaggucaaggaaauacuaaaggauaguucacuaaaaaacucggaaaagcaaucuagauuaaauaaaauucuuggauuaaaaccaucugauaaacagaaaaaagcaauaacaaaccucauaagcggcaauaaaaucaauuuugcagaccuuuaugauaacccugaccuuaaagacgccgaaaagaacucaaucucauucucuaaagaugauuucgacgcucuuucagacgaccuagcaucaauucuaggcgacucuuuugaauuacugcuaaaggccaaagcgguuuacaacuguagcguuuuauccaaaguaauaggugaugaacaauaucuaucauuugcaaaaguaaaaaucuaugaaaagcacaaaacugaccuuacgaaauuaaaaaaugucauaaaaaaacacuucccaaaagacuacaaaaaaguauucggcuauaauaaaaacgaaaaaaauaauaacaacuauuccggguacgucggcguaugcaaaacaaaaucuaaaaaauuaauaauaaacaacucugugaaucaagaggauuucuauaaguuccuaaaaacaauuuuaucagcgaaaagugaaauaaaagaaguuaaugauauauuaacagaaauagaaacggguacauuucuaccaaaacaaauaucgaaaucuaaugccgaaaucccauaccaacuccgaaaaauggaacuggaaaaaauucucucaaacgccgaaaaacacuucucauucuuaaaacaaaaagacgaaaaaggacucucgcauucagagaagauaaucaugcuuuuaaccuucaaaauccccuauuacauuggcccaauaaacgauaaccacaaaaaauuuuucccugauagauguuggguuguaaaaaaagaaaaaagccccucaggaaaaacaacacccuggaacuuuuucgaucacauagacaaagagaagacagcggaagccuucaucacuucaagaaccaauuuuugcacuuaccucguaggcgaaagcguauuaccgaaaaguucauuauuauacucugaauacacugugcucaaugaaaucaauaauuuacaaauaauaauugacggaaagaacauaugcgacauaaaguuaaagcaaaaaaucuacgaagauuuauuuaaaaaguauaaaaaaaucacccaaaaacaaauaucuacguucauuaaacacgagggaauuugcaauaagacugacgagguaauaauauuaggaauagacaaagaaugcacaagcucacuaaagucauauauagaacuaaaaaacauauucggcaaacaaguggaugaaauuucaacaaaaaacauguuagaagaaauaauccgcugggcuaccauauaugacgagggagaaggcaaaacaauauuaaaaacaaaaauaaaagcagaauaugggaaauacuguagugacgaacaaauuaaaaaaauuuuaaauuuaaaauucagcggauggggcagauuaucaagaaaauuucuagaaaccgucacuucagaaaugcccggcuucagcgagccuguaaacaucauuacagccaugcgagaaacacaaaacaaucuaauggagcuccucucaucugaguucaccuucacagaaaauauaaagaaaaucaacuccggauucgaggacgcagagaaacaauucucuuaugauggacuuguaaaaccgcuauucuuauccccaucagucaaaaaaaugcucuggcaaacccugaagcuaguuaaagaaauaagucauauaacccaggcaccaccaaaaaagauauuuauagaaauggcaaaaggagcugagcuagaaccagcacgaacaaaaacacggcugaaaauccuucaagaccuguacaauaauuguaaaaaugaugcggacgcuuuuucauccgaaauaaaggaucucucagguaagauagaaaacgaagacaaccucagacuacgcagcgauaaguuguaccucuacuacacacaacuuggaaaaugcauguauugcggaaaaccaauagaaauaggacacguuuuugacacaagcaacuacgacauugaccacauuuauccucaaagcaaaauaaaagaugacucaauaagcaauagagugcucguguguucaucuugcaauaaaaauaaagaagauaaauauccucucaagucagaaauacaguccaagcaaagaggcuucuggaacuuucuucagagaaacaacuuuauuuccuuagaaaaauuaaaccgcuuaacaagagcaaccccaaucucagaugaugaaacugcuaaguuuauagccaggcaacuaguagagacccgccaagcaacaaaaguggccgccaaaguuuuagaaaaaauguucccugaaacaaaaauaguauauuccaaagcagaaaccguaucaauguucagaaacaaauuugacaucguaaaaugccgugaaauuaaugacuuucaccaugcacacgaugcguaccuaaacauagucguaggcaauguauacaacacaaaauucaccaacaauccauggaauuuuauaaaggaaaaaagagacaacccuaaaauugcugauaccuacaacuauuauaaagucuucgacuacgacguaaaacguaauaacauuacugcuugggaaaaaggaaaaacgauaauaacgguaaaagacaugcuaaagcgaaauacaccaauauacacaagacaagcagcaugcaaaaaaggagaauuauucaaccagaccauaaugaaaaaaggauuagggcaacacccacuuaaaaaagaaggacccuucucuaacaucucuaaauacggaggauacaauaaaguaucagccgcuuacuauacauuaauagaauaugaagaaaaaggcaacaagauuagaucccuagaaacgauaccacuuuaucuugucaaagacauucaaaaagaccaggacguauuaaaaagcuauuuaacagauuuacucgguaaaaaagaauucaaaauucuaguaccuaaaauaaaaauaaacucucuauuaaaaaucaauggcuuccccugccacauaacagguaaaaccaacgauucauucuuacuuaggccagcgguacaguucugcugcagcaacaacgaagucuuguauuucaagaaaauuauuagauucagcgaaauaaggucacaacgagaaaaaaucgguaaaacaauuuccccauacgaagacuugucauuuaggagcuacaucaaagaaaaccuauggaagaaaacaaaaaaugacgaaauaggcgagaaagaguucuaugaccuucuccaaaagaaaaaccuagaaauauacgauaugcuauuaacgaaacauaaggacacuauauauaagaaacggccaaauagcgcaaccauugacauauuggucaaaggaaaagaaaaauuuaaaucccuuauaaucgaaaaucaauuugaaguuaucuuagaaauacuaaaauuauucucagcaacacgaaauguaucagaccuucaacacauuggaggguccaaauauuccgguguagcaaaaaucggaaacaaaaucucaucacuugacaauuguauccuaauauaucagucaauaacaggaauauuugaaaaaagaauugacuuguuaaaaguguga

SEQ ID NO: 5584 - RNA, 4188 nt, Artificial Sequence
  Cas9 variant
augaacgcuaauagagagauggcauacuacauaggaauagacaugggcacggggucagugggaauggcaaucacagacgaaaauuacaaucuucuuaaaguaaaaggacaagacuauugguucguaagagaauucgaaacagcgaauacgcaaauaaaaagaaggaugcacaggauaucaaagagacgacuucgccgacaucaaguaagaguagcauuaauuagaaguuauuucgcugaagaaauauuaaaaaaugacccuuuauuuuuuauucgacaagauaacaguauauacuaccuagaagauaaagacuccgucuuaaaaacaaaagauugucucuuugcagacuauaacuaucacgauaaaaacuauuauaaagacuacccuacaauauuccacuuaagacaagccuucauuaaggauacaguaaaagacgacgaaaaccauacgagauacgcaagacuacuauaucucgccauuauuaacauguucgaacaccgaggacacuuucugcuuaacucaguaucagaagacaucaacaaagaaauggucaaagaugcaggagaagguuuuacauuauacuuacaagaaagaauuaaagaaauaaaaccaguaaguuacagcgauauuuuagacguucuaguggaaaaaaauaucagccguagugagaaaaaagaacgaauuguggaacuguucggaauuaaaaaaucaugcaaaaacggaauggagaucauaaaaugccuauguggcuuagaagcaaacguagcgauaauguucaacuuggacgauauagaaaauaaacuaacgaucgucguaagcaaagaugacuaugaggauaaacuagcagaaguccaaccacuaguagaugaagaaaguuucgaauuacucucaagaauaaaacaacuuuacgacuacagucaauuacaaucaauauuaaaagguuacaaagaaaaagaggacggugaagauaaauauuugagugacguacgcguugaauuauacgaaaagcacaaagcugaccuuaaacugcuuaagaaaguauacaaaagagaucuggauaagaaagggaaaauaugugaggguaaaaauauccaaagaucuagcaaauauaacuuuauguucagaagcgggaaagacgguacauacagugccuauacuaacagucuaaacucauucugcagcaaaacuauagaaaauaaauacaggcgaaauaugaaaaauagagauagagcuagccuauaugauacaauuaaaaaagacuuaaguggaauagaaaaugacgacguaaaaaaaauacuccgcgauauagaaacagaaaaauuccuuccaaaacaaauuacaggagaaaauggcguaaucccaaaccagauucacgcuaaagaacuaaaagcaauacuaaaaaacgccgaaaaacauuuaccauuuuuaacggaaaaggacgacuccggucuaacaguaucagaaagaauuauaucauuguuucgauacuguauacccuacuacauaggaccuguaggaaaagauucgagaacagggugggccuccaucaaagaagaaggacaaauauuucccuggaauauagaacaaaaaauugacguagacaaaacgagcgaagaauuuauaacaagacucauuaaaacuuguacuuacuuaagcaacgaaaaaguaguaccaaaacagagccuaguauacgaacgauacugcguacuaaacgaaauaaacaacauaaaaauacguggaaaacgaauagacccacaguugaaacaagaaauuuuuaaagaacucuacauaggaucaaaaugcggaaaaaaaguaacacgaaaaaaccucugccaauaucuaguuaauaaaggugccauagaagaagacucagaaauuucagguauagacaaagaccuaaauacauacaugagcucauacggaaagauguaucaaauuuucggcgacaaaauuaaacgagaugacauaaaggagguggccgaagaaauaauauacuauggaacuauauaugguggcgcgaaagaaauguuuaaaaaaaaaauugaacaauauguaucugaagacauccuagacgaagcacaaaugaacagaauacuugguuucaaauuuaaagacugggcuagauuaucaaaaaaauuucucuaccuugaggguuaugauaaaggaaaucaaaaucaacugacgacauuaaugcaagcacuaugggacuacaaccuaaauacaauggaauuaaugaacucgccaauguuuacauuuaaggaaacucuugaaaaacaaaaaaauaagauggaaaaaguauuaugcgacuuugaauaugaagaucucgacgaguacuauuucucagccccaguaaaaaggaugguuuggcaaacgauagcgugcuuaaaggaaguagugcaaaucauggggcacaacccaaaaagaauauucauagaaaugccaagagcugacgaggagaaaggagaacaaggccgcaaagcaagccgaaaaaacagauuacuaagccuguaugaagaaauagaagacgaacgaccauggaaaaaagaaauagagaacgccgccgagucaggccgacugaauaguaaacguauguaccuguauuauuuacaaaugggaaaagacgcauauacuggagaagacauagacauugaagaccuauuugauaauagcaaauacgauauugaucauauuuacccaaggagccucacagaugacaauagucucgaaaauaaucucgugcugguaagcgcaacgaucaaccaggacguaaaaaagaaugauuacccaaucccauacgacaaaaucagaggaaacucaaagguaagagaauuauggcgguuuuuacaugaaaaaaaauucaugaaugacgaaaaauauaauagacuaauguccgaugucccacuuacgcaagaacaacuagcaggcuacauagcucgucaauuaguagaaacagcacaagguacuaaaggaauugcugauauaauuaaaucaguaauuccggacgcagauauaauauacucaaaagcaaaaaauguaagcgacuuuagaaaaagauauggaaugcuuaaaucaaggcuuaccaacgacuuucaucacgcgaaggacgccuacuuaaacguagugguaggaaacguuuauuucacaaaauucacgcaaaacccaaggaaauacaucaaagacgaaaaugacauagagaauaaaaaauauaacuauaacuuaucgaaaauguaugacaaagaugucauacgaaacggaaaaguagcuuggauagcccaaaacggcaaaaaagcugggacaauacaaacaaucaaaaaagucauggacaggaauaccccaauaauaaccagacaagcauucgaacaaagaggcgaauuauacgaccuacaacccaucagcaaacauaaagccaagaaagaaaacuacguaccaauaaaagccacaaacgaaaagaugaaagacguaacaaaauacggcggauucacaucacuaaauccagccuauuuuguuuuuguagaauacgggagugccaaaaaacgacaaagauguuucgcaguaguacauaguuacugggcgagcucuaucaaaaacaacgaagauuuaguaacacaccuaaaagacagaggauaugagaaccccaucgugauagcagauaaaauaaaaaaaaauucucuuauuaaauauaacggcuauuuucuauacauaguagguauggaugcaagaaaacaaguugaauuuaguaaugccacuagcaugugccucaacaauaacuucauacaguauauacaaaaaauagaaaaagcuaauacacucauagcugaagcaaaaaaaagacgaccauacauagaugaaagcauaacggcagaacgcaauaucgcccucuacaacgaguugaaaaaaaaacaucuagacucaauuuucaaaaaccaucccaaagguauugggaguguuuuagaaucaggagaaggagcguuuguccaacuaucucuagaacaacagauaggaauacuguauaguauuauacaauucuccuccuucaaaaagggaacauucucccuaacgcucauagggggacccaaagaaguuggcaggauaagaaucuccgggaacaugccuaaagcacgagaauuaaaacugauacacuauucaauaaccggcauguacaagaaagagauaaaucuauuggacuga

SEQ ID NO: 5585 - RNA, 4188 nt, Artificial Sequence
  Cas9 variant
auggaaacacaagcuucuaaucaacuaauaaguucacaucuaaaaggcuacccaauaaaagacuauuucguaggucuugauauagguacaucaucagucggcugggcugucacaaacaaagccuacgaacuucuuaaguuccgaucacacaaaaugugggguaguagacucuuugaugaaggugaaagugcuguugccagaagaggauuccgcuccaugagacguagacuagaacgacggaaauuaagacuaaaacuccucgaagaacuauucgccgacgccauggcacagguagacccuacauucuuuaugcgucuaagagaaagcaaauaucauuaugaagacaaaacaacaggccacucaucuaaacacauacuauucauagacaaaaacuacacagaucaagacuacuauaaagaguauccaacuauauaccaccugagagucgcccugaugaaaucgggcacugaugauauccguaaacuauuuuuggccguacaccacauauuaaaguaccgaggaaacuucuuauacgaaggagcuaccuucgauaguaacgcauccaccuuagacgacguacucaaacaagcacuagaaaacaucacauucaacugcuucgauagcagcgcagcaauaggcuccaucggucaaaucuuaauggaauuaggaaaaacuaaaucagacaaagccaaagcuauagaaagacugguagacacauacauaauaacagaugaaguugauacaaguggaaaaacacagaaagaacagguaaaagaagauaagaaaagacuaaaaucguucgcaaaucuaguucuagguuuaagugcaagccucaccgaccuuuuuggaucuguagaagaccuagacgaagaccuaaaaaaacuucagauuauaggagauaccuacgaugaaagaagagaugaccuugccaaagucuggggcgacgagauacauauaauugaugauuguaaaucuguauaugaugcaaucauucucaugucaaucaaagaaccaggauuaacaauuuccgaaaguaaaguaaaagcauucaaaaaacacaaagaugaccuagcuauuuugaaaaguuuauuaaaaucagaccgaaguauauacaacacaauguuuaaaguugaugaaaaagguuuacacaauuacguacauuauauuaaacaagguagaaccgaagagacaaguugcaauagagaggauuucuacaaauacacgaaaaaagucgucgaaggacuuccugacucaaaagacaaagaauauauccuauccgaaauagagcuacaaacccugcucccccuccaaagaauuaaagacaauggcguaauaccguaccaguuacaucucgaagaacuaaaagugauauuggcaaaauguggaccaaaguuuccuuuucuaaacgaaguugcugauggcuuuucuguagcagaaaaauuaauaaaaauguuagaauuccgaauaccauacuacguagguccacucaauacacaucacaacguugacaauggaggauuugcuugggcaguaagaaaggcuagcggaagaguaacaccguggaauuucgaugauaaaauagaucgcgaaaaaucagccgcugcguuuauuaaaaaccuaacaaauaaaugcacauaucuacuaggugaagacguacuaccuaaauccagccuuuuguauucugaauuuauguuguuaaacgaacucaauaaugugagaauagauggaaaaccucucgaaaaagcuguaaaagaacauuuaauugaagcagucuucaaacaagaccauaaaaaaaugacaaagaaucggauagaacaauucuuaaaagauaacaauuacauaccggaaaagcauaaaccugaaauaaccggccuagacggagaaauaaaaaaugacuuagcuuccuauagagauaugguucgcauucuaggaaacaacuucgauuuaagcauggcagaagaaauaauaaccgauaucacaauuuuuggagagaguaagaaaaugcugcgagaaacacuaagaaauaaauuuucaucaaggcuagaugaugaagcuauaaaaaaacuaucgaaauuaagauauagagacuggggacguuuaucuagaaaacuacuaaaugucauagaagggugugacaaagcaggggaugggacgccagaaacuauaauaauauuaaugcgcaacuuuucauauaauuuaauggaacuauuaggagauaaauucuccuucauggaacgaauucaggaaauaaaugccaaguuaauagaaggccaaauaguaaauccacaugauauaauagaugaucucgcacucucuccagcaguaaaaagagcuguauggcaagcauuaagaaucguagacgaaaucguacacauaaaaaaaaccuuaccugcgcgaauuuuuguagagguaacacgaucaaacaaggcugaaaaaaaaaaaaaagauucuagacaaaaacguuugagcgaucuuuacgcagcaauaaaaaaagacgaugcacuacuaaguggacuaacuaaugaagaauuuggugggcuaaaaucuggccuagcaaaauacgaugaugcagcucuaagaucaaaaaaacucuauuuauacuacacucaaaugggacgcugugcauacacaggugaagucauugaucuuagucaacugaacacagauaacuaugacauugaucauauauacccccgcuccuuaacaaaagaugacucauuugauaaucuaguacugugcaaaagaacagcaaaugcucagaaaucagauaccuauccgauaucaaaagaaauucaaaaagcucaaaaagcguuuuggaucuuuuuaaaacagcaaggacuaaucucagaaagaaaauaugaaagacuaaccagaauaacuccccuaacagccgacgaccuuaguggauuuauugcacgccaauuaguagaaacaaaccaauccgucaaggcugccacaacuuugcucagaagauuguauccaggagucgacgugguauuuguaaaagcagaaaacgucacagauuuucgacaugauaacgacuucaucaaagucagaucucuaaaucaccaucaucacgcaaaagaugcauaucuaaacauaguuguaggcaacguauaucacgagagauuuaccagaaacuuccgagcauuuuucaaaaaaaacggagcgaaccgaacuuauaaucucgcuaagauguuuaauuacgauguuaagugcacuaaugccaaagauggcaaagcaugggcuguuaaaaccucaauggacacaguuaaaaaaaugauggauaguaaugacguuagagugaccaagcguguuuaugaacaaaaaggccaacuuucagauauuaaccuuacuaaagcaucuaaaguuaaagccgauaucuauuuacccauuaaagccaacgauccaauaaugucacaaaauaugaaauacggaggauauuccgauauuaagaaugcauacuacacuauaauugaauacucagacaaaaaaaauaacagcaucaaagcuuucauccccaucccuaucuucauagcaacaaaaacccuaaccaaacaggcauuacucgaauacauaaaaacaguacuuccaaaagcuaacaauuuaagaauaauauauaaaaaagucuauaaugaccaacuacuaaaaauagacggcuuuaauuauuaucuaggaggucgauccaacgacagauucuguaucgacaacgccauacaacuuauuguacccuuagaaauacaauucuacauuaaacuaguugaaaaauucacagcaauaauaucagaaaauaaaaacauugcccuuaaagccucaucugucaagucuagaaauccuauaaauaaccaagucgaaaauauaacacucgaauacacucaaaaacuguuugacuauuuggucaguaaauuuaacgaacuaauauaucuaaaaaugagaggcaacaaauugacagauguaaauaauauaggaagaaaacaguuuaucaaauuaucacuugaagaaagauguaaagcguuagcagaguuacuuaauauauucaccaacaugaauaagaaacuauccuuaaguacuauuaaugucagugcuagccguaagguaguaaauuucaagauuagcucacuugacgaauucaaaauaguaaacgagagcauuacagguuuauauagccaugagauaaccauagucuga

SEQ ID NO: 5586 - RNA, 4188 nt, Artificial Sequence
  Cas9 variant
augaaucuuagaaauacaacagacgaauacaauauaggccuugauaugggaacgaacaguguggggugggcuguaacagauaaaguaggugcuauugcucauuuuaaaggcaugccuacauuagguucaagauuauucgaugcagcucaaacagcagcagaagcaagagcucacagaggccaaagaagaagauauguuagaagacgcuggagacuugaucuacuacaaucucuauuucaagacgaaaucgacaaaguagacucugaguucuuuaucagguuacgacaaagucgguuacacgucgaagacagggaagauggacacgcugauuacaaauggcccaucuucaaugacagcgacuucacggaaguagauuauuauaaaagauucccaacaauauaccaccuaagaaaaugguugauagaaacugaucaaaaagccgauauaagacuaauauauuuagcgguacauaacauagucaaacauagagguaauuucuuacgagaaaauaacaaaaauuuaagcucgcgaaacgccgaucccgccgaagccguaggucaucuaagauuagcuuugaauaauuggugucuagaaagaggauacgaaugugccuggaaaucuggagguaacgacaaugcaaucuugaauguacuaauagacggagagaaaagaagaucugaucagguuagggaaauagccaaacuuacgggaauugacuguggugaugcaaaacagaguagacaauguaaugaagcgauugcuaaagcaauaguagggcugaaagcagaaaugaaaaacauauuuggagaguucccugcugagaaaacauuaaucuaucuauccucugaugacgauguugaaguaguaagagacgcgugcccugaugauucgguagaauuauuccaagcauugugugaauuauacgccgcauauauacuacaaggacuauuaucauaugcuccaggacaaacaauaagugucaauaugguaaagaaauacgauagauauggagaagauuuacaucucuuaaaggaauuaacaagaacuuacgcaaguaaaagauaugacgcauucuuucgaggggaaaccuaugaaggaucaucagacuacguaguugacaaagcacaagguuauacaagauauaaucuaggcacaacacaacuuaguuaugaugacuuucaaaaagcaguaaaggaauuguuuaaaggcacagaugccuuacaggaugaaagauaucagggaaugaugguugcuuuuggugaacaacgcuuuuuaagaagguuaaaaacaagcgacaaugggagcauauauuaucaauuacauuuagaagaacuacaugcgauacucgaaaaucaagguaaacacuacccauuuuuguuagcagaagaagauaaaauugaaagccuagucucauuccguauaccauauuauguagguccacuuacgagggaaaaugcagcaguaggacaugauggaaaagagagguucgcauggucaaguagaagggacggaauggaacacgcuguaauaacuccguggaacugggaagaaauaauagauagggacaaaucagccgaagauuuuauuauacgaaugacuggagauuguacuuauuuacaaggagaaccuguauuaccgaaauguucgcuguuauacgaagaguuuugugcgcucaacgagcuaaauggagcacacuggacgauagaugaagacgaugaaagacguuucgaugcugcacaacgcgagagaaucaugugugaucuauucagaagcacaagaaaaguaacauauaagaaagucagcgacuggcuagaaagagaagauucauucgucggggcacgaguacacgguggccaaggcgagcauggauucgaaagucaacuagguuccuauaucuucuuuuguaaagauguauucaaaacggacucguuagacgaagcagauuacccaaugaucgagcaaauaauacuauggucaaccuuauuugaagacagagacauucuacggagaaagauagaagaggcuuacggagauagauuaacaacagaacaaauaaaaguaaucugcaaaaagagguuugcaggaugggguagauuaucaaagaaauuauuaacaggcauaaaaguagauacagauacaggacguaaaucgauuauagacguacuccgagaaggcaacccaaacgacggucaaaggagcagaacgaugguauuuauggaagugcuaagggaugaaggauuaggauuucaaaaagccguugaugacuucaacagagacuacuucagugaacauaacaacggauuaauggacgugaaugauuuacccggaaguccugcuauuagaagaucgauaaaucaagcaguacgaauugucgacgaaauaguaucuauugcaaagaaagaaccagcaaacauauucauugaaguuacucgagaagaagacgauccaagaaagaaagggaaaagaacuaaaaggcgauaugacgcgauuaaaagugcgcuagaaguauucaagaaagacgauccccaacucuggaaagaguugacgaagaaagacuccaauaacauggacgaacgauuaucacuuuacuucaugcaaagggguaaaugcauguacagcggaagaccgauaaaaauagaagaacugcacacagggaaauaugaaguagaccacauaauacccagaaguuacauaaaagaugacagccuggagaauaaaguucucguauacagggaagaaaaccagcauaaaacugauacacuucucauagacagcucaauccgucgaaaaaugggaaaauacuggaggaugcuacauaaugccaaguuaauaggugauaagaaauuuagaaaucuuuucagagaucauauagaugauaaaacuaugaaagguuuuguagccagacaaauaguagagaccucccaaaugguaaagcuaguucaaaccuugcuagaagccagauaccccggagcaagaauuguuccaguuaaagcaaacauaucacaugauuuaagagaugcugcaggauuagucaaaugcagagaagcaaaugauuuccaucacgcgcaugaugcguuucucgcaugccgaguaggguuauuuauacagaaaagacacccaucgguauacgacaacccaauuggcuuggcucacauaaugcgagauuaugcaagagcacaagcaagagaauauaagaaaagucacuaccuagcacacacuaaaggauucauaguuaauucauuuuuaucaaguggguuugauaaagagacaggggaaguuuuuaaagaugauugggacgcagaagcugaaguagaaggcauccgaagaguauugaacuaccgacaaugcuuuauuagcagaaugccuguugaagcaacaggcacauuuugggaucaaacgauauacucacccaaauguggaaagaaacucacucuaccgcuaaaaagggguuuagaccccgacagauacggaucuuauagccgagaacaauucgcauacuuuuucauauaugaagcaagggaucuuaaacacgaaagacauauacuacaauuugcucaagucccuguaagagucgcugcacauauagcaaaagacccaucacaacuugaauccuaugcaguuaaacuagcaggccaggccaaccucgcguuuguaagaauagugcgaagaagaauauugaagaaacaacuacuagaacuaaauggcgaccgauuaauaauaacagguguaagagaaguaagaaacgcuacagaguucgcauuuagucuugacgaagaaacauuaaucgaaagaugcguacagaucgcuaaaguagguucacugauagguguaguaaaugacgaagacgaagaacaauuaucugcagauuuaaaugaacucuuuagcagcuuaguaaaaagaggcccgaaacuuuguaauaggcuauacgcacaacuaaaacuagauaaauacuuguccaaauuugacgaauuaacuuuaacagauaaagcgaaaguaguuuuacaacugauugcuauaacuaauggcagcauaaauauggcugaccugagcgcauuaggaagcucuaaauaugcugguuguaugcaaguuucauauuuuaaacaacuaaacgcuccgauaggugaaguaaauauaauagaucagaguguuacuggaauguucgaacguagaacgcauauaggccuauga

SEQ ID NO: 5587 - RNA, 4188 nt, Artificial Sequence
  Cas9 variant
augaaagaaauaaaggauuauaucauuggcuuagacauuggaacaaacucguguggauauguugugacugacaaacagaacaacauacuaaaacugaaaggaaaaacagcaauaggcgcacgacuauuuaaagagggccaagcagcagcagaucgaagaucauuuagaacaacaagaagacguuuggcaagacgacacuggagauuaggguuauuagaagaaauauucgacccugagauggaaaaaauugaccccaauuuuuuuagacgauuaaaagaaucggacuauucaccaaaagacucgcgcaagcaauuuaaugcaauaguauucaaaucaauaaaggcagacaaaagauucuacaagaaauauccaacaauauaccaccugagaaacgcucuaaugcaugauaaucaaaaacaugauuuaagagaaauauucauggcaguucaccauauaguaaaauaucguggcaacuuccucagggaagauaguguaaaugcauucaaggcagcaaaauuuuccuuaagaggagaagauggaauagguccaguugacaaauuaaacgaccuccuuaaagaaauauacagcgaguacucaccagaauuagcaacaaacaaucuaucaaagaucgaagacaucaucaaagacaaaaaccuauacaaacaagauaaacuaaaacaaguagcaacacuacuuauuaaagaagcagacucuaaagauaaggccaaauuaaacaaagacauagcaaaacaaguagccaauucauuuaugggauacauguucaggcuagauacccuuuuuucacuuaccgacgucgauguuaaggacuacaaauuaaaguuuucugaugcgaacauugaugaaagcuuagacgacuugacuucccuucuuacugacgcccaaauagaauucguauuagaacuccaaucaauuuacaauacgauagucuuaaaugagauagucccagacggaaugucucucagugaaaguaugauaaaaaaauaugacgaccacaaagaagaucuaaaaaucuucaaagaauacaucgauagccuauccgaccaaaagaaagccaaaaaauuacuuucagcauauaaucuauacguuaacuaccgaaaaucagaccuaguagaagcaaaaaaucuauuuaaaaauaaaaaaguuggagacaaaaacuucgcugauguaauaucuaauuucgaaguuuucggaaaauucgucuccgacaaucuugacgacucagaauuagcaaacaaaauaaaagcuagacuagaccugggagaauuccuaccaaaacaaagaacuaaccaaaacggcguaauucccuaccaauuacaccaaguugaauuaacccaaauauuagaaaaacaaggaaaauacuaccccuuucuaauaacaccaaacccaguugaaucucacaggaacaacgccccauacgaaauaagugaauuaguaucuuuucgaguuccguauuacguaggcccauuaaucgacaaccaauccauaaaggauaaacaaaauaaaaauaaauuugcauggaugguaagacaaaaacaaggacaaaucacacccuggaaccuggaagaaaugguagacacaaccgaaagugccaaccaauucauaaaacgaaugacaagaaaagacacguauuuauuagcggaagaugucuuaccaaaaucuaguuuaguauaucaaaaguucaugauucuagaugaacuuaaucgaauaaaaauagacggaaaaaagcuaacaucagaguugaaacaugacauuuuugaaaaacuguuuaaaaaacaaaaaucgauuaauuuagacaacuuaaaaaacuauuugcuaguugaggggaacaucccaggacugaucgaaggacugucagacgguaucaacuuuaacaauucauucagcaccuacauugauuacagaaauauauucggugacgagauagauaauccaaauaaacaagcagauuucgaaaaaaugauagaauggucuaccgucuuugaagacagaaagauuuuuaaacgaaaauuaaaagagauaacaugguuaacgucagaacaaauuaaacaaguaucaucaaaaagauacaguggauggggucggcucagcaaaaaacuccuaacacaaaucacagacgaaaacggaguaaacauacuacaaagauuauggaaugaaccugaaaccuuaacagaaguccuagccaacccagucauaaagcgaaaaauaguggaagccaauucaaguuucaccaaggcgaaagauaugaaagacauccuuguugaagcuuacacaagcccccaaaacaaaaaagcgauacggcaaguaaugcgagucguagaugacauaauugccgcggcacauggcaaaaaacccucgcagauagcaauagaauucgcaagagaagaucaagacaauccacaaaugacuaaaucacgcaaagcccagcuagaucaaaucuaugcaaaaauuagugaugaauucuuagaugacgcugugaaaaacgaacuaaaaaauaugaaagacaacaaacccuuagcaaaagacaaagucuuccuauacuuuaaacaaauggggagagacgcauacagcggggaaaaacuaucuuuagauaauuuacaggacuaugacauagaucauaucuacccacaaagcuuuauaaaggaugauucauuugauaauagaguccugguccaaagagcguacaauaacgggaaaucugacaauguaccaguacugcuauuuggaaacaaaauagcagcuggcuuaggcauaacaauuagacaaauguggaaaaaaugguuggaauuaggacugauuuccaaaagaaaauucaacaaccuaauaacagacccggaaaaaauaucaagaaauauggcaagcgguuucguaaaccgacaacuaguugaaaccucacaaguuauuaaacuuguagcaaacauccuacaagcuaaauuaccggauaccgaaaucauagaggucaaagcaagcuacaauuccauacuucguaaagaauucaaucuauauaaaagucgcgaaguaaacgacuaccaccaugcaaucgacgcguacuuaacuaccauaguaggcaauuauuuauaucagguuuauccaaaacuacgacccuacuuuguauaugggcaauucaaaaaauucggaaaggcagaaaaucaagaagacgacccaguaaaaaaaauaaaaaaauucaacuucauuuaccaacuaaucuggggaaaagacgacgccauauguauaagucacaccaaucaacaagucuuuagcaaaaaagauauuauagacaaguuaacaaccgcauauaacuuuaaguacaugaacauaucacacgcaguauauacaagaaacaauaauauguuuaaacaaacacucuucccaauaaucgaaagaaccacagcaaagacuaaaucacuaauacccaaaaaacuagauaggcccacugacauauauggaggcuauagcaacaauaacgacgcauacuuagcuuuaguuaaaguagacaaaaaaagagguagcgaauacaggguaguaggaauacccaugagggcugcagcuaugcuaaaagcaagcaaaaacuacgacgaagaccuuagaaaaguuauagaaccgauggugauguuugacaaaaacggcaaagcaaaacgaggcauagagggcuuucgcguauuaguaggaaaaaugcccuuuaaacaagccguccuggaugguaacaaaaaauucauguuaaccggaacuguugacaccccaaauuuaaaacaacuaguacuaucucaacaaaacaugaaauacauccuagauuacauagaagaugucgacugcagaaaacacaaauuuggagacaaaguacaaaacccagauaagugcuuauuagagguuuucgacgaaauuauagaaauaguagacaaauacuuugagcuguucgacagccgugacuucagagaaaaacuaagaaacucacggaauaaauucaucaaauuagaggcgucuaaaaaagcagacacaauauuagcuaucuugaaaggucuacaagcuaaaagcacacgagcaacuauaaaagaacuaaauauaucagauuucggacgaauuauuacaucuagcauuucccccgaagcucaguuaauauaucaaagccccacuggauuguuugagagaagaguaaaagucaaagacuuauga

SEQ ID NO: 5588 - RNA, 4188 nt, Artificial Sequence
  Cas9 variant
auguccaagaaauaucaaaacacaaaauauuaugucggauuagacauugguacaaguuccguaggaugggcgguaacagacgcaaauuacgaacuguuaaaaguaaauggacauaaaacauggggaaguagacuguucacagaagcagaaacagcccucgaaagaagaacccauagagcaacgagacgcagacuacaaagaagaaaacaacgauuagaucuacuugacgaacuguuugcagaagaauuagcaaaaguggacccccaauucuuacuaagauuaaaagaaucucaauaucacauggaagauaaaucuacugacgacaaauacguucuauucaacgaccaaaaucgcaccgacggagaguucuuuacagaauauccaacaauauaccaucucagauccgaauuaaugcaaggcaagaaagaagauauaagagccgucuaccuggcacuccaccacauugucaaauacagagggcauuuucuccuaccaggagauaacuaugacaugcaaggaaaccuuucagaauugauaaaaaggcuauuuaaauucauagaagaaacguuauuuauagaagaucucggucuuacggacgaaauacaaaguaaaauugaagaaauacuauuaacaaaaacaaaaacgagacucgauaggcaaaaagaaauuguaaaacuauucaauaccaaacaccaaaaacuggacgacaaacagaagaaacucuuagaagcaauauucaaauuaugccuaggacuuaaaggaaauauggucaauauauucggagauaaaggagaauauggaauagacuucaccgacguugaagacaaaaagaagaaagucgaauuuucagcagacuacgacaacaauauuaacgauuauguagacuucuucggcgaauauuucgaauuacuagaaauuaccaagaaaauuaacgauacugucauauuuucagaaauacuuguagauggcaaagguuucucagaaagcaaaguuauuagcuaugaaaaacaccaacaagaucugagaaaauuaaaaacauuacuaaaaagucuugacaaaacacugggauacaaauacggagaaggguuauaucagaaaauauuacuagaugauguaaaauccaauuaugucaacuacucagggaauagucaaaaauugaagaaauguacaaaagacgaauuuuacggauuuauaaaaucgaaauuaaacagcgucaccaagaaagaaaaaguaagcgaggcucaacaaaaagaaauagcucaaauacuugccgacauggaauuuggggauuaccucccauuacaacgaacaacagacaauggagugauaccaaaccaauuacacaagaaagaauuaaucgaaauaaucgaacaacaaacaaaauaccacgacuuuuucaaugacguagaugaaaaugggcugaccauuaaagacaaaauaaucucauuaaugacauuuaggauuccauacuacguaggaccauuaaaugauuaucacaaaguugcagaugguacaggccacgcauggauugagaaaaagaaagacggaaaaauauacccauggaacuucgacgaaaugguugauaccgaagccacagcagaaaaauuuaucaaaaaccucacaaacaaauguacuuauuuaaaaggagaagacguccucccaaaagaaagcaaacuauacagugaauuuauguuacuaaacgaacuuaacaacauaaaaauagauaaucaaaaauuagaucccaaauuaaaaaugaaaaugguuagcgaauuauuuaugaagaaaaaugagaaaauaacuaagaagaaaauaguagauuaucuacgaucgaucggccaagccaacggaaaugaaaugguaucaggcauagauagagagaucaaauccgaucugaaaacaauacacaaaauacaacauuacuaucaagacgccucucuggaaauggcagagaacauuauacgcuggaacacaaucuucaacgauucaacgucggacauacucaaagacaaaauaacgaaagcauacggcgauguacuaacaccaggccaaaucaaaggcuuaucaaauuuagccuguaaagauugggguaaauugucagaaaaauuucucacagggaucaggugcgacguuggugaguucaaaaauauuucgauaauacaagcuaugagagauacaaauaacaaucugauggaacuauuaucaaacaaauaugaauuuauggauaaaauacaagaauacaauaaagaauacuauggcgacuuuaccuucaaagcagagcccucaauaauggacgaccuauacgugggcccaggcccaaaacgcgcgauuuggcaagcuguacgaauaguugaagaaauuaaaagaaucaugggucaugacccagagaaaauauuuuuagaaacaaccagaacaaauagagcgcccaaagugaaaaauacaaaaagauacgaugccuuggagaaaaaguacgagagcguuaaagaacacgaauaugcagaaguuaagaaagaguucgaaauagagaaaaaugacucccuuaacaucaagaaacuauuccucuauuucacgcaauuaggacauugcauguacuccgacgagaaaauaccauauaacgaacuuuucacaaauagauacgacauagaccacauauaucccagaagcaaaacaagggacaauucuauggauaaucuaguauuagugaaagcagaaugcaacagggauaagaaagauaacuacccuauaaaacuuaaaaccaauauccaacaaaaaugucaaguucgaugggccuaccuaagagauaagaaauuaauaacugaagagaaauauaacagauuaguaagaaaaacaccacuuacagaagacgaacuaucacaauucauagccagacagcuugucuuuaccagucaauccgucaaagcuacagcagagguguuuaaacguuuauacgaagauagcaaaauuugcuacgugaaagccgaaaauguguccgacuuucguuacggaagcacgagaaaaaugucaaaagacgaucaaccacaaccauucaucaaaaaccgugacguaaacgauuuccaucacgcaaaagacgcauauuuaaauaucguaguagggaauguauacgaugucaaauuuacacaaaacccuacaagguucauuaaagccaauaaagacuauucauuaaauuacaucuuucguuauccagucaacaagaaaggagaaaauguaugggaucccgaacaguccaugaaaauaguagagaaaacucuuaaaagcaaugacguacgagugaccaaacucguaaaaccuauaacauccccaauuaguaaugaaaccuuacauaaagcucuaaaaugcaaaccaggauccuauuuaccaaggaaaaguaguaaaggaaccccucucgcagacgucacaaaauacggaggcuaugagaaaaucaaaaacgcauauuauaguauauacaaauauacauauaugaaaaagaaagaauguauggaagaauuuuuauuaguaccgauaccaauccaucuagucaacaaugacgaagaacuaccaaaauacauaaacgauaaaauagcagagcgggccaaaaagaagaaauuagagacaguagagugcauaguaaaagaacuuuaucaaggaacauuaguaagaaucaauggcuaugauuauagaauagcaggcucaagcggaaaacaauucgaacuacacaacggaauaaaccucauaguagaaccuuggguggaaaaaguccuaaaagaaaccgacaaauuuguaagaaaaagcaacucaaaacuagacaagaaacaacaaaaagaaaacacaacagaaacacuuauagaaaaacaauuaaacgauguuuuugaauaucuuugucgaaaacuaaaucaaggaaucuucaaaaacaauaaacacacacuaccagcaaaacuccuaggggauucaauacagaaaagguucgaagacgccagcauagaagaugaguucgaagucauaaaagaacuaaucagugcuauagcuaaaaauccccagaacuucaaaacaauacaaaaagucuuagauauuuccggaaguucaauuccaagauuuaaccuaaaacucaccaaaaauaacgucgacgaguucauaaucaaaaacgaauccgucacaggauuauuuacucacgaaaaagucauuuuucgaaaauga

SEQ ID NO: 5589 - RNA, 4188 nt, Artificial Sequence
  Cas9 variant
augaaaaaagagauaaaagacuacuucuuagggcuagacgucggcacagguucagucggaugggcagucacagacacggauuacaaacucuuaaaagcaaaucgcaaggaucuauggggaaugagaugcuucgaaaccgcugaaacugccgaaguacguagauuacacagaggagcacgaagacgcauugaacguagaaaaaaaagaauaaaacuucugcaagagcucuuuucgcaagaaauagcgaaaauugacgagggauuuuuccaacguaugaaagaaagcccauuguacgcagaagauaaaacaauccuccaagaaaacacucuauucaaugacaaagauuucaccgacaaaacuuaccauaaagccuauccaacuauaaaucaucuuauaaaagcauggauugaaaacaagguaaaaccggauccuagacuacucuauuuagcgugucacaacaucauaaaaaaacgaggccauuucuuguucgaaggagacuuugauucugaaaaccaauucgacacaucaauucaagcuuuauucgaauaucucagagaggacauggagcuagacauagaugcagacucccaaaaagugaaagaaauauuaaaagacucaucacucaaaaacuccgaaaaacaaucaagauuaaauaaaaugcuagggcuuaaaccaagugacaaacagaaaaaggccauuacaaaccuaauaucggguaacaaaauaaacuucgcagaccuauacgacaauccagacuuaaaagacgcugaaaaaaacagcaucucauucucaaaagaugacuucgaugcgcucagcgacgaucucgcaaguauacucggugauucauuugagcuccuauuaaaagcaaaagccguauauaauugcucuguacucuccaagguaauaggagaugaacaauaccuuuccuuugcaaaaguaaagaucuacgaaaaacauaagaccgaccuaacaaaacuaaagaauguuaucaaaaaacacuuuccaaaagacuacaaaaaagucuucggcuacaacaaaaacgaaaagaauaauaacaacuacuccgcauauguaggaguauguaaaauaacacacaaaaaauuaguaaucaaaaauucugcaucccaagaagacuuuuacaaauuuuuaaaaacaauccuauccgcaaaaucagaaauuaaagaaguuaacgacauacuaacagaaaucgaaacaggcacauucuuaccaaagcaaauuucaaaaucaaacgcagagauaccuuaccaacuaagaaaaauggaauuagaaaaaauauuaucaaacgcagaaaaacacuucaguuuuuuaaaacaaaaagacgaaaaaggauuaagucacuccgaaaaaauuaucaugcuucucacauuuaagauaccauauuacauaggacccaucaacgacaaccacaagaaaucauucccagauagauguugggucgugaaaaaagaaaaauccccgucagggaaaaccacaccauggaauuucuuugaucauaucgauaaagaaaaaacugcggaagaauucauaaccaguagaacuaacuucugcacguaucugauuggcgaauccguacugccuaaaagcucuuuacuguauuccgaauauaccguacuaaacgagauaaacaacuuacaaauaauaauugauggcaaaaauauuugcgacauuaaacuaaaacaaaaaauauacgaagaacuuuucaaaaaauacaaaaaaauaacacaaaaacaaauaucaacauuuauaaaacacgaaggaauuugcaacaaaacagacgaaguaauaauccuuggaauagacaaagaauguaccucaucgcucaaaucguauauagaacucaaaaauaucuuuggaaaacaaguagaugaaauuuccacaaaaaauauguuagaagaaauaauucgaugggccaccauauacgacgaaggagaaggaaaaacaauauuaaaaacaaaaaucaaagcagaauacggaaaauacugcagcgacgaacaaaucaaaaaaauuuuaaaccucaaauucucgggauggggccgucuaucacgaaaauuuuuagaaacugucaccucagagaugccgggauuuagcgagcccguaaacauaauaaccgcaaugagagaaacacaaaauaacuuaauggaacuauuaucaucagaauucaaguucaccgaaaacauaaaaaagauuaauucagguuucgaggaugccgaaaaacaauucucauauaacggccuagucaaaccgcuauuccugucgccgaguguaaaaaaaaugcuuuggcaaacacuaaaacuagucaaagaaauaagucacauaacacaagccccuccaaaaaagaucuucaucgaaauggcaaaaggcgcagaacuagagccagcacgaacaaaaacacgacucaaaauacuacaagaucucuacuccucuugcaaaaacgacgcagacgcuuuuucaucagagauccaauaucuaucaggaaaaauagaaaacgaagauaaucuaaggcuacgaagcgauaaacuguaccuauacuacacccaacuuggaaaaugcauguacuguggcaaaccaaucgaaauaggacaugucuucgacaccuccaacuacgacaucgaucauauauauccacaaucaaaaauuaaagacgacuccaucucuaacaggguacuaguuuguagcucaugcaacaaaaacaaagaagacaaauacccacuaaaagcagaaauucaaagcaaacaaaggggauucuggaacuuuuuacaaagaaauaacuucauaucacuagaaaaauuaaaucgacuaacaaggacaagucccaucuccgacgaugaaaccgcaaaauucauugcacgccaacugguagaaacaagacaagccacaaaaguggcagcaaaaguucuagaaaaaauguuucccgagaccaaaauagucuacaguaaagcugaaacaguaucaauguucagaaauaaauucgacauaauaaaaugucgagaaauaaacgacuuucaccacgcgcacgacgcguaccuaaacaucguaguaggaaauguauacaauacuaaauucaccaacaacccauggaauuucaucaaagaaaaacgagacaacccaaagauugcagauaccuauaauuacuauaagguuuucgacuacgauguaaaacgcaacaacauaacagcgugggaaaaaggaaaaaccaucauaacaguaaaggauaugcuaaaaaggaacacucccauauauacuagacaagcagccuguaaaaaaggcgaacuauuuaaccaaacaauaaugaagaaggguuuaggacaacauccacucaaaaaagaaggaccgcuaucuaacauaagcaaauacggcgguuauaacaaaguaucagcugcauacuacacauuaauagaauaugaagaaaaaggcucaaaaauaagaucauuagaaaccauaccccuauaccuuguaaaagauauacaaaaaaauaaagacgguuuaaaaucauaccuaacagaccaaauuggcaaaaaggaaauaaagauccuaauacccaaaaucaaaaucaauucucuacuaaagauaaauggguucccgugccacaucacaggcaaaaugggugaagcuuucguucuacgacccgcaguucaauuuuguuguucaaaugaugaagcacucuauuuuaaaaagauaauuagauucaaugaaauaagaaaacagcgagagaaaaugggaaaaacaauaucgccguacgaagaccuaaguuuccgaaguuacauaaaagacaaucuuuguaaaaaaacuaaagcagaugagauagaagaaaaagaauucuacgaucuuuuacaaaaaaaaaaucuagagaucuaugauaugcuccugacaaaacauaaagacacaauauauaaaaaaagaccaaauucagcaacuaucgauauauuaguuaaagguaaagaaaaauucaaaucuuuaauaaucgaaaaucaauucgaaguaauccuagaaauucugaaguuauucuccgcaacacguaaugucucagaucuucaacacauaggcgguucuaaaaaugccggcaaugcacgaguaggaaauaaaauaucaaguuuagauaauuguauccuaaucuaccaaucaaucaccggcauauucgaaaaaagaaucgauuuacugaaaaucuga

SEQ ID NO: 5590 - RNA, 4188 nt, Artificial Sequence
  Cas9 variant
auguccuucaaaaaaauuuuaggcuuagauguaggaguggcuagcauaggcugggcagucguaagggaaaacgaagaaaacccaaauuuuaauacaauaaccaaauuaggaguaaggguaguuccaauaacaucggacgaaaaacuaaauuucgaaaaagggaaaucuaucacgucaaacgcagaaagaacacuggcacgaucaucuagacggaaucuccaacgauuccgucuaagacgaaaaaaccuaaucgcuaucuugcugcaaaaccagauaauaaccccaacaacuccucucaccgaaaaaggcaaauucaccacuuucgaaacauuaaaaauaagagcuaaagcuacaaaagaaaaaauugaacuagaagaacucgcacgaguccuacuccauaucaauaaaaaaagagguuauaaaucuucacgaaaagucaaaaauucagaagacggaaaagccauagauggaauggaagcugcaaaaauccuauaugagaacaagcuaaccccaggucaauacacguaucagcuucuagaaaaaggaaguaacaaaauaccugauuuuuacugcagugacuuacaaauagaaugggaaguaauauggaauuuucaaaaacaauucuaccccaaccucuuaacagaagauuucaaaaaagaacugaaagggauuggccagagggccacagcugcacuguucuuaaaaaaauacggcauauauacagcacuaaauaaaggcaaacgagaagaaaaaaaauugcaagcuuauaaauggagaucaaaaucaguaagugaaaaaauaccaguggaagaacucgcauacguuauugcagaaaucaacagucacauuaccaauucaucagguuauuugggaacaaucagcgauagaucaaaggaacuauauuuuaaccagcaaaccauaggagagaaucucuaugcacaaguugccaaaaauacgcaugccaaacuaaaaaaucaagucuuccuucgacaagauuacagcgccgaauuugaacaaaucugggaaacucaagcuaaauuccacccacaacucacuccagagcuuaaaaagaaaauaagagauucaauaauauucuaccaacgaaaacuuagaagccagaaacgauuaauaagcaucugcgaauucgagaauagagaaaucgaaauaauaaaaaauggaaaaaaaaaaaaaaaaaaaauuggcuuaaaagcugcaccuaaaucuucgccauuauuucaagaguuuaaaaucuggcaaguacuaaacaauauugucauaaaacaagaaggcaaagacagacuauuaacaugggaagaaaaagagcuacuauucaccgagcuaaacaucaaaggaaauauuagcgggcaaaaagcccuugcucuuuuaaaacucuccccaaaagacaccaaaauaaaugucacuauacuggaaggcaaccacacccaagaacaauuauaucgaguuuaccuacgcauacuaggcauggaaggguaugauguauuugaccuucugaaaauaccagaaaaccaagaugaaauuaaaccagcagauucaaaaauuucagcagccgaaauaaaagaaaccguaaaaucaguauucaaaacauguucaaucucgccaucaauauuagacuucgaccccuuacuacccaaccccgaauuugaaaaccaaucaucuuaccaacuguggcaccuacuauauuccuacgaaggggauaguucaccuucaggaaacgaaaaauugcuagaauugcuaaaaaauaaauuuggcuucaagaaagaacaugcacuucuacuugcaagcaucagcuauacauacauauacggaaaccucucuucaaaagcaaugaggaaaaucuacccuuacucaaaagaaaauaccuacucggaagcuugcaugcuagcaggauaucgucauucuaaaaacgcacuaccaagagaagaacuaguaaaguaccagcuaaaagaccgacuagagauauuaccaaaaaacucccuuagaaauccaguaguagaaaaaguauuaaaucaacuaauaaaccuggucaauucauugauggacgaauauggagcauucgaugaaauaaggcuggaaauggcacgggaacuaaaaaaaaacgcaaaagaaagagaaaaauggucaaagaauaucgcugacgcuacaagccgaaaccaaaaacaugcugagauccuaaaaaaagacuucaaaauaagcaauccguccaaaaaugaccucauacguuauagauuauacuuagaacuuaaagccaacggcuauaacgacuuauacacaaauacuuacauugacauaaacuaucuauuuacucaccgauacgacauugaucacaucauaccgcagucaaagguauuagacgacucauuuucaaauaaaguacuaguaccacgucaagccaaccuagaaaaaagcaaccucacagcauuugauuauauuucccaucagggaaaagaaaaagaagaacacuaucuuaacgucauaacugagcuauauaagcgagguucuauauccgaaaccaaauauaaaaaccuacaaaaaaagggaaacgaaauaggagaagguuucauaaauagagaccuaaaaaauacccaauauauaguaagaaaggccagagagauuuuaagucucauuacaccgaauguugucacaaccacaggcgaaauuacagcaaaauuaagaaaggauuggaaucuaaucaauaguaugaaagaacuaaacauggacaaauucagaaacgcccggcuaacagaacugguagaaaacagccgaggugaaaaaaaagaaauuauaaucgauuggaacaaaagaaaugaucaaagacaccaugcuauagacgcauuaguaguagcauuuacgacacguaaucacguacaauacuuaaacuacaugaacgcuagggaagaugaaagccauaaacaacacucucacauacuaucuauagaaaaaaaaauaaaauacgacaaauuccaugaaaauggaagccgacaaucucgguucaucuaucccacaaguaauuuucgugaagaagcaaaaaaaaaacuaaaggaaauauuagugucauauaaaaccaaaaauaaagucguaaccguuaauauaaacaagccaaaaaaaaaaggcggcuauaguccaaaacacgaauugacuccacgcggcccucuacacaaagaaaccaucuacgguaugauaagaaucuuacauacaaaagaaauaaaaguuucaucuaaauuaaauuucgaaacgguggucagaauacaaaaccccagauauagaaacgcauugcuagaacgcuuaaaagauaauuuuaaugacccaaaaaaagcauucucuggaacaaacucauuaacaaaaaauccuguauuucugaccgcaaacuccacagaaacaguaccagaaaaaguuacuauacaaugguucgaaaaaguguauacuauacgcaaaccuaucaaucccacaaauuuuaaaaacgaaaaaaacaucgaaaaaguacuugacccuacaauucgcaccuuacugaaaaaaaggcuacaagaauauaacggaaacgcaaaagaggcauucucggaccuggaaaaaaauccgaucuggcuaaaccaagaaaaagguaucugcauaaaaacaguuacaaucacaggaauauccaacguagaaucuuuacacaccaaaaaagaucacuuugguaaagaacuacuagacauaaauggaaauccaaucccuguagauuuuguaaguacaggaaacaaccaccacguugcaauauaugaagauagugaagggaauuuacaggagaaaguuguaucauucuaugaagcagucgaaagaguaaaucaaggguuaccggucauagacaccuuauauaacuuagaccuaggauggaaauuucuauuuaccaugaaacaaaacgaaauguuccuauucccagcagacgauuucgacccaaacgacauugacauuuaugaugaaaagaaucuaauacuaaucagcaaacauuuguuuagaguccagaaacuuucaucaaaagacuacuguuucagacaccacuuagaaacgucuauaaacuuuaaugaccccgcacuaaaagguauaacuuggcguagagaaagccccaauggccuacgaaaucuuguuaaaguuagauuaaaccacuuaggcaaaauugugcacaucggggaauga

SEQ ID NO: 5591 - RNA, 4188 nt, Artificial Sequence
  Cas9 variant
augaaaaaagaaauaaaagacuauuuucuuggauuagacguuggcaccggaucaguuggcugggcaguaacagacaccgacuacaaacuccuaaaagcaaaucauaaagaucuuugggggaugcgauguuuugaaacagcagaaaccgcagaaaaaagacgacuuuucagaggugccagaagaagaauagaaagacguagaaaaagaaucaaacuccuccaagaauuguucucucaagagauagcaaagauagacgaagauuucuuccaacgaauggaagaauccccuuucuacgcagaagauaagacuauacuacaagaaaacacgcuauucaacgaucgagacuuuacagacaaaacauaucauaaagcuuauccaacaauuaaccauuuaauaaaagcauggauagaaaacaaagucaaacccgauccuagauuauuguaccuagcaugccauaauauuauaaaaaaaagaggucacuuucuauucgaaggagacuucgacuccgaaaaucaauuugacacuagcguacaagcccuauucgaauacuuacgagaagauauggaguuagacauagaugcugacaguaaaaaaaucaaagaaauccuuaaagacagugcucuaaaaaacucagacaagcagaauaggcugaacaaacuucuuggcuuaaaaagcucugauaaacaaaaaaaagcccugacaaauuugauuucgggcaacaaagcaaacuucgcagauuuauacgacaacccugaccuaaaagaugcagaaaaaaauuccaucucauuuucgaaagacgacuuugaugcacuuuccgacgaacucgcuaguguacucggagacucauuugagcuccuucucagagcgaaagcuguauacaacugcagcguccuaucaaaaguaaucggugacgaacaauacuuaagcuucgcuaaaguaaaaaucuaugagaaacauaagaacgauuuaaccaaacucaaagaagucguaaaaaaauauuucccgauagaauaucgcaauauauucggauauaaacaaagugaaaacaauaauugcaauuauuccagauauguuggaguauguaaaucuggaagcaaaaaaaaaguuaucaacaagacagcgucacaagaggacuucuacaaauuucuaaaagacauauuacuaaaaaggucagacguaccagaagccaacggaauacucacagaaauagaaaccgguacauuccuaccaaagcaaauaucaaaaaauaaugcggaaauaccuuaucaauuaagaaaaaucgaauuagaaaaaauccucaccaaugcggaaaaauucuuuucguuucucaaacaaaaagaugaaaauggccuuucccacucagagaaaauaauaauguuacuuacauuuaaaauacccuauuacauagggccuaucaacacuucacacaaacaauauuucccagauagaucaugggugaucaaaaaagaaaacgccccacaagaaaaaauuacacccuggaacuucuucgaccacauugacaaagagaaaaccgcugaagcuuucauuacaagccguacaaacuuuuguacguaccuaauaggagaauccguauuaccaaaaaacagccugcuauacucugaauacacaguccucaaugaaauaaacaaccuucaaauaauaauagacggaaagaauauaugcgaugucaaauuaaaacaaaagaucuacgaagaacuuuucaaaaaauacaaaaaaguaacccaaaaacagauaagcacauuuaucaaacacgaaggaauauguaauaaaacagacgaagucauaauccuaggaaucgauaaagaaugcaccucauccuuaaaaaguuacauagaauuaaaaaacauuuucgguaaacaaguugaugaaauuucgacaaaaaacaugcuagaggauauaauccgaugggccaccauauacgaugaaggagaaggaaaaacuauucuuaaaacaaaaaucaaagccgaauacgaaaaauauuauucagacgaacaaauaaaaaaaauauuaaaucuaaaacuauccggcuggggaagauuaagccgaaaguucuuggaaucuaucacaagcgaaauuccaggauucauagaaccaguuaauaucauaaccgccaugcgagaaacacaaaacaauuuaauggaacuacucucuucgaaauucaaauucaacgagaacauuaaaaaaauaaacucaggauucgaagacacagacaagcgauuuaguuacaacucucuaguuaagccuuuauuccuauccccuucugucaaaaaaaugcuguggcaaacuuuaaaacuaguaaaggaaauaucacauauaacacaggcacccccaaaaaagauuuuuauagaaauggccaaaggugccgaguuggagcccgcacgaacgaaaacaagguuaaaaaucuuacaagaccuauauaacucauguaaaaaugaugcagaugcuuucagcucugagauucaauaccuacucggcaaaauagaaaaugaagacaaucuucgguuaagaagcgacaaacuuuaucuauacuacacccaacuaggaaaauguauguauugugguaaaccaauagagauaggccacguuuucgauaccucaaaguacgacauugaccauauauacccgcaaucaaagaucaaagacgacuccaucaacaaccgaguccuagucugcagcucuugcaacaaaaacaaagaagacaaguacccacuaaaaccagaaauacaacuaaaacaaaaaaaauuuuggaauuuccuucaacgaaacaacuucaucagcauugaaaaauuuaaucguuuaacuagaacaacccccauaucagaugaugaaacagcaaaauucaucgcacgacagcuaguagaaacuaggcaagccacaaaaguagcagcuaaaguucuagaaaaaaucuucccugaaacaaauauaguauauagcaaagcugaaacaguaucuauguuccgcaauaaauucgauauuaucaaaugccgagaaaucaacgacuuucaccaugcccaugaugcauaccuaaauaucguagucggaaauguauauaacacuaaauucacaaacaacccuuggaauuuuauuaaggaaaaaagagauaacccuaaaauaggcgacacauacaacuauuacaaaguguucgacuaugacguuaaacggaacaauaucacagcaugggaaaaggaaaaaacaauaaucacaguaaaaacaaugcuaaaaagaaauacccccauuuauacuagacaagccgccugcaaaaaaggagaacuuuucaaccaaacuauaaugaaaaaaggacuaggucaacauccacuaaaaaaagaaugcccuuucucaaauaucucaaaguacggagguuacaacaaaguaucagcagccuauuacacuuucauugaauacgaagaaaaaggcaacaaaauacgaucacucgaaacaauacccuuauauuuagaaaaagacauacaaaaaucacaagauggacugaaaggcuaucuaacagaucagcuaggcaaaaaagaaauaaagauacuuguaccuaaaauuaaaauaaacucauuacuuaaaauaaacggauuccccugucacaucacuggaaaaaccggagccuccuucguacuaagacccgccguacaguuuugcugcucaaacgaugaagucuuauacuucaagaaaauaauaagauuuaacgaaauaagaagucaacgagaaaaaaugggaaaaacaauaucuccauacgaggaccuuaguuuucgcucauacauaaaagaaaaucuuugcaaaaaaacaaaaaacgaugaaauaggcgaaaaagaauucuauggauuccugcagaaaaaaaaucuagaaauauacgauaugcuacuaauuaaacacaaagacacaauauauucaaaacgaccaaauucaacuacacuagauaugcuaaucaaaggacgcuaugaauucaucaaucuaaaaccagaagaucaaauuagaguaauguuagaaauccuaaaacucuucugcaccacuagagaagucaucgacuuagggcuaauaaaaggcaaguccgaagcaggcguuacaacuuuaggaaaaaaaauaagcaaccuugauucauguauacuuauauaucaauccauaaccgguauauuugaaaaaagaauugacuuacuaaagauuuga

SEQ ID NO: 5592 - RNA, 4188 nt, Artificial Sequence
  Cas9 variant
augaaaaaggaaauuaaagauuauuuucuaggacucgacguagguacgggcaguguaggaugggcagucacagacacagacuauaaauuauuaaaagcgaauagaaaagaucuauggggaaugcgcuguuucgaaacagcagaaacagcagaaguucguaggcuacacagaggagccaggagaagaauagaacgcagaaagaaaagaaucaaauuacuucaagaauuauuuucacaggaaauagcuaaaacagacgaaggauuuuuccaacgaaugaaagaaagcccuuucuacgccgaagacaaaacaauucugcaagaaaaugcacucuuuaaugacagagacuucacugacaaaacauaucacaaggccuaccccacuauaaaucaccucauuaaagcauggauagaaaacaaaguaaaaccagauccccgcuuauuauaucuagcaugucauaacauaauaaaaaaacgaggacauuuccuauucgaaggagacuuugauagcgaaaaucaauuugacaccucaauccaagcauuauucgaauauuuaagagaagacauggaaguagauauagaugcagacucucaaaaagucaaggaaauccuaaaagacucaaguuuaaaaaacagcgaaaaacaaucaagauuaaacaaaaugcuuggacugaaaccaagcgacaaacaaaaaaaagcgaucacuaaucuaaucaguggaaauaaaauaaacuucgcagauuuauaugauaaccccgauuuaaaggacgcagaaaaaaauagcaucagcuuuucuaaagacgacuucgacgcucuuucugaugaccuugcaaguauacucggagacucuuucgaauuauuacuaaaagcaaaagcaguauauaacugcucaguccuaucaaaagucauuggcgaugaacaauaccuuagcuuugccaagguaaaaauauacgaaaaacacaaaacggaucuaacaaaauuaaaaaacgugauaaagaaacacuuuccaaaugauuacaaaaaagucuuuggauauaacaaaaaugaaaaaaacaauaacaauuauucggccuacgugggcguuugcaaaaccaaaaguaaaaaacuuguuauaaauaauacugucaaccaagaagauuucuacaaauuucucaaaccgauucuacucgcaaaaagugaaauaaaagaagugaacgauauauugaccgaaauagaaacugguacuuuucugccgaagcaaauuucuaaaucgaaugcagaaaucccauaucagcuuagaaagauggagcuagaaaaaauauuauccaacgcagaaaaacauuucucuuuccucaagcagaaagaugaaaaagggcuaucacacagcgaaaaaaucauaauguuacuaacauucaaaauuccuuacuauauaggucccauaaacgacaaccacaaaaaaucauucccagaucgcuguuggguuauaaagaaagaaaaaucacccagugguaaaacaacaccauggaauuucuuugaccauaucgauaaggacaaaacagccgaggcauuuauaacgucccguacaaauuuuugcacauaucuaguuggggaauccguacucccaaaaaacucauuauuguacucagaauauacaguauuaaacgaaauaaauaauuuacaaauuauaaucgauggaaaaaacaucugcgacauaaaacuaaaacaaaaaauauaugaagaacuauucaaaaaguacaaaaaaaucacacaaaaacaaaucucuaccuuuauaaaacacgaaggaauuugcaacaagacagaugaggucauaauacucggaauagauaaagaauguacuucaucucuaaaaucauacauugaacuuaaaaacauauucgguaaacaaguagacgaaauaucaaccaaaaacauguuagaggaaaucauuagaugggcaacaauauacgacgaaggagaaggaaaaacgauacuuaagacgaaaauaaaggcugaauauggaaaauauuguucagacgaacagaucaaaaaaauacucaaucuaaaauucagcggauggggccgacuuucaagaaaauuuuuagaaacagucaccucagaaaugccaggcuuuuccgaacccguaaauauuauaaccgcgaugagagaaacucagaauaacuuaauggaacuguuaagcucagaauuuaaauucacagaaaacaucaaaaaaaucaauucaggauuugaagacgucgaaaaacaauuuagcuacgauuccuuagugaaaccauuauuuuugucuccaucagugaaaaaaauguuauggcaaacacugaaauuagucaaggaaauuucacacauaacacaagcgccgccaaaaaaaauauucauagaaauggccaaaggggccgaauuagaccccguacgaacaaaaacacgauuaaaaauacuacaagacuuauauaacaacugcaaaaacgacgcagacgcauucagcucagaaauaaaagaccucucaggaaaaauagaaaaugaagacaacuuaaggcuaagaagugacaaacuauaucuguauuacacacaacuaggcaaaugcauguacugcgguaaacccauagaaauaggacacguauuugauacaucaaauuaugacauagaccacauauauccccaaucaaaaauaaaggaugacucuauaucgaacagaguauuaguaugcaguucauguaacaaaaacaaagaggacaaauacccccuaaaagccgaaauucaauccaaacaaagagguuuuuggaacuuucuucaaagaaacaacuuuauaucccuagaaaaacuaaaucgacuaacacgaaccucuccaauauccgacgacgaaaccgcgaaguucauagccagacaacuuguugaaacacggcaagcaaccaaaguagccgcaaaaguuuuagaaaaaauguuuccagagacuaagauagucuauucaaaagcugaaacggucuccauguuccgaaacaaauuugacauaauaaaaugccgcgaaauaaaugacuuccaccacgcacaugaugcauaccuuaacaucguaguuggaaauguauauaauacaaaauucacaaauaauccauggaacuuuauaaaagaaaagcgcgacaacccuaagauagccgacacuuacaacuauuauaaaguuuucgacuaugacguuaaaaggaauaacauaacagcuugggagaaaggaaaaacgauaauaaccgucaaagacaugcuaaaaagaaacaccccaauauacacaagacaagcagccuguaaaaaaggagaacuauucaaccaaacaauaaugaaaaagggacuuggacaacaccccuugaaaaaagaaggcccuuuaaguaauauaucuaaauacggcggauacaacaaggucagcgcagccuacuacacgcuuauagaauacgaggaaaaagguucaaaaauccgcucacuagaaacaauaccacucuaucuaguaaaagacauccaaaaaaauaaagauggccugaaaucauaccuaacagaccagauaggaaaaaaagaaauuaaaauccuaauacccaaaaucaagauaaacagucucuuaaaaaucaacggauucccaugccauauaacaggaaaaaugggugaagcguuuguacugagaccagccguucaauuuuguugcucgaaugacgaagcauuguauuucaaaaaaauuaucagauucaacgaaauacguaaacagagagaaaaaaugggaaaaacaaucucaccuuaugaagauuugucauuuagauccuauauaaaagacaaccuauguaaaaaaacaaaggcugaugaaauagaggaaaaagaauucuacgaccuccuacaaaaaaaaaacuuggaaauauacgacauguuauuaacuaagcacaaggauacaaucuauaaaaaacgacccaauuccgcaacaaucgacaucuuagugaaaggaaaggaaaaauucaaaagccuaauaauagaaaaccaauuugaagugauuuuagagauauuaaaauuauucagugcgacccgcaaugucucagaucuacaacauauaggaggcuccaaaaaugcagggaacgcaagaguuggaaacaagauauccucacucgauaauugcauacuaaucuaccaaucaauaacaggaauuuucgaaaaaagaauugacuuauuaaaaaucuga

SEQ ID NO: 5593 - RNA, 4188 nt, Artificial Sequence
  Cas9 variant
augaagaaagaaauuaaagacuacuuuuuaggauuggacguaggaacagggucaguuggcugggcaguaacagacacagacuauaaauuacuaaaagcaaaucgaaaagaucuauggggaaugagaugcuuugaaacugccgaaaccgcggaagugagacgauuacauagaggagccagacgaagaauagaacgacggaaaaaacgaauaaaacuacuacaagagcuauuuucucaagaaauagcaaaaauagacgaaggauuuuuccaacguaugaaggaaucacccuucuacgcugaagauaagacaauccuccaagaaaacgcacucuuuaaugauaaggauuuuacagacaaaacauaccauaaagcuuacccuacaaucaaccaccucaucaaagccuggauugaaaauaaaguuaagccagauccccgacuucucuacuuagcgugccauaauaucauaaaaaaaaggggccauuucuuauucgaaggggacuucgacucagaaaaccaguucgauacaagcauacaagcccuauucgaauaucugcgagaggacauggaaguagauauagacgcagacucacaaaaagucaaagaaauacuuaaagacucaucacuaaaaaauucagaaaaacaguccagauuaaauaaaauucucggacuaaaaccauccgauaaacaaaaaaaagcaauaacaaaccuuauaucaggaaauaaaauaaauuuugccgaccucuaugauaacccagaucuaaaagaugcagagaagaauucaauaucuuuuaguaaagaugacuuugaugcccuauccgaugaccuagcauccauacuaggagauaguuuugaauuguuacucaaagcuaaagcaguauacaacuguagcguucuaucaaaagucauuggcgacgagcaauaucuaucauucgcaaaaguaaaaauuuacgaaaaacauaaaacagacuuaacaaaacuaaaagcaguaauaaaaaaacacuuuccgaacaacuauaaaaagguauuuggguauaaucaggacaacgaauccaaaaacaacuacucuggguacguaggagucuguaaaacgaaaaacaaaaaauuaguuauaaacaauaguguaaaccaagaagacuucuacaaauuucuuaaaccuauuuuaucugcaaaaucggaaauuaaagaaguaaaugacauccuggcugaaaucgaaacugguaacuuccuaccgaaacagauaagcaaaucgaacgcagaaauaccauaucaauuaagaaaaauggaacuugagaaaauacuaagcaaugcagaaaagcauuucucauucuuaaaacagaaagacgagaaaggacuuagccacagugaaaaaaucauaaugcuacuaacauucaaaauaccauacuacaucgggccaauaaacgauaaucauaaaaaaucuuuuccagacagauguuggguggugaaaaaagaaaaaagccccucaggaaaaacaacaccauggaauuuuuucgaccauaucgacaaagaaaagacugcagaagaauucauaacaucacgaacaaauuucuguacauaucuaauaggcgaaucaguacuacccaaaaacuccuuacuguacuccgaguacacaguccuuaacgaaauaaacaacuuacaaauaaucauagacgguaaaaacauuugcgacacuaaauugaaacaaaagauauaugaagaucuauuuaaaaaauacaaaaaaauuacucaaaaacaaaucagcacuuucauaaaacacgaagguauaugcaauaaaaccgaugaaguaauuauuuuaggaauagauaaagaauguacuucaucucucaaaagcuacauagaguuaaaaaauauuuucgguaagcaaguagaugaaauuucaacaaaaaacaugcuggaagagauaauaagaugggcaacaauauacgacgaaggagaaggaaaaacgauauuaaaaaccaaaauaaaagccgaauacggaaaguauuguucugacgaacaaauaaaaaaaauauuaaacuuaaaauuuagcggauggggacgcuuaagccguaaguuucucgaaacaguaacaucagaaaugcccgguuuuagugaaccaguaaauauaaucacugcuaugcgugaaacgcaaaacaaccuaauggaauuauugaguagcgaguucaaauucacagaaaacauaaaaaaaaucaauucaggcuucgaagacgccgaaaaacaauucuccuaugauggauuaguaaaaccuuuauuucuuagcccuucaguaaagaaaaugcuguggcaaacacucaaacuaguuaaagaaaucucgcauaucacacaagcaccccccaagaagauauucauagaaauggccaaaggugccgaacuggaaccagccagaaccaaaacgagauuaaaaauacuucaagauuuauacucuagcugcaaaaaugacgcggacgcauuuucaagugaaauucaauaucuuuccggaaaaaucgaaaacgaagacaaucuccgauuacgaagcgauaaauuauacuuauacuacacacagcuagggaaaugcauguacugcgguaaaccaauagaaauuggacacguauuugauacaucgaauuaugauaucgaucauaucuacccgcagaguaaaauuaaagacgacucuaucucaaaucgaguccuaguaugcucuucuugcaauaagaacaaagaagauaaauauccacuuaaauccgaaauacaaucaaaacaaagaggcuucuggaauuuucuacaaagaaauaauuucauuucccuugaaaaacucaaccgccuaacccgaacuacccccauaucugaugaugaaaccgcuaaauucauagcacgccaacuagucgaaacacgucaagccaccaaaguagcggcaaaaguuuuagaaaaaauguucccggaaacaaaaauuguguacucaaaagcagaaacaguaagcauguucagaaacaaauuugacauuaucaagugucgagaaaucaacgauuuccaccacgcacaugacgcauaucuaaacauaguaguaggaaacguauauaauacaaaauucacaaacaacccauggaacuucauaaaagaaaaaagagacaauccaaaaauagccgauacauacaacuauuacaaagucuucgacuacgaugucaaaagaaauaacauuacagcaugggaaaaaggaaaaacgauaauaacaguuaaagacaugcucaagagaaacacgccaauauacaccaggcaagcagccuguaagaaaggugaacuauuuaaucaaacuauuaugaaaaaaggauuaggacagcacccacucaaaaaagaagggccauuuucuaauaucagcaaauacggaggauauaacaaaguaucagcggccuauuauacauuaauagaauaugaagaaaaaguaaacaaaauacgcucacuugaaacaauaccccucuauuuaguaaaagacauacaaaaagaccaagaugugcuaaaaaguuaucuaacugaucuacucggaaaaaaagaaauaaaaauacuagucccaaaaauaaaaauaaauucauugcuuaaaauuaacggauucccaugucacauaaccggaaaaacaggagauuccuucguacucagaccagcaguccaguucuguugcagcaaugaugaaguccuguauuucaaaaaaaucauacguuuuaaugaaauacgaucccaaagagaaaaaaugggaaaaacaaucucacccuacgaagaucuauccuuuagauccuauauaaaagaaaauuuaugcaaaaaaaccaaagccgaugaaauaggagaaaaggaauucuacgaccuacuacaaaaaaagaacuuagaaauauacgauauguuacuuacaaagcacaaagacacaauauacaauaaaagacccaauuccaccacacuuggaaugcuaacaaaaggccguuacgaauuuauaaaccuuaagccaaaagaccaaauuauagucaugcuagaaauccuuaaauuauucuguacaacaagagaagcuaucgaccuaggccuaauaaaaggaaaaccagccgcaggcguagcuacuuuaggaaaaaaaauauccaauuuagauaacuguauacugauauaucaaaguauaaccgguauauucgaaaaacgaauagaccuacuaaaaguuuga

SEQ ID NO: 5594 - RNA, 4188 nt, Artificial Sequence
  Cas9 variant
augaaaaaagaaauaaaagacuauuuuuuaggucuagacguaggcacaggauccgucggaugggccgugacagauacagacuacaaacuacuaaaagcaaaucgcaaagaccuauggggcaugagaugcuuugaaacugcggaaacugcagaaguaagaagacuacauaggggagcaagaagacgcauagaacgcagaaaaaaacgcauaaaacuuuuacaggaacuauucagucaagaaaucgcaaaaauugacgaagguuuuuuccagcguaugaaagaauccccgcuauaugccgaagauaaaacaauucuacaagaaaauacccuuuuuaacgauaaagauuuuaccgacaaaacauaucauaaagcauacccaacaauaaaccaucuaauaaaagcguggauugaaaacaaagucaaaccagauccuagauuacucuaccucgccugucauaauauuaucaaaaaaagaggccacuuucuauucgaaggagacuuugacuccgaaaaucaauuugauacaucaauacaagccuuauucgaauacuuacgagaggacauggaaguagacauagacgcugacucacaaaaagucaaagaaauacuaaaagauuccagccuuaaaaauuccgaaaaacaaucucgacucaauaaaaugcuaggacuaaaaccaagcgauaaacaaaaaaaagccauaacgaaucuaaucagcggcaacaagauaaacuucgcagaucuauacgacaacccugaucuaaaagacgccgagaaaaauuccaucagcuucucaaaagacgacuuugacgccuuaagugaugauuuggcaucaauauuaggagauucauuugaguuacugcuaaaagcaaaagcagucuauaauugcucaguccuuuccaagguaaucggugacgaacaguauuuaagcuuugccaagguaaaaauuuacgaaaagcacaagacugaccuaacaaaacucaagaacgugauaaaaaaacauuucccuaaagauuacaaaaaagucuucggauacaacaaaaaugaaaaaaacaacaacaacuacagcggcuaugucggaguaugcaaaacuaagucaaaaaaauugaucauuaacaauuccguaaaccaagaggacuuuuacaaauuuuuaaaaacaauacucagugcgaaaagugaaauaaaagaaguaaacgacaucuuaacggaaauagaaacuggaacauucuuaccaaaacagauauccaaaucaaaugcagaaauacccuaccaacuccgaaagauggaacucgaaaaaauccugucaaaugcagaaaaacacuucucuuucuugaaacaaaaggacgagaaaggauuaucacauuccgaaaaaauaauaaugcuacucacguucaaaauaccauauuacaucggcccaauaaaugauaaucauaagaaauccuuccccgaccgcuguugggugguuaagaaagaaaaauccccuucuggaaaaaccacaccuuggaacuucuuugaccauauagacaaagaaaaaacagcggaagaauuuauaacuuccagaacaaacuucugcacuuaucuaauaggagaaucaguacucccaaaaaauucacuccuuuacuccgaauacacaguacucaacgagaucaacaauuuacaaauaauuauagacgguaaaaauauaugcgauacaaaacuaaaacaaaaaaucuacgaagaacuauucaaaaaguauaaaaaaauuacacaaaaacaaauaaguacauucaucaaacacgaagguauaugcaacaagacagaugagguaauaauucuuggcauagacaaagaauguacaucaucccucaaaagcuauauagaacucaagaacauauuuggaaaacaagucgacgaaaucucaacaaaaaauauguuggaagaaauuauaaggugggcaacaaucuaugaugaaggugaaggcaaaaccauauuaaaaacaaaaauaaaagcagaauauggaaaauacugcucugacgaacaaauaaaaaaaaucuugaaucucaaauucuccggauggggacgacuaucaagaaaauuccuugaaacgguaaccucagaaaugccuggauucucagaaccaguaaauauaauaaccgccaugagagaaacccagaacaaccuaauggaacugcuaucaucagaauucaaauucacagaaaacauaaaaaaaaucaauucaggauucgaagacguagaaaaacaguuuaguuacgauggacucgucaaaccacuauuccuaucacccucugugaaaaaaaugcuuuggcaaacauuaaaacuuguaaaagaaauuucacacauaacacaagcccccccuaaaaaaaucuuuauagaaauggccaaaggggcagagcuagacccagucaggaccaaaacaagacuaaagauacuccaggacuuauauaacaauugcaagaacgacgcagacgcuuucagcucagaaaucaaagaccuaucuggaaaaauagaaaacgaagauaauuuaagacuaagaucugacaaauuauacuuauacuacacacaacuaggaaaaugcauguacugcggaaaacccauagaaaucggacaugucuuugacaccagcaacuacgauauagaucauaucuacccccagagcaagauaaaagaugacuccauaucaaacagaguucuaguauguaguuccugcaauaaaaacaaagaagacaaauacccucucaaagcugaaauccaaagcaaacaacgaggauucuggaacuuucuacaacgaaauaauuucauaagcuuggaaaaauuuaacagacucaccagagcaacccccauaagcgaugacgaaaccgcaaaguucauugcaagacaacuagucgaaacaagacaggcaaccaaaguagcugcacgaguacuugaaaaaauguucccagaaacaaaaauuguauacucaaaagcagaaacaguaucaauguuucgaaacaaauuugacauaguaaaauguagagaaauaaacgauuuccaucacgcacacgacgcuuaucuaaauauagucguagguaacgucuauaauaccaaguucaccaauaaccuauggaauuucauaaaagaaaaaagagauaacccaaaaaucgcugacacauauaauuauuauaagguauucgacuaugacguaaaaagaaacaauaucacugcaugggaaaaaggaaaaacaauaauaacgguaaaagacauguugaagagaaauacaccaaucuacacacgccaagccgcaugcaagaaaggaggacucuucgaccaaacaauaaugaaaaaaggccucggacaacaccccuugaaaaaggaaggaccauucucaaauauaucuaaauacggagguuauaauaaagucucggcagcuuacuacacuuugauagaauacgaagaaaaagguaauaaaauccgaucacuagaaaccauaccacuauaucuugugaaagauauucaaaaagaucaagacguucuaaaauccuaccuaacagacuuacuaggaaaaaaagaauuuaaaauacuugucccaaagaucaaaaucaacagucuacuaaaaaucaacggauuucccugucauaucaccgguaaaacuaaugauucuuucuuacuaagaccugcuguccaauucugcuguaguaacgacgaaguucucuauuucaaaaaaauuauucgcuuuucagaaauacgcucacaacgggaaaaaaucggaaaaaccauuucgccauacgaagaucucuccuucagaucauacauuaaagaaaaucucuguaaaaaaacaaaaaacgaugagaucggugagaaagaauucuacgaucuauuacaaaagaaaaaucuggaaauauacgacaugcuauugaccaaacacaaagauacuauauauaaaaaaagaccaaauucugcgacuauugacauacucgucaaagguaaagaaaaauuuaagagucucauaauagaaaaccaauucgaaguaauucuagaaauccuaaaauuauucucagcaacuagaaacguaucugacuuacaacacauaggugguagcaaguauuccgguguagcaaaaauaggaaacaaaauaucaagucuagacaacugcauacuuauauaccaaucuauaacuggaauauucgaaaaacgcauagaccuacuaaaaguauga

SEQ ID NO: 5595 - RNA, 4191 nt, Artificial Sequence
  Cas9 variant
auggacagcaguaaacaaggacuacgccgguaucaccuaggauuagacauugguacaaauaguauaggauggacagcaaucgaugaucacuuuucacuuuugagaguaaaaggcaagaaugccauagguguuagaacuuuuaaggaaggagagacggcagcagacaggcgcggauuuagaacugccagaagacgauuaagucgaagacgcuggcgucuccaauuucuugacgaguucuuugcuccauaucuagccgaaguagauccaaacuuucuagcaaggcuaaaacaaagcgauaucucugcaaaagauccagcuaaaaaucaagaauauaugggcaaacuccucuucccagaccaagaagccgcaagugauggaaacggcuauccaacgcuaauacagaugcgcaaagccaugccagcagaaaaagccgcagauuuuccaguauucaacauauaucaauuacgcuaugcacuaaugaaugaaaaacggaaauuugaccuaagagaaaucuacuuggcuguucaucacaucguaaaauauagagguaauuuccucaacaacacaagcgucgauaaauuuaaagcugaucagaucgauuucaauaaaucauucgaaacccuaaacgaccuguuccgacagguccaaccuauagcaccguuccaaaucgaucugacaaaaguagaugaacuugguaaacuuuuacuugauacuaaacaaaagaaacucgauagacaaaaagcugucgcaaaacuacuaccgcuuauagaagauggaacagacaaagaaauuguuaaagcacaucaacagacagcacgugaaauaucuaaauuaauauuagguuauaaagccaaaguuggacuaauucuacaaaacaaucucgaccaaacacuggacaugucuacagaaaauagcgaugaucaacuaaugcaaaucgcagaagaacuagacgauuaccaaauggaacuuauaaaucaacucucauuauuauacucacaaauaaugcugaaugaaauaguacccaacggagaaacagugucugcgagcauguuaaaccgauacuacaaacacagaugucagcucaaagaauugaaagauuauggagccgcccaagacaagaaaacuagagaacaacuagaccaucuauacgcugaauacauaggacaaauaccaaaagacucaaaauuugacuuuacaaaagaccuuaagaaauuaauggauaaaagcgaccuaggacagaaaauaaaagaugaaauagaagcuggugauuaccuaccgaaacaacgaacaucagcaaaugguguaauaccccaucagaugcaucaacaagaacucgaucaaauaaucgaaaaccaaaaagaguauuaccccuggcuagcagagccuaauccagucgagaaaaacauuaaaaaugcaaaauauaaauuggaucagcuaguaucauuuagaguucccuacuauguagggcccaugaucaccuuagccgaucaacagaaaacuucaaaggcuuccuucgcuugggcagucagaaagaaagcagguaaaauaacaccauggaauuucuaugacaugauagauagagaaaaauccgccaauaauuuuauaaaacgaaugaccaauaaagauacauauuuacuaagcgaggacguucucccagcuucaaguuuacuauaccaaaaauucaccguauuaaacgaauuaaauaacauacgaguuaacggucgaaaacuacaaccagcacucaaacaagcaauauauacugacuuauuccaaaaacgaaaaacaguaaaccuaaaaacgcugacgaacuuuuuagcaauacaugaaccaacucucacaaaaccaaaaauagagggcuuaucuaauggcaggucauucaacucuuccuuaggaaccuauauagacaugucaaaaauacucggggacucccuagaugacuuaaacuaccgagaugauaucgagaaaaucauagaauggucuaccguauucgaagauucagaaauauauggaguaaaacuacaagaaauacaaugguuaacaaaugaacaacgagaaaaauuaguuagaaaaagauaccaagguuggggaagacucuccaagaaacuauuaacagguauaacagacgaaaauggacaacgcauaauagauuuaaugugggacaccagcaaaaauuucaugcaaauuguacaucaaccagucuuugaagaacaaauugcagaacucaaccaacagcuuuuacaagaugcagacaaagcuccucuugaaguaguagaugacauauuggcugaugccuauacaucaccucaaaauaagaaagccauuagacaaguaguaaaaguaguagcagacgucguaaaagcaguaggaaaugcucccgccaguauauccauugaguucgcaagaaaugaagaccguaauaaagaacugaaaaacucucgacgacauucaauagaaaaauuauaccaugaaaccgcagaaaaauuagucaaacaaacaaacuuacuagaagaauugggcaauguuaaagaucuaaaugaucgguauuaucuauauuuuacacaagcaggccgugauauguaugacggaacaccuauuaacauagaugaaaucagcacucacuacgaaauagaucacauuuuaccucaaucauuccuuaaagacaacagucuggauaauagagugcuaguaaagaaaagugaaaacgcagcgaaaucugaucgaguaccugcaaaacuauauggagccaaaaugagagcauuuuggaaacaacugaaagaaucgcaauuaauaucuaaucguaaauaucuuaaucucaccacagacccagaacaaguagauaaauaccaaaugcaaggauucguacauaggcagcuaguugaaacacgccaaauaaucaagcuagcagcuaacauauucgggagucuauauccugacagcgcaguaaucgaaacaagagcggaacuaacuaaacaauuaagagaaaaauucagccuauauaagguaagggauguaaacgauuaccaucacgcaguugacgccuaucuuacugccuuugcagggcauuaucuuuaccaacguuaccccaaacuucgccccauguucguauacggagacuacgcuaaaauauaugcagacgaucucaaaagguuaagaucugugaaucucuuucacgaccuugagaaagaccaauacaauucuggaacggcaguaaauccagaaacuaaagagaaaaucguagacgucgacuggcuaagugauuacgugagcaagauacaacacuuuaaguauaugcucauaagcaaagcuguauauacucaacacggccaauuauauggagcaacaauacucccagucgcucagguugacaaaauauccgcgccaauuggcaucaaagaugacaaacccguugacauauauggcgccuacacaaaugaaguugcugcuuauauggcaauagucagaguuaaugguaagaaaccaaaauauaaagucguuuccgucccaguaagaaugcuacaaagacuaaaaauggcugaacaaaaaggacaugaucaguauaugcaaacccuacacgaugugcuauuacgcaauuuuaccucacuaaagaaaaacagaaaaacaggauugaaagaagcaguaguuaaagacuucgacguauuaguaccaugcguaagauauaaccaauuaguaauugauggcgacaccaaauucacauuaggaagcgcuacauaccaacacaacgccaaacagcuaguauuauguaaucacucucucgaaacacucgcgaacaacuuugaauacguaagaaaacauccagaugaagcggacgaaagaaugauaaugcuauaugaugacauauuagaucaaguaaaucacuauuuuaccuuguaugacaaaaauaaauuucgagaaaaauuaaacgcuggaagagauaaauacuuaaaacuacccacguuuucacaauucgaaaauaacaagaaaacagcaaucggaaaaagugaagcaauaauaaauauacuaagaggguuacaugcgaacgcugcuauuacaaaccuaaaaugccuagguguaagcacaccguucggucaacuccaaucaccaucaggcauugaauuaagugaaaacgcaaaacuuguauaucaaucccccacgggucucuucucaagagaaguacuauugaaagaucuauga

SEQ ID NO: 5596 - RNA, 4191 nt, Artificial Sequence
  Cas9 variant
auggcaaauuugagaaacuauaaaggugauuauaauauuggacuugauauggguacagguagcguaggaugggcgguuacggauucagaaggaaaauuauuacauuuuaagaaacaaccgaccugggggagccgucuuuucgacucggcagaaacagcagccagugcgagaauaccaagaggacaacguaggagauauguaaggagaagguggagacuagacuuacuacaacagcuauuucaggacgaaguuaguaaagcggaucccgaguucuucauaagauuaagacaaaguagauuauugaaagaagauagagaggagggacaucgggauuacaaucauccauuauuuaaugauucagacuucacugagacagacuauuauaauagguuuccgacaauauaucaucuaagaaaauggcuaauggaaacggaugaaaaagcggauauccgauuaguauauuuagcagcacacaacauaguuaaacauagagguaauuuucuucgacaagaaaauacgaguuuaagcgcuaaaaacgcucgaccgcuagaugcauugagagaauuuaggucggcauuaguagacuggugugcggaacuuggauacgaauguaauccugacgaaucaggugaaauuaguaacgagauauugucaguccuugaagaggaacacguagcuaacagcgauaaaaagaaacgaauaucgagcuuaauagggguagcaaugaacgaaggagcaaaagagagcaaagcgugcaaugaugcccuugcuggugcaaugguaggauugaaagcagaguucaaaaacguauucggagaaauuucagcagaacagacuagcauauacuugaguaaugacgaagcgguagacgcauuaagagaaggcauaccagaugaaggauuagaacucuucgguaaacuauguagcguauauagcgcguauguacuucagggacugcuaagcuaugcaccaggacaaacaauaucgguaaacaugguagcuaaauaugaaaaauauggaaaugaucugaaaacgcuaaaagcgcuagucugugaauacgcaagagcggaauaugauuccuucuuccgcggagaauuuuauagagaucaggauggacaugaauugaacauauauaacgccaguaaagcacaaggguauacuagauauaauuuagggacaucaaagaugaguuacgaagauuucgaaaaagcgguaaagaaacuauucgcaggaacggcagcugaagaagacggaagauaccugcaaaugaugaaagaauuuggcgaacaacgauuccuaagaagauugaaaacaagugacaauggaaguauuuacuaucaacuucauuuggaagaauuaacagcuauauugaguaaccaagggaaacacuaucccuucuuaguagaagaugcugagaaaauaaaaaguuugguaucuuuucguauuccauauuacguagguccguugacagauagaaacgcaaggaaagauaagcauggcaaaaauagauucgcguggagcgaaagaaagaguggaauggaagacgcgguaauuacaccauggaauugggacgaagugaucgaucgaggaaagagcgccgaagcauucauuacacguaugacuggaauguguacauauuugcagggagaagauguacuaccaaaauguagccuccuguaugaagaguucugcguauuaaaugaauuaaauggaagucgauggggcauggacggagauaaagaacacagguucgaugcagcagaccgggaagcaaucauagaggaacuuuucaaaaagaagaaaaccgugaaauauaaagacgucgcaaacugguuggaaagagaggcagguaggaugaacguucaugucaugggaggccaaggugaaacaggauaugagaguaaauuaaguagcuauuacuucuuucgcagagauaucuuugauguugaagaauuagacagagcugauuauccaaugauugaacaaaucauccuguggaacacacucuuugaagaucggagaauacuaaaagaaaaacuagaagacgcauacgggccaaaaggaaacggacggcuggacgaugaucaaauaaagaaaauaugccgaaaaagauuuacagguugggguagauuaaguaagaaauuccugacaggaauaaaaguugauacggacuguggaccucgaucuauaauggaugugcuaagagaaggagauccuaacgcagguuuccgcggaaaaacaaugguaaugauggaaguccuaagggaugaaaaccuagguuuucagcaaaaaguggaugaguuuaacaaaaacuauuucggucaaaaagggaaagcauuagagguaaaugaauuaccagggucucccgcgauaagaagaucguuaaaccaagcaauaagaauaguagacgagaucgcaaaaauagcaggaaaagacccagaaaguauauuuaucgaaguaacaagagacgacgaacuagacaaaaggggcaaaagaacuaagagacgauacgaugcacugaaagaagcacuaacaguauuuaagaaagaagauccggaaauaugggcagaauuacaagcuacaagccccucggauuuggaugaaagguugacuuuauauuuuaugcaacgagggaaauguuuauacucaggagaaccuauagauauaaacaaacucucaagcggcgaauacgaaguagaccacaucauaccaagaaguuauauaaaagacgauagccuagagaauaaagcucuagugugcagaaaauacaaccaaucaaaaacugacgcgaugcuccuagauccuaguauaaggcgaaaaaugagaaguuauugggauauguuacuagacgcuaaacuaauugggcccaagaaacaucggaaucuacuaagggaucacauagacgaaaaagcgaugaaaggauuuguagcuaggcagcuuguagaaacgucccaaagcguaaaacuagcaggcagccugcuaagcgucagauauccaaacgcgaauauuguaccuguuaaagcaaguaugagccacgauuugcgagaagcugcaggauuuguaaaaugccgugaggcaaacgacuuucaucaugcacacgacgcguauuuagcauguagaaugggacuuuuuauacagaugagacauccuaaaguauaugaaaauccgauagcaaugacaaggguaaugcagaaauaugcacaacaacaaucuaaggaauuuaacagaaaucacagaguuccuggaacaucuggauucauuguaaacagcuuuauguccagcggauucgauaaagaaacaggagagauauuuaaggacacuuggaaugcagaaacagaaaucgaaggaauaagaaaggcucuaaacuaucgucaauguuauauaucuagaaugccaauggaagauaccggagccuuuuggaacgcaacgguauacaguccuagagauccuaaaauggguccaaaguuagcgcugccacuuaagaaaggacuggacccgaaaaaguacggggguuuuagcagccagcaauucgcauauuucuuuguauacgaagcacgcgauaaaaaggauaaacaaguuuuuagauuugcagaagugccuguaugguuagccucccaaauagaaucagauaagauagcacuagagagauaugcaacgggccucgcagaagcagaaaaacuaaaauucguaagaauagaaagagcuaaaauauugaagaaacaacuaauagaaauugauggagauagauuuauacuaacugguaagaaagaaaugaggaauggacgggaacuggcguuaucacaaaaagaaacacuaaaucuaauaguagccggagaugaaaaugcaagccuagaugaucgcggaaacgcaucagaugcaguuuuugacgcgaucguacgucagggagacgaaauaggauuaagacuauacaaacaacuaaaaauagcagaaauagcagaaagauacagaagcguaggcgcagaugcaaaaguuggugcgguaaugucuuuauuaucaucaauaaaugcuaguucaaauaugguuaaccugaguaugguuggaggauccaaauacgccggaaauuugcagccaaauuauucgaacuuacucucagauccagaaaccaacuucguaauaauagaucaaaguguuacagggauguucgaaagaaggacacggauuggauuauga

SEQ ID NO: 5597 - RNA, 4191 nt, Artificial Sequence
  Cas9 variant
augacuaaaccauauucaauagguuuagauauaggaacaaacagcgugggaugggcaguaauaaccgacgauuauaaaguuccugccaagaaaaugaaaguacucgguaauacuaacagagacuacaucaagaaaaacuugcuaggagcacuauuguuugauggaggagaaaccgcagaaggaagacgacuaaaacgaacugcaagaaggcgauacacaagaaggaaaaacagacuaagguaucuacaagaaauauuugcagaagaaaugaugcaaguagacgaaaguuucuuucaaagguuagacgacucuuuucugguagaagaagauaaacaagguagcaaauaccccauauuuggaacacuuaaagaagaaaaagaauaucacaagaaauuuaaaacaauuuaccaccuaagagaagaacucgcaaacucaaaagaaaaagcugaucuaagauuaguauaucuagcauuggcacauaugauaaaauucagagggcauuuccuuuacgaaggagaccucaaagccgaaaacacagauguucaagcccuauucaaagauuucgucgaagaauacgacaaaacaauagaagaaagccaccuaagugaaauaacaguggacgcauuaucgauucucacagaaaaaguaucaaaaagcucacguuuagaaaacuuaauagcucacuacccaacagaaaagaaaaauacacuuuuugguaaccucauagcccuaucacuaggauuacaagccaauuucaaaacaaauuuucaauuaagcgaagacgcaaaauuacaauucucgaaagacaccuacgaagaggaccuugagggauuacucggagaagugggggacgaauaugcagaucucuuugucagcgccaaaaaucucuacgaugcaauacuucucuccggcauacuaacgguggaugacaacaguacaaaagccccacugagcgccucaaugguaaaacgauauaaagaacauaaagaagaacucgccgcauucaaaagauuuauaaaagaaaaauuacccaagaaauaugaagaaauauuuaaagaugacaccaaaaauggcuacgcgggcuauguaggagcagauaagaaacuuagaaaacgaucgggaaaacuagcgacagaggaagaguucuacaaauaugugaaagguauauuaaacaaaguugaaggugcugacuacuuuuuagauaaaauagacagagaagacuucuuacguaaacaaaggacguuugacaauggaucaauaccccaccaaauucacuuacaggaaaugcacgcaauacugagacgacaaggggaacauuaccccuuuuugaaagaaaaccaggauaaaauagaaaagauacugacauuuaggauaccauacuaugugggaccacuagcacggaaaggaucacgcuucgccugggccgaauacaaagcugacgagaaaauaacgccauggaauuucgacgacauacuggacaaagagaaaagcgcugaaaaauucaucacgaggaugacacuaaacgaccuauauuuaccagaagaaaaaguauuacccaaacacagcccacuauaugaaacauucaccgucuauaaugaacucaccaaaguaaaauacguaaaugaacaaggagaagccaaauucuucgacacaaacaugaaacaagaaaucuucgaucauguauuuaaagaaaauagaaaaguuacaaaagauaaacuacuuaacuauuugaauaaagaauuugaagaauuucguauaguaaaucugacgggacuagacaaagaaaauaaagcauuuaaugcgaguuuagguacuuaccaugaucugcguaaaauauuagacaaaucauucuuagaugacaaaguaaaugagaaaauaauagaagacaucauccaaaccuuaacacuauucgaagauagagaaaugauucgacaacguuuacaaaaauauagcgauauauuuacaacacaacaacuaaaagaauuagagagaagacacuauacaggauggggacgacuaucuuauaaacuaauaaauggaauacgaaacaaagaaaauaagaaaacuauacuugacuauuuaauagacgacggauacgcaaacagaaauuucaugcaacugauaaacgacgaugcgcuuagcuuuaaagaagagauagcuagagcucagauaauuggagauguagaugacauagcaaacguaguccacgaucucccagguagcccagccaucaagaaaggaauauuacaaaguguaaaaauaguagaugaauuaguaaaaguuaugggccauaauccaacaaauauaauaaucgaaauggcuagagagaaucagacuacagacaaaggaagaagaaacucacaacaaagguugaaacucuugcaagauucacuaaagaaccuugacaacccaguaaauaucaaaaauguagaaaaucagcaacugcagaacgauagauuauuccucuacuacauacaaaaugggaaagacauguacaccggugaaacacuagacauuaauaaccuaucgcaguaugacaucgaccauauuauaccacaagcauuuauuaaagacaauucucuagacaacagaguauuaacgagaucagauaaaaaccggggcaaaagugaugauguccccuccauugaaguaguucaugaaaugaagucuuuuuggagcaagcuacuuucuguaaaacuuaucacacaacguaaauuugacaacuuaaccaaagcagaaagaggcggccuaacagaaaacgauaaagcaggcuuuauaaagagacaacucguugaaacacggcaaaucacgaagcacguagcacaaguucuagacgcaagguuuaacgccaagcacgaugaaaauaagaaaguaauaagagacguaaaaauaauaaccuuaaaaagcaaucuaguaagccaauuuagaaaagacuucaaauucuauaaaguacgagaaauaaaugacuaccaccaugcacacgacgcauaccugaacgcaguaauaggaacagcguuacuaaagaaauaucccaaauuagccucagaauuuguuuacggagaauuuaagaaauacgaugucagaaaauucauagcaaaauccgauaaagaaauaggaaaagcaacggccaaauacuucuuuuauucaaacuuaaugaauuucuuuaagaaagaggugaaguuugcagauggcacagugguagaacgacccgauauugaaacaagcgaggauggcgagauagcguggaauaagcaaacagauuuuaaaaucguaagaaaagucuuaaguuacccucaagucaacauaguuaagaaaacagaagugcaaacucauggauuagauagaggcaaaccuagaggauuauucaacgcuaauccuucuccuaaaccaaaaccagauucaagcgaaaauuuaguagguauaaagcgcaacuuagauccgaagaaauaugguggauaugcagggauaucaaauucauacgcgguauuaguaaaagcuauuaucgaaaaaggugucaagaagaaagaaacaaugguacucgaguuccagggaauuagcauacuugacagaauuacauucgaaaaagauaaaagagccuucuuauuaggaaaaggauauaaggacaucaagaaaauuauagaauuacccaaauacagucuuuuugaacuaaaagauggaucucgcagaauguuagcgucaauacuauccacuaauaauaaacgaggggaaauccacaaaggaaaugaauuguuuguuccucaaaaauucacaacguuacuauaccaugcaaaaagaauaaacaacccuaucaacaaagaucauaucgaauacguaaagaaacaucgugaugacuucaaagaacuacuuaacuauguauuagaguucaaugaaaaguauguaggagcaaccaaaaacggagagagacuaaaagaagcaguagcagacuuugauagcaaaaguaaugaagaaauaugcacaaguuuucucggagccguaaauuccaaaaacgcaggucucuucgaacugaccucacuuggaucagcaucugauuucgaauuuuuaggcgucaaaauaccuagauacagggauuacacaccaucaucauuauuaaaagacagcauauuaauucaucaauccauaacaggccuauaugaaacaagaaucgaccuuagcaaauuaggugaagacuga

SEQ ID NO: 5598 - RNA, 4191 nt, Artificial Sequence
  Cas9 variant
augaaacgagugaaugaagauuacauucugggacucgauauaggaaccaacagcugcggaugggcuguaaccgacaagaaaaacaauuuacucaaauuaagaggaaaaacagcaaucgguagucauuuauucgaagaaggucacaccgcagcugauagacgaggauucagaacaacaagaagaagacuaaaaagacgaaaauggcgccuccgauugcuagaagaaaucuucgcagaaccuauggcaaaaguagauccaggauucuuuguucgucuccaucaauccuggguaaguccacuagauaaagaucggaagaaauacaacgcgauaguauucccaaccgcaaaagaagaucaagcauucuacaaacacuacgcuacaauuuaucaccuccgagacgaacuaaugacacaagacagacaauucgacuuaagggaaauauuccucgcgauucaccacauaguaaaauacagaggaaacuuuuuacaagacacgccugucaaagacuuugaagcaucuaaaauugaagucggcccaauucuuucucauauaaacaaugcauuugcagagaaaauaguggaagaccaagacccaauagaacuaaauguugccaaugccgcagacauugaagaugugauacgagguaaagacgccgagaaaaccguuuacaaauuagacaaagucaagaaaauagcaaaacuccucacugacagcaccgcgaaagaagagaaaaacguagccaaacaaauagcaaacgcaaucaugggauauaaaacccaauuugaaacaaucuuagacaaagaaauagauaaaagcgauaaagcacaaugggaauuuaaacuaagcgaugcagacgcugaugauaaacuagacgcgcuacuaccagaccuugacgaaaccgaccaaacagucguagccgaaauagaaaaacuuuucucugcuauaacacuuucaacaauugucgacgaaaauaaaucauuaucacaaucaaugguugaaaaauacaagaaacacaagaaagauuacaagaaacuaaagaaauacaucaauacacuacaagaccaaacuaaagcaaagaaauuacuauuagcguacgaucuauauguaaacaacagacaugggagacuauuagaagccaagaaaaccuucgaagauaaaaagaaaaagaaagcauuaacaaaagacgaguucuacaaaauaguaaaagauaauuuagacgacucagaccuagcacacgaaauacaacaagaaauagcagcagacaauuucaugcccaaacaaagaacaaauucaaacggaguuauaccauuccaacuucaccaaauagaacuagacaaaauuauagcuaaccaagguaaauacuauccauucuuagcagcagaaaacccgguagaagaucauagaaaacaagcgccuuauaaacuagacgaauuagugagauuuagaguaccauauuaugucgguccaaugauaacagcugaugaacaagagaaaaccuccggcaaauccuuugcauggauggugcgaaaagaagacgggcaaaucacacccuggaauuucgaacaaaaaguugacagacaagaaucagccaacaaauucauuaaacgcaugacaauaaaagacaccuacuuguuauccgaagacguacugccugccaauucacuauuauaccaaagauucgaaguccuaaacgaacuaaacaacauacguauuaaugguaguagaauaucaguagaccuuaaacaacaaauauucaaugacuuguucgaagagaagaaaacgguaacagaaaaaucacuaacaucauacuuaaaacaaaacuugcaccuccccacaguagaaauaaaaggucuagccgacccaacuaaauucaauucaucucuagcuucauauuaccauuuaaaaucacuacaugucuuugacaaagaacuugcggacccacaauaccagaaagauuucgagaaaauaauugaauacaguucaauuuucgaagauaagaaaaucuuccaagacaaacuacaugccgaguucaaauggcuaacacccgaacaauuuaaggcuauuaguacuuggcgauuacaaggauggggacguuuaucccguaaacuacuuguggaacuacaugacacuaauggacaaaacauaauggagcaauuaugggauucacagaaaaacuuuaugcaaaucguaaccgaaccagacuuuaaagaugccauagccaaagaaaaucagaacgucacaagagcuaacggcgucgaggaaauacuagcagacgcauauacauccccagcaaauaagaaagccauccgccaagucguaaaaguaguugcagacgucgucaaagcugcuggcggaaagaaaccugcacaauuugcaauugaguucacaagagaucccgauaaaaauccacaguuaucacauauuagaggaaccaaacuacuuaaggcuuaucaagaaaccgcaggagaacuuguagaccaaaaauuaacugauucguuaaaagaggcaaugaccucgaggaaacuauuaaaagacaaauauuuccuguauuuuaugcaagcaggacgugaugcauacacaggucagaaaauaaacaucgaugaaguuaguacaaauuaccaaauagaucacauauuaccucaaucauuuauaaaagacgauaguuuugauaauagaguacuaacagccacaccacuaaacgcggagaaaagcgacgauguaccguacaaacgcuucgcaaacaauuauguguccgauaugaaaaugaccguaggcgaaauguggaaacauuggcaaaaagcgggaaucauaaauaaacacaaacuuggaaacuuacuccucgauccagacagacuaaauaaauuccagaaaagcgguuuuaucaacagacaguuaguagaaacaucacaaauuaucaaauuaguuucaguuauucuccaaaacaaauauccggacgcugaaauuauaacuguaaaagccggagauaacuccgcguuaagacaacgccuuaaucuauacaaaucaagagauguuaacgacuaccaucaugcuauugacgccuaccuaucaauaauuugcggcaacuuccuauaucaaguauacccuaaauauagaccuuauuuuguuuauggaaaauacaagaaauucucacaagaucccgaccuacaaaaagaaguuaucaaacacuuuaaaggauuuacauuuauguggccccuauuacaaaaagacaauucagagaggaaagcaccagaaaagauaaaagagaauaacuccgaucgcauagucuucuacaaacacccagacauuuucgauaagcuccgaaaagcauacaacuacaaauauaugcuaguaucaagggaaaccaccacagaaaacucagggcuuuuugacgucacuauuuacccuagaggagaaagagacuuagcaaaaacaaggaaauuaauaccaaaaaguaacggccucgaucccaaaauauacggcggauauucagguaacacugacgcuuauaugguaauuguuaaaauagauaaaggaaaagaaucaauauacaaggucaucgggguaccaaugagagcacuggccucacuuaacagggcuaagaaacaagguaauuauaaagaagaacuucaucaagugcuugaaccacaaauaauguuugauaaaaauggcaaaccaaaacgaucaguaaaaggcuuccguauaaucaaagaccacguaccauucaaacaagucguauuagacggugacaaaaaguuuaugcuuaauuccucgacauaugaaauaaaugccaagcaguugaccuuaacaccagaaaccaugagaauaguaacagauaacuugaagaaaggagaggaucaagaccaauuauuaguuaaagcauacgacgaaauacuacaaaaggucgaccaauacuuaccuuuauucgacguaaacaaauuuagaaacagucuccaucucggcagagcuaaauucuuggaucuagcaguaaacgauaagaaaaucacacuaaccaacauacucaacgguuuacaugauaacuuaguaacaccugaucuuaaaaacaucggaaucaaaacaccccuagguaaacuacaaguaccaucugggauagugcucagcucagaagcaauauuaaucuuucaaucaccaacaggucucuucgaaaagcggguaagaauagcugaucuauga

SEQ ID NO: 5599 - RNA, 4194 nt, Artificial Sequence
  Cas9 variant
augaaagacuacaauauaggauuagacauaggaacaucaaguaucggauuugccgccauagaugaugauaauaaucucauuagaguaaaagguaaaaacguaaucggaucgagacuuuucgcagaagguaaaacagcagcagaacguagagguuuccgaacagccagacgacgcuacaaccgaagaaaauggagacuaaagcuauuagacgaaauauucuaugaggaaauaauacauauagacccagaguucuuuaauagauuaaaacaaucaucaauaucuccaaaagaugaaucaaagaaauauuuuggauccuuauuauuuccggacaaaacagauuccgcguacuaucaugauggaaaccaaacaauauaccaucuuagaaaccgucuugugcaucaaaaagaaaaagccgauauaagagaaauuuauuuggcgcuaagacacauaguaaaauaccgcggaaacuuccuagacaguacgccagucagcucuuucgaagcugauaaccugaaacuagacgaacucgucccaguaauaaaugauauguacgagaacauugacauugacuucagcauuaaugucgacaauauaucggaaauagaaaaaguacucuuagauaaucaccuaaaaucagcagacaaacaagaucgacuuaaagaauuacuuuacgacaaccccgaauaucccgaugacaaagucaaacaaaaggaaauaaguaaauuccgcaaagaucuagacaaagaaauaauuaaaguaauuguuggauauaaauucaaugcauacaaaauaguaaauuacauacccgacgacggaucuaaauucucauucagcuucuccgaugaaucauccgacgacaaacuagaugacuuauccgaaguacuagaugacucacaaauggaaauacucaauacacuaaaaguuauuuauucccgcguacguuuaaaccaaauaauaccaaaugggaugggauuaucagaaucaaugguagcaaaauacaacaggcaucacgagcaacucgaagaccucaaagaguuacuagacguacucccaaaugaugaaaaacgaucaauagaauaugcauauacagcauauauaggaaacguugacaaacaaaaauauaauaauaauuuagucgcaucucuaaaagaccugccaaucaaaggagauaucaacaaaaagauccaagcgguauuugaauacgcaaaaggccacauaucaucacaagaccuguaugauguuaucaagacaauuauuauagauaaauaucuagaagaugaaucauuugaauaucaugaucuuguagaacgaauuuccaacgacauagauaauaaggauuaccuacuuaaacaaagauccucccaaaacggaaauaucccacaucaaguucaccaaauggaaauggacaagauaaucgccaaucaaagucaauauuacccuuuccuaggaguuuuaaaucccaaugaauccagacgucauaucgcuaaguauaaaauauccgaauuaguuagcuucagagugccauauuaugugggaccauuaauaacacccgaggaacaagagaaaacaucagguaaacauuucgccuggaugaaaaggaaagaagcagguaaaaucaccccauggaauuuugaagaaaaaguugacaaagaagcaacagccgcuaaauuuaucaaaagacugacggucaaagacacuuaccuacucaacgaagacguucuuccagacaauaguuuacuauaucaacaauuuaaagucuuaaacgaacugaacauaguuaaaguuaacaauaaaagacucacacuaucagaaaaacaagguguauacaacgaucuuuuuaaaaacacaaaaucgauaacuguuaaacgccucaaaaauuaccuaauuucuaauuacaaacaccuugaaaacauugaaauaacaggcuuaucagacggcgauaaauuuaacaauaguuuaggaacuuauaacgacuucaagaaaauuuucggagcacguauugacgacgugaauuauagcgcagacuucgaaaacauaauagaauggucaacugucuuugaagaccgaucaauacucaaagaaaaacuggaaaaagacaucgauuggauuaccccagaagaaauaaaagcaguaguggcaaaacgauauagcggcuggggaagacuaucugcuaaacuacuaacggaauuauuggacgacgauggacaacguauaauugauauucuauggaacgauucaauuacauuuauggaagcagucucaaaaccagaaauaaaagcucaaauccaaaacaucaauagagauuuuauuaaagcaacagacauugaaacuguauuggacgaagccuacacauccccacaaaacaaaaaggcgaucagagaaguauacaagcuaguuaaagauauucagaaagcgaugggagguaaagcacccucgucaauaaguauugaauuuacaagaucaccugaagauaauggaagcguuaccaaaacacgauacaacaacaugcaaaacaaauacaaagaacuagguaaagaauuaucagaugaccuaucagcacaacucaaagaauacaaagguagaauggaccaagauaaauucuaucucuacuuuaugcaaaugggaaaagauuuguaugacggaucaacaauaaaccuagaugacuuaaauucuuaucaaauagaucauaucguaccacagagcuucuauaaagacgacagcaucgacaaccgaguucuaacacacuacaccaacaaucaaaagaaaggaaaccauacaccccuaaauggacuuaacauugacgcacaaacgcaaaaucuauggaaacaucuuaacaaauuaggucuuaucagcaaaaagaaacuacaaaaucuguguuuuaaagacauaaaccaacuaucaaaauauacaaaacacggauucguacgacgacaacugguagaaacaucccaaguaauaaaacuuguugcaaauauacuuuccgacgaguucgcaaacgacggcaccaaaauaauagaaguaaaagcgaaaaugaacucauugaugcgcgacacauucaaucuauauaaaguuaggcaauuaaaugauuaucaucacgcaguagaugcauaccuuacgaccuuuguaggaaaauaccuauacaaaagauacccaaaauuaaggucaauguuugucuauggggauuuuaagaaauuuagcgcagaagaugaccuaaaagauauaaaaacguucaacuuuuuacacgauauaacuaauccgaaagaaagcaauaaagagaaaauauaugacgaaaaaucaggagaauuaauacuagauagaaaacaugcaaucgaaacuauuaagaaaauuuaucaauacaaauuuaugcucauuguucgagaaguuucaacuaaaucugggcaauuauucaaacaaacaauauauagcgcuaagaaaacgaauggacugaaaucagcaauaccggucaaaaguaaccuagaaccaagcaucuacggguaucggucaggaaauguagaccaucauauggucaucguuaaaauaaagaaaggcacaaaauauaguuucaaagucauagggauaucugcccgagcaauccaagaauuagaaauagcaaagaaaauagguaacuauagagauaaacuauaugaaguagucucagacagacuaucccaaucaaugaaaucagucgagagcuucagaauaauccuagauaacaucauguacggacaauugaucguagacggaaaugacaaauucacacucggcucagcagacuacaggaaaaauucacggcagcuaguacuaugcacgaacucacugaaaauacuuaaagacgaggacuauaugaacagacuaucagacauacaacgauccaaauuaaugguccaaguauacgacgaaauaauuaaaaucaugaaaaauaaauauucauuauucauaagcaacacggaaaaacucuuagagaaaagagacaucuuuuguggacucucauuugaugaacagaaaauaguaauauggaaaauaauaaucgauuuacauaauggaccauucacgaaaauccaagaacuuggcauuaauaacaaaaugggaacguuccaaacaaaacaugguauaauacuuacagaaaaugccauuguuauauaccaaagcccuucaggauuauucgagaggaaaguuagacuaaaagaucuuuga

SEQ ID NO: 5600 - RNA, 4194 nt, Artificial Sequence
  Cas9 variant
augaaaaaaguacuaggauuagaccuaggaacgaauucuaucgguugggcucuaguaaaugaggcaacaaaggaagagaaaaaagaagggaaaaguucugaaauaauaaaacuaggaguaagaguaaaucccuuaacaguugacgaaaaaacgaacuucgaaaaaggaagaccacuaagcacgaaugcggacagaacacugaaaagaagugccaggagaaacuuacaacguuauaaacuucgacgcagaaaccucauagaaauauugauuaaaaacggauucauaacuaaagauacaccacuuacagaaacgggcaaagauacaacgcaccaaacacugaaacuaagagccaaaagugcaaaagaaaaaguagacuuaaaagacuucgcaaaaauuuuauuaacaaucaacaaaaaaagaggauauaaaucaucccgaaaaguaaauucugacgaagacgguuuagcaauagacggaauggcaguggcaaaacaucuauacgagcaaaaccucacuccaggccaauacgugcucaaucuacuacaaaaaaacaaaaaauacguaccugauuuuuaccguuccgaccuacaagaagaauucaaaaauaucuggaacaaccagaaaacauacuacuucgacauacuaacagauacccuauuugaagaauugaaagacaaaaacaagucacaaacuugggcuauauguaaaaagccauucgacauugcaggaauaaaacaaauuggcaaagcaagugacaaacgacuugaacgguauaaauggaggacagaaggccuaacccagaaauuaaaucuagaauaucuagcaaucgcucuucaagaaauaaauaacgacauaaacaaaagcucgggauauuuaggugcaauaucagaccgaucaaaagaacuauuuuuuaauaaggagacgguuggcgaaaauuuauacaggcaacugguaaaaaccccacauacaagcuuacgaaaccaaguauucuaucgucaagauuaccuagacgaauuugaaaccauaugggaaacacaggcaaaguucuacccacaacuaacgcauacauuaaaagaagaaauaagagacguaauaauauuuuaccagcgaaaauuaaaaagccaaaaaucccuaaucucauucugucaauuugaaucaugggaacagaccuacauagaaaaggaaacugguaaaagcaaaacacgaaccguaggccggaaaguaaucccgaaaucuucaccauuauuucaagaauuuaaaauuuggcaaaaccuaaacuccuuagaauuucgaaacucagacgaaggcgagauaauagaguucauuaaacuagaugaggacauaaggcaaacgguauucgaagaacuuaauuuacgaggaaauuuaaaaccaaacgauguauugaagauacuaggcaacuacauaaguuuaggaaaaguaagccaauggaaaugcaauuuugaagaaauagaagggaaucgcaccaacgccgcccuauacaaugucuaucaaauaauagcagaaaacgaaggauacgguuucgauugggccaaaaaaaccgcauccgagauaaauaaagagcucaagaacaucuuuccacaacugggcauagaugcaucaauuuuagacuucgacuucacacaagcuaacuuugacaaacaaacauccuaucaacucuggcaccuuuuauauucagcugaagaagacuuuaaaaucuccgaagaagacaaaguacuuuaugguaauucaucaguaagcuuaaaaaaaaaacuucaccaaaaauauggcuucaaacccgaauauacaaaacuacuuacuaauauuuccuuacagccagacuacgguaaucucucagccaaggcaauauguaauauacuaccuuaucugaaagaaaacaacguuuacuccgaggccugcgaccuaacuggauacaaccauagcaacuuucuaacagccgaagaacaagccaaaagaccccucaaaccaauuuuagaacuucuaaaaaaaaacagcuugcgaaauccaguuguugaaaaaauacuuaaccaaaugguuaacguugucaaccaaguaauagaaacuuacggaaaaccagacgagauaagaauagaacuaaccagagaauuaaaaaaaagcgcaaaagaaagagcgaacaugaccaaaucaauugccgaugccacaagacgaaaugacgauuacagaaagacaauaaucaaagaauuugguaucccaaaccccacaaaaucagaugugguacgauaucgccucuggcaagaacuagccucaagaggauauaaagacauauuuacagacacagaaauaaaaccacaagaacucuuuagcaauaaaauagacauagaacauauaauccccaaagcccuacucuuugacgauucauucucaaacaaaaccuuagccuucaaaaaagacaacuuaaagaaggcaaaucgcacagcauacgauuuuauagcaaacgauuacgcacccaaccuagaaaacuauauagagagaguggaaucccugcauaaagauaggaaaauaacacgagcuaaaagaaacaaauuauugaugcuucaaucaaaauuaccagacggauuuauugaaagggaccuaagaaauagccaauauauaacuaaagaggccaaaaaaaugcuuuacgaaguaugcagaacaguuguaucuaccucgggcucuauaaccgauaaacuacgugaagacugggaucucauaaauguuaugaaagaacuaaacuucccaaaauacaaggcauuagggcuaacagaaaagauagaacgauaugacaucggagcagaaaaaaugaaagaagucgaaauuauugaagacuggaauaagcguaaugaccauagacaucacgccaucgaugcacuuacaguagccuucaguacacacagucacauucaauaucuuaaucaccucaacgccagacgagacgaagggcauaaaaaacacgcugcaaucauugccaucgaaucaaccauaacagaaaaagagggaaacaaaaaaaggagauuuauagcuccacuacccaacuuuagauuacaggcuaaagaacacauugaaagcauacuaguaucauucaaaaacaaaaauaaaguaguuacuaacaauauaaauaaaacuaagagaauuaaaaaagacaaauucaacaccaaaguccaauuaacaccaagaggccagcuucacaaagaaacaauauacggaaaaaucaaacaaccacuagaaaaacacaucaaacucaauaaauccuuuacacuugaacaggccaaacuuaucauagacaaacgucaaagggaaaaaguucucaaccaccuagaaaaauaugcacauaauuccgacauugcauucaacagcaaaacacuaaaaaaaaaccccuuacucauaucagacgaaccucucaaagaaguacucugcuucgaagagguauucaccauccguaaagauauaagcuaugacaacuuuaaaaacgaaaaacaauuagauaaaguuauagacgaaaaaguaaaacaagcacucaaagaaagaauaaaucaauauaacggcgacuucagagaagccuuuagcgauauugagcguaacccaauauggcuaaacaaagcaaaaggaaucugcguuaaacgagcaacaaucaaaggaguauccaacgcagaaccccuccauacagccaaaaaucaucuuggugaagaaguccuaacugaaaauaaagaacaaauacccguagauuauguaagcacaggaaacaaucaccacgucgccaucuacgaggacgaagauggaaaccuucaagaaaaaguaguaucauuuuaugaagcaguuauacgagucaacgaaggcuuacccauuauagacaaggaauauaacaagucuuuaggauggacuuuuaaauuuacuaugaaacaaaaugaaauguucguuuucccaucagaagauuucaauccaacugaaauagaccuucuagaccaaaaaaacgccucguuaauaucacccaacuuauuucgaguucaaaaauucacuaucaaagacuauuucuuccgacaucaucuagagaccaccguagaaaauaacaauacucucaaaaacacaacuuggcgaagggagggauuaagugggauauacggcauaaucaagauuagacuaaaccaucuuggagaaauaguacaaguaggagaauauuga

SEQ ID NO: 5601 - RNA, 4194 nt, Artificial Sequence
  Cas9 variant
augaaugaaaacaaagaaugguucuuagggcuagauauaggaacugcaucagucggaugggcagcgacagacacaaacuacaaccuauugaaauuaaaaggcaagaaaucauggggaguacgauuauuugacgaagcucaaacagcaaaagaacgacgagacuguagaucuaaaagacgcagacucgcucgaagaaaauggcggcugggacuacucgaagaacuuuucgcagaagaaauaaacaaaauagauccaaacuucuuuaugcgacucagagaaagcaaauacaaagugucugacaaaacaggaaacgugccauccauacuuuucaaugagaaaaacuauacagacaaagaauacuaccgcaacuacaaaacaaucuaccaucuacgagcagaccucauccacaaaaacaaccccgacauuagagaauuauuuuuagcaauacaccacaucuuaaaauauagaggacauuuucuauucgcaggacaacaauucaaaggcagugaaaucaaagacaacauaagagaauuacuucaauauaauucauuaaauaucaaaauugacauuacagaugaacuaauaaacaacauugcagaaauacuacugaaaaagaaaaacucuacggauaaaauaaucgaauuuaagaaacuauucgcagacgaaaaacaauugauagaagccuugcguuuagcucuggguaacaaaacacaacuagcaaaacuauucgacauagaagcauacaaagaacuugauauaucaauaaaaacaauuucauucaaagagaaaauauaugaagacguccgauccaacuaugaagaaauucucggagaauacaucauaguauuagauacagcaaaacuaauuuaugacgccaucauccucucuaaaauaaaaauuaaaaacaugacaauaagugaaagcaaaguagucucauacgaaaaacacggcaaagacuuaaaacaguuaaaacaucucauaaaagaagacugcaaacucaguaagaaagagaaacgacaacuauucgaaaacauauuuguaaaagaagacgaaaaaggcgcaaacuaugugaauuauauaggcaaaaacaacgcugguuccucaaaaaguucaugcucauaugaagacuucaagaaauuccuaaccaaagaacuaaaauguugcgaagaaagcaaauuaaaacaagauauacuagcagaacucgaauuagaaacuuuucuuccacgucaacgaacaaaagauaacaguguuauacuauaucaaauacacaaagaagaacucgagaaaauacuaaacaacgcaguucaauaucauccguucuuaaauaacacggaugaauacgguauaucuauaaaagagaaaaucauacaacuacuagaauuucguaucccguauuacguaggacccuuaaauaccucgcauaaaguaggagacggcggauuuucuuggagcguacgcaacaaagguuaugaacacauagccgucacuccauggaauuucaacaaaguuauaaauaaagaagaaagcgccaaaaauuucauagaaaaccuaacgaaccaauguacauaucuacuauaugaagacguacuaccaaaacacucacugcuguacagcgaauuugcucuuuuaaaugaacugaauaguauaaacuauggaggaaaacgauuaacaguagaacaucgaaaccuaaucauagaaagauucuuuaaacagucagcaccaaaagcaacagggaaagaauugaagaaauuccuaaugucugaaggagucauugauggaaaagacgaauuaucaggauuugacgucucaaucaaaaacgaucuaaaaucguaucgagauuuuaagaaaauccucggagacaaauucgacuccgaaaaaguagagaaaaugauaagauggaucacacuauucggcgaaagcaaacaacuacuuguagacaaaaucacuaaagaauacggagacauauauucucucgaagaaaucaagaaaauuagcggacucacauauaaggauuggggacgacuuagcgaaaaguuauugacagaaauuguaaguucacaacucuacgacgaaucgacaggagaaugcuucaacaucauaaacgcaaugagaaacaacacccuacucuucauggaacuguuaggcacaaacuaugacuauuucgagaaaauaaauauuuauaacagaagacuaagaaaagaaauaacugaaaucacuccacacauuuuagaugauuuauacguaucaccagccgucaaaaggaguauauggcaaguaguccguauugucgaagaacuaaagaaaauuaucggaucagaacccaaaagaauuuuugucgaaacuacccgcucaaacaaagagaaaaagggugaugauggaagaaaagacucacguaagaaagcauuacucgaauuauauaagaaaaucaaaacaucagauauuguagaauuagaaaaagcgcuaggacauacuguagauuucgacaagaagaaacaagaccuaacagacauagauaacaacaaacuaaaagcuagaaaacuauaccucuacuauacacaauuaggaagauguuuauacacaggcaaagcuauagaccuaaauaaucugcucucaaguaauucagaauacgauguagaccauauauacccccaaagcaaaacuaaagaugggucauggaauaacuugguacugguaaacaaaacagaaaacagcaagaaaucaaauggacuuauaucagaauccauccaaaggaaaaauaaacauuuuuggagauuccuaaaagccaaaaaccuaaucucugaagaaaaauauaaacguuuaacacgaacggaagauuuuacggacgacgaacuauccggauuuauagcaagacaacucauagaaacaucacaaucgguaaaggcaguaagccaaauacuucaaaaucuuaauccaacaacagagaucugcuucucaaaagcagaaaacguacacgacuuucgacaagaguucggaaaaauaaaagugggaaaaagaagaaacuuaacggaagaacaacaaaaagaggccaaagaaggacaauugauaaagguaagagaccuuaaugacuuacaucacgcaaaagaugccuaccuaaacauugucgucggaaacgucuaccacaucaaauuuacaaggaauccgaaaaacuuuauaaggaaaaauaguaagaauagagaauacacauuaaacacuuuauucuacucagauaaaauagaaaggaacggagaagucgccugggaaaaagguaaaacugagaaaaucguaucuuccguaaugugcaacaacuugauuaacguaacaagaagaacaagcgaacaaaaaggcgcacuauaugaugcaaccauauacaaagcaaacgcagccaaagaaggaaguuauuaucccguaaaaaccaaaaauaaaaacuuaaaagauguaacucgauauggcggcuuuacaucaaucaaaauagcauauuacucaauuuucaaauaugacauacgaaauaaagacaaaguuaaagaaaacauaaagauaaucccaaucccaaucuacauuucacagaacauuaaaacggacuuagauuugaucaacuuugcagaaaaacaaauuaaacuaaagaaaggggaaaacauagaaaaccuucaacuaauauacaagaaauuaaauauaggagcucuuguuaaaauugauuauuacccguauuacguaggaggaaaaacuaaugacaacuucuacauagacggagcaguccaaguacuucuaucauccgacaucgagcgcuaucuaaaagaaguggugaaauuuguaaacuuucaacgagaaaauaaagaagccaaaguaucaaaagaacacauaaguuccgaagaaaauaucgaacuauacaacacccucuuauguaaaaugacugcaaaaaucuuuacacauaccaaaaauaauaaauacaacgacuuagcucaggauaaagccaaaaacacguucaaaaauuuaucauuagaagaacagugcaaaguccuccuugaaauacuaaaccugcuaacaaauaagaaaacaaccuucgaccugagccuaauaaacgaaaaagccucgcgcguaaaauguggauuuaaucuacuaaaccaaaaacaauuuaguauuauagaacaauccgucacgggucuauacgaaaaagagauaaaaauaauugaggauuga

SEQ ID NO: 5602 - RNA, 4197 nt, Artificial Sequence
  Cas9 variant
auggaaacacaagcaucuaaucaauuaauuucaucacaucuuaaaggauauccaauaaaagacuauuucguggggcuugauauaggaacaagcucuguggguugggcuguaacaaacaaagcguaugaacuucugaaguuccgcucacauaaaauguggggcucacgucuauucgacgaaggagaaucagccguugcuagaagaggcuuucgauccaugaggaggagacuagagagaagaaaacuaagauuaaaacuacuagaagaguuauucgcggacgcaauggcacaaguugauccaacauucuucaugcgucuacgagagagcaaguaucauuaugaagacaaaacaacaggacauucaucuaaacauauucuguucauagauaaaaacuauaaugaucaagacuauuuuaaagaguauccgaccgucuaccauuuaagaucagaacuaaugaaaucgggcacagaugauaucagaaaauuauuccuggcuguccaccauauacucaaguaucgcgguaacuuccuuuaugaaggcgcaacauucgauucaaaugccucaacuuuagacgauguaauuaaacaagcacuugaaaauaucacguucaauuguuucgacugcaauuccgcaauaucaucaauaggacaaauuuuaauggaagccgguaaaacaaaaagugauaaggcaaaagcaauugaacaucucguagacacauauaucgcaaccgauacaguugacacaucuucaaaaacacaaaaagaccagguaaaagaagacaaaaaacgacuuaaagccuuugccaaucuuguauuaggauugaaugcaucccuaauugaccucuuuggguccguagaagaacuugaagaagaccuaaaaaaacuacagauaacaggagauaccuaugacgauaaacgagaugaacuagcaaaagcauggagugaugaaaucuauauaauagaugauugcaaguccguauaugaugcaauaauauuacuaagcauaaaagagccgggccuuacgauaagcgaaucgaaaguaaaagcuuuuaacaaacacaaggacgaucuagccauauuaaagucgcuacucaaauccgaucgaaguaucuacaacacaauguuuaaaguagaugaaaaaggucuacacaacuauguacauuauaucaaacaaggaagaacagaagaaacuucauguaacagagaggauuuuuacaaauacaccaaaaagaucguagaaggacugagugauucuaaggacaaagaauacauucugagccaaauugaauuacaaauacucuuacccuuacaaagaauaaaagacaacgguguuauaccguaucaguugcaccuagaggagcucaaagcuauccuagccaaaugcggaccaaaauucccauuccucaaugaaguagcagacggguucagugucgcagaaaaacuuauaaagaugcucgaauuccgaauaccguacuaugucggaccucuaaauacacaucacaaugucgacaaugguggauuugcuugggcagucagaaaagccucuggaagagucacccccuggaauuuugaugacaaaaucgauagggagaaaagugcugccgcauuuaucaaaaaccuaaccaacaaauguacauaucuguuaggugaagauguucuaccuaaauccuccuuguuauacucugaauucaugcucuuaaaugaauuaaauaacguacguauugacggaaaaccauuagaaaaaguagucaaagaacaucucauugaagcuguauucaaacaagaucacaaaaaaaugacaaaaaaucgcauagaacaauuccuaaaagacaacggauauauauccgaaacccauaaacacgaaauuacaggucucgacggugagauaaaaaaugacuuagcaucauaucgagacaugguacguauucuaggagacggauucgacagaucaauggcugaagaaauaauaaccgacauaacaauauuuggcgaaucuaaaaagaugcuuagagaaacccuuagaaaaaaauucgccaguugccucgacgaugaagccauaaagaaacuaacgaaacucagguauagagacuggggacgccuaucgcaaaaauuauugaauggaauagaaggaugugacaaagcuggggacggaacucccgaaacaauaauaauacucaugcgaaacuucagcuacaaucuaauggaguuauugggcgauaaauuuuccuucauggaaagaauacaagaaaucaacgcgaaacuaacugaaggacagauaguuaauccccacgauauaauagacgaucuagcacuaucaccugcaguaaaaagagcaguauggcaagcccuacgaauaguagaugaaguagcacacauaaaaaaagcacuaccagcacgcauauucguagaaguaacgcgauccaacaagaacgaaaaaaaaaaaaaagacucuagacagaaacgcuuaagugaccuauaugccgcaauuaagaaagaugacguauuacuaaacggacuaaauaacgaaauuuuuggagaauuaaaaagcucacucgcaaaauacgaugaugcagcuuugagaucaaaaaaauuauacuuauauuauacacaaaugggacgaugcgcauacacgggcgaaaucauagaacuaucauuauuaaacacggacaacuaugacauagaucacauauacccucgaucacucacaaaggaugacucauuugacaacuugguacuaugcaaaagaacagcaaacgcacaaaaaucagaugcauacccuauaagugaagaaauucagaaaacucaaaaaccauucuggacauuucucaaacagcaaggccuaauuuccgaaagaaaauacgaaagacuaacacgcauaacaccauugaccgcagaugaucuaucaggauuuauagccagacaauuaguugagacaaaccagucaguaaaagcagccacuacccuucucagaaggcuuuauccagguguugauguaguauuuguuaaagcugagaacguuacagauuuccgccaugacaauaacuuuauaaaaguacguucccuaaaucaucaccaccaugccaaagacgcauacuuaaauaucgucguaggcaacguuuaccacgaacgauuuacccgaaacuucagagcauuuuuuaaaaaaaauggagcgaauagaacuuauaaccucgcuaaaauguuuaacuacgaugucaacuguacaaacgcaaaagacggaaaagccugggaugucaaaaccucaauggauaccguuaaaaaaaugauggauucuaaugacguaagaguuacaaaaagauuauuagaacaaaccggagcucuagcagacgcaaccauauacaaagcaacaguggcuggaaaggcaaaagacggagccuacauaggaaugaagaccaaaagcuccgucuucgccgacguaucaaaauacggaggaaugacaaaaauaaaaaaugcauauuccauuaucgugcaauacacuggaaaaaaaggcgaagugauaaaagaaauaguaccuuuaccuauauaucuaacaaauagaaauacgacagaccaggaccucauaaacuacguagcaaguauuauaccacaagccaaagacauaagcaucaucuacggaaagcuauguauaaaccaacuagugaaagucaauggauucuauuauuaccuaggaggaaaaacaaacaguaaauuuugcauagauaacgcaauccaaguaaucguaucaaaugaauggauacccuaccuaaaaguacuagaaaaguucaauaauaugcguaaagacaauaaggacuuaaaagcaaacgucguaagcacacgcgcccuagacaauaaacauaccauagaagugagaauaguugaagaaaaaaacauagaauuuuuugacuauuuaguaaguaaacuuaaaaugccaauauaccagaaaaugaaaggaaauaaagcagcagaauuaagugaaaaaggauauggacuauucaaaaaaaugucacuagaggagcagucuauacaccuaauugagcuacuuaaucuacuaacgaaccaaaaaacaaccuuugagguuaaaccgcuaggaauaacagcaucaaggaguacugucgguucgaaaaucagcaaccaagaugaauuuaaaguaauuaaugaaucgauaacaggacuauacucaaacgaaguaacaauagucuga

SEQ ID NO: 5603 - RNA, 4197 nt, Artificial Sequence
  Cas9 variant
auggaaaaaucauacuccauuggauuggacauuggaaccaacuccguaggauggucaguaauaacugacgauuacaaagugccugcaaagaaaaugcgaguauugggaaacacagacaagaaauauaucaagaaaaacuuauuaggagcauuacucuucgauuccggagaaacugcagaagccaccagauuaaaaagaaccgcaagaagaagauauaccagaaggaaaaaccggcuuagauauuuacaagaaauauucgcuaaagagauggcaaagguagaugaaaguuucuuccaaagacuagacgaaucuuuccuaacagacgacgauaaaaccuucgacucacauccaauauuugguaauaaagccgaggaagacgcauaccaccagaaauuucccacaauuuaucaccuucgaaaacaucuugcagacucucaagaaaaagcagaucuccgacuaauauaucuagcauuagcacacaugaucaaauuucgaggacauuuccucuacgauaauuucaaugaugacaauuucgacuggagaaauauagauauacagaaaagauaugaagaguucauagaaaccuacgacucgacucucggagaaucuuaccucgccgauauauccguggacgccgcuagcauauuggaagaaaagguaagcaagaccgagcguuuagagaauuuacuaaaauacuacccaacugagaagaaaaccaccuucuuugguaaccuaauuaaacuaauccuuggccaacaagccaaauuuaaagcaauauucaaucuagaagacgaaauaucauuacaauucgccacuccaacauacgacgaagaucucgaagaacuacuuggaaagauagauaacggagacagcuauucagaauuauucguugcagcacaaaaucuauauaauacaauacuucuugcaucauucuuaaaaaccgacaacaaaagugcaaaagcuccauugucaacaaguaugauugaacgauaugaaaaucauaagaaagaucuagcaaaacuaaaagauuucgucaagaaaaacuguccggaccaauaucacgauauauuucgagauaaaaguaaaaauggauaugcaggauacauagacaauggaguaucacaaaacgauuucuacacauuuaucgguaaaugccuagaagaaucauugaagaaagauaaaggcgcacaauacuucuuagauaaaaucgauagagacgacuuucuucguaaacaaaggacguucgauaacggagcauucccauaccagauacauuuacaagaaaugcacgcaauacuucgaagacaaggagacuauuauccauuccugaaagaaaaucaagauaaaauagaaaagauucuuaccuuccguauaccauauuauguuggcccccuugcgcgaaaagacagccgauuugcaugggcuaauuauagaagugaugaagcaauaacuccuuggaacuuugaugaaguagucgacaaagaaaaaucagcagaaaaauuuauaacacgcaugacauugaacgauuuauaccuaccagaagaaaaaguacuaccaaaacacagucucaucuaugaaacauuuacaguauacaacgaacuuaccaacaucaaauacguuaaugaccaagguaaugcuauacacuucgacucagaacuuaaagagaaaauauuuaaccaauuauucaaagaaaacaggaaagucaguaagaaaacacucaucgacuucuuaaauaauucugaaggaauauauaccgauaaauuaguagguauagaugaagaagucaaauaccuaaaugccagcuuaggaacauaucacgaucucaagaaaauccuugaauccuuuauggacgacgaaauaaacgagaaaauuauugaagauauaauucaaacauuaacauuauuugaagauaucgaaaugaaaagacaacggcuacaaaaauaugaugacauauucaccccaaaacaacugaaagaacucgcgcgacgcaacuacacaggauggggacgucuaagcuacaaauuaauaaauggcauccgaaauaaagaaaauaauaaaacaauacuagauuaccucaaaaacgguaaucgaaauuucaugcaauuaauaaaugaugauagacuaucauuuaaacaaaucaucauagacgcaagaaaaauagaaaaacuagacaauauugaaagcguaguuuauaacuuacccggaucuccagcgauaaagaaaggaauauuacaaucaauaaaaauagucgaugaauuaguuaaaguaaugggacacaauccggacaacaucguaaucgaaauggcgcgcgaaaaucaaacaacaaaccaaggcaaaaaucgaagccaacaaagguuaaaacgacuucaagacagcaugaguaacuuuaaagauucgucaaucagccuaaaagauguagacaauucagaccuacaaaacgaccgccuauuucucuacuacauacaaaaugguaaagauauguacacaggggaagaacucgauauagaccaccuaagcgacuacgacauugaccauauaauaccacaauccuuuauaaaagacaacaguauagacaaucguguacuuacaagcagcgccaaaaaucguggcaaaucagaugauguacccggaagagacguagugcuaaaaaugaaaccauuuuggaagaaauuauaugacguuaaauuaaucucaaaacgcaaauucgacaacuuaacaaaaagugaacacggcggucuaacagaaucagauaaagcgggcuucauaaaacgucaacuugucgaaacacgucaaauuacaaaauaugucgcucaaauacuggacgguagauuuaauacuaagagagacgacaauaauaaaguuauucgagauguaaaaguaaucaccuuaaaaucgagccuaguuucacaauucagaaaggauuucggauucuauaaaguaagagaaauaaacgacuaucaucacgcgcacgacgcuuaucuuaaugcaguaguugguacagcgauacuaaagaaauauccuaaacuugcaccagaauuuguauacggagaauauaagaaaugugacguacgaaagcuaauugcaaaauccggagauaaauccgaaauugguaaagcgacagcaaaauauuucuuuuauucuaaccucaugaauuucuucaaacgagucauaagguacaguaacggaaugaucgugguuagaccaguaauagaauauaguaaagauacaggagaaaucgcaugggauaaagaaaaagacuucaaaacugucuguaaaguauugucaugcccacaaguaaacauaguuaagaaaguugaaaaacaaagccacggacuagaucgaggaaaaccaaaaggauucuauaacgcaaacccaagcccaaaacccaagaaaggauccaaaguuaauuuagucccaauaaaagccaaccuuaaucccaaaaacuauggaggcuacgcagguauuucaaacuccuaugcuguccuaguggacgcaaccauagaaaaaggugcgaagaagaaacuaacacgaauacaagaauuucaaggaaucucaaucauagaccgagaaaaauacgagaaaaacaaagucgaauuuuuaaaaggcuugggauauaaagagauauacucaaucauaacacuaccaaaauauucgcuuuucgaauuggccgacggauccagaagaaugcucgccaguauauuaucaaccaacaacaaaagaggagaaauccauaaagggaacgaauuaguccugccggcgaaauacaucccccuacuauaucaugcuaauagaauacacaauaccuuugaaacaggacaccgagaauaugucgaaaaacauauagcagaguucaaggaaauagccgaaauaauacuagaguucaacaauaaguauguaaacgccaaaaagaacucaucaauaauagaaaaagcacucgagucuuucgacucauuuucacucgaugagauaugcgacagcuucguaggaaaacuaaagaaaaauaacaccaagaaaaacucgggauuauucgaauuaguaucacuuggaucagccagugacuucgaguucuuggaaacaaaagucccucgauauagagacuacacaccaucaucuuuacuaaaugccacccucauacaucaaucaaucacaggauuauaugaaacgagaauugaucuaucaaaacucggagaagaauga

SEQ ID NO: 5604 - RNA, 4197 nt, Artificial Sequence
  Cas9 variant
auggaaacgcaagcauccaaccaauuaauaaguucccaucugaaaggguacccaauaaaagauuacuucgugggacucgauauaggaacuucauccguaggaugggccgucacuaauaaagcauaugaacucuuaaaauuuagaagccauaaaauguggggaaguaggcuauucgacgaaggagaaagcgccgucgcaagacgcggguuuagaagcaugaggagacgccuggaacgacgcaaacuaagauugaaacuacucgaagaacuauucgcagaugcaauggcacaaguggauccgaccuucuuuaugagauuacgagagucgaaauaucauuacgaagacaaaacaacuggacacucaucaaaacacauccuauuuauugacaaaaacuacacagaccaagauuacuauaaagcguacccaaccaucuaucauuuaagggcugaguuaaugaaagacggcaccuacgacauaagaaaauuauuucuggccguacaccauaucuuaaaauacagaggaaauuuucuuuaugaaggugcuucauuugauuccaaugcuucuacauuagaugauguccugaaacaggcacuagaaaauauaacauucaacuguuuugauagcucagcggccauaggcucuauaggacaaauacucauggaaacagguaaaaccaaaucugauaaagcaaagacaauagagcgucuaguugacacauauauaauaacagacgaaguuaacgcuucaggaaaaacacagaaagaccaagucaaagaagauaagaaaagacuaaaggccuucgcuaaccuaguacuuggacucaaugccucacuaaucgaucucuuuggaucaguagaagaacucgaagaagaucuuaagaaacuacaaaucacgggugauacauaugacgauaagagagacgaacuagccaaagcauggucagacgaaauuuauauaauagaugauugcaaaucgguuuaugaugcuauaauacugcuaucaauaaaagaacccggacuaacaauaucugaaucaaaaguuaaggcauucaacaaacacaaggaugaucuugccauccuaaaaucgcuccuaaaaagcgaccguagcauauauaaugcaauguuuaaaguagaugaaaagggcuuacauaauuauguucacuauauuaaacaaggccggacugaagaaacaaguugcaaucgcgaagacuuuuauaaauacacaaagaaaguaguggaaggauuaccugauucuaaagacaaagaauauauccucucagaaauagaacuacaaacacuuuuaccccuucaaagaauaaaggacaaugggguuauaccauaccaacuucaccuagaagaacugaaaguuauacuagcuaaguguggaccaaaauucccauucuuaaacgaaguagccgaugguuucucagucgcugagaaauuaauuaaaauguuagaguucagaauaccguacuaugucggaccacuaaacacuucacacaacguggacaacggagguuucgcgugggcuguccguaaagcaaguggacgagugaccccuuggaacuuugacgacaaaauagaucgugaaaaaucagcugcagcguucauuaaaaauuugaccaauaaaugcacguaucuauuaggagaagaugucuugccuaaauccucauuacuauauucagaauuuauguuauuaaacgaauuaaauaacguucgcauagauggcaaaccacuagaaaccaagguaaaagcccauuuaauuaaagcuguauucaagcaagaccauaagaaaaugaccaaaaauagaauagaacaauuuuuaaaagacaauaacuacauaccagaaaaacauaaaccugaaauaacaggucuagauggagaaaucaaaaacgauuuagcuaguuaucgugauauggugcgcauacucggaaacaacuuugacuuaaguauggcagaagaaaucauaacugauauaacaauuuucggagaaagcaaaaagaugcuuagagaaacuuuaaggaagaaauuugcaaguugccuagaugacgaagcuauaaagaaacuaucgaaacuacgauaucgagacuggggucgacuaucgaagaaacuccuaaauggaaucgacggaugugauaaagcaggagauggaacuucagugacaauuaucgaagcaaugagagauuucaguuauaaucuaauggaauuacuaggagaccguuuccuauuuauggaaagaauacaagagaucaaugacaaacuaacggaaggccaaauaguaaacccacaugacauaaucgacgacuuagcacuaagccccgcaguaaaacgcgcagucuggcaagcacuaagaaucgucgacgaaauuguacauauaaagaaagccuuaccugcaagaauauucguagagguaaccagaagcaauaaagccgagaaaaagaagaaagauucccgacagaaacgauuauccgauuuguacgcagcaauaaagaaagacgaugcauuauugagcggacuaaccaaugaagaauuuggagggcucaaaucagaacuagcaaaauacgacgacgcagcacuuagaagcaagaaacuuuaucuguauuacacacaaaugggaagaugcgcuuacaccggcgaaguaauugaucuaucacaauuaaacacagacaacuaugauauugaccauauuuacccaagaagucucacuaaagaugacagcuucgauaaucuaguacucuguaaacgaaccgccaaugcccaaaaaucagacacauauccaauaucgaaagagauacaaaaagcacaaaaagcauuuuggauuuuccuaaaacaacaaggacuaauuagugaacggaaauaugaacguuuaaccagaauaacgccauuaaccgcugacgacuuaucaggauucauugcuagacaauuaguagaaacaaaccaaaguguaaaagcagcgacaacacuccuaagaagacucuauccagauaucgauguaguauucguaaaagcagaaaacguaacggauuuuagacaugauaacaauuucauaaaaguacguucauuaaaccaccaccaccacgcaaaagaugcuuaucuaaauauagucgugggaaauguauaucacgaaaaauuuaccagaaacuucagggcauuuuucaagaaaaauggugcaaacagaacauauaaccuugcaaaaauguuuaacuaugauguaaaauguacaaacgcaaaagacggaaaagcaugggacguuaaaacgucaauggacacagucaacaaaaugaugacaaguaacgacguaagaguaacuaaaagauuacucgaacaaucaggggcccuagcggacgcaacaguauauaaagcaacaguugcagcaaaagcaaaagacggugcuuacaucgguaugaaaacaaaauccucagucuucgcugaugucacgaaauauggaggaaugacaaaaaucaaaaacgcauauucaauaauagugcaauacauaggcaagaaaggagaaguugucaaagaaauagugccuuuaccaauauaccuaaccaaucguaacauaacggaccaagacuuaauugauuacgucgcaaguauaacaccacaggcaaaagauaucucgauaauuuaucgaaaacucuguauaaaucagcuaguaaaaguaaauggauuuuacuacuaucucggaggaaaaacaaacucuaacauuuauauagauaaugccguagaaguaguugugccagcaaacauugcaguauacaucaaaguacuagaaaaauuugcacuucuacauaaagauaacaacaacauaaaggcuucaacaguaacaacacguauauauaaugaaggcaguacaaauauaguaaguaucacagauaaagauggccuaauuguauaugauuauuuaaugaguaaauuaagaacaccucuauacaugaaaaugaaaggaaauaaaguagacgagcuaucuacgguaggaagaucaaaauuuaugaauaugacauuagaagaacaauccauauaccuacucgaaguauuaaacuuacucacuaacagcaaaacaacauuugacguaaaggcuuuaggaaucacagcaucacgaagcacaaucggcguaaaaauucauacucucgaugaguuuaaaauaauaaaccaaagcauaaccggguuauacagcaacgagauaacaaucguauga

SEQ ID NO: 5605 - RNA, 4197 nt, Artificial Sequence
  Cas9 variant
auggaaacacaaacaaguaaucaacuaauaacaagucaccuaaaagauuaucccaaacaagacuauuuugugggauuagacauaggaacaaacagcguuggcugggcuguaacaaacacaucauaugaguuacugaaauuucacucccacaaaauguggggaaguagauuauuugaagaaggagaaagugcaguaacacgaagaggauucagaucuaugcgaagaagacuagaaagaagaaaauuacgucucaaauuauuagaagaacuuuucgccgacgcgauggcacaaguagacucaaccuucuuuauaaggcuccaugaaucaaaauaucauuacgaagauaaaacuacagggcacagcucaaaacacauucuuuuuauagacgaagacuauacagaccaagacuacuucacugaauacccaacaauauaccacuuacgaaaagaucuuauggagaaugggacugaugauauacgaaaauuauucuuggcaguacaccacauacuuaaauacagaggcaauuuucuauaugaaggugcaacguucaauucaaaugcauucaccuucgaagacguucuaaaacaagcccuagugaacauuacauucaauuguuuugauacaaauagcgcaauaagcaguauuucaaacauucucauggaaucuggaaaaaccaaaagcgacaaagcaaaagcaauagagagauuaguggacacauacacaguuuucgaugaggucaacacaccggacaaaccacaaaaagaacaaguaaaagaagacaaaaagacacuuaaagcauucgcaaauuuagucuuaggauuguccgcaaauuuaauagaccuguucgguucugucgaggauauagacgacgaucuaaagaaacuacaaauaguaggcgacacauacgacgagaaaagagacgaauuagcaaaaguuuggggagacgaaauacacaucauagaugacugcaaaaguguauaugaugccauaauucuuaugagcauaaaagaacccggacuaaccaucagucaaaguaaaguuaaggcuuuugauaaacauaaagaagaccuaguaauccuuaaaucacugcugaaacuagaccgaaauguauacaaugaaauguuuaaaagcgacaagaaaggacuacacaacuacguccauuacauaaaacaaggccgaacagaagaaaccucuugcucaagagaagacuucuacaaauauaccaagaaaauagucgagggacuagccgacagcaaagacaaagaguauauacucaaugagauagaauuacagacgcuauuaccccuccaaagaauaaaagauaauggaguaauaccuuaccaguuacaucuagaggaacugaaaguaauacuagauaaaugcggaccgaaauucccauuccuucauaccguauccgauggcuucucaguuacggaaaaacuaauuaaaaugcuagaguucagaauaccauauuauguaggaccccuaaacacacaccacaacaucgacaacgggggauucucaugggcaguuagaaaacaagcuggaagaguaacaccauggaacuuugaagagaaaauagauagggaaaaauccgcugcugcauucaucaaaaaccucacuaacaaaugcacauaccuauucggugaagauguacuaccuaaaaguagccuccuauauucagaauuuaugcuacugaaugaacuaaacaacguaagaauagacggaaaagcacuagcacaaggaguaaaacaacauuuaauagacagcauauuuaaacaagaccacaagaaaaugacaaagaauaggauagaacucuucuuaaaagacaacaacuauaucacuaagaaacacaaaccggaaaucacaggucucgauggugaaaucaaaaaugaccuaaccagcuauagagacaugguaaggauauuaggaaauaauuucgaugucucaauggcagaagacauuauaacugauaucacaauauucggugaaucaaagaaaaugcuaagacaaacccuaagaaauaaauuuggcucacaauugaacgaugaaacaauaaagaaacuuaguaaacuaagauacagagacugggggagauuaagcaagaaauuacugaaaggaauagacggcugcgacaaagcagggaauggagcacccaaaacuauaauagaacuaaugcgaaaugacaguuauaaccugauggaaauccuaggagacaaauuuagcuuuauggaaugcauagaagaagaaaaugcaaaacuagcacaaggccaagucguaaauccacaugacauaauugaugaacuugcccuaagccccgcaguaaaacgagcaguauggcaggcacuacguauaguagaugaaguagcgcacauuaagaaagcacuaccuucaagaauauuuguugaagucgcacgaacaaauaaauccgagaaaaagaagaaagacuccaggcagaaaaggcuaagugacuuauacagugcaauaaagaaagacgauguuuuacaaucugguuuacaagauaaagaauuuggugcauuaaaaagcgggcuagcuaauuacgacgaugcagcacuacgcagcaagaaacuauauuuauauuacacgcaaauggguaggugcgcauauacaggcaauauuaucgaucucaaucaauuaaauacagacaacuaugacaucgaucauauauacccaagaucacucacgaaagacgauaguuucgacaacuuaguacuaugcgaaagaacagccaacgcuaagaaauccgacauauauccaaucgauaacagaauacaaacaaaacaaaaaccauuuugggcguuucuaaaacaccaaggccuaauuagcgaaagaaaauacgaacgccuaacccguaucgcaccacucacagcagacgaucucucaggcuuuauagcaagacaacuugucgaaacuaaucaaaguguaaaagccacgacuacacuucucagaagauuauacccagacauagacguagucuucgucaaagcagaaaauguaucagauuuccggcauaacaacaauuucauaaaaguaagaucauugaaccaccaccaucaugcaaaagaugcauaccuaaacauaguaguaggcaaugucuaucacgaaaaauuuacacgaaauuuuagacuauucuucaagaaaaacggagcaaaccguacauacaaucuggcaaaaauguuuaauuaugauguaaucugcacaaaugcacaagacgguaaagcaugggacguaaaaaccagcaugaacacaguaaagaaaaugauggcuucuaacgacguaagaguaacaaggaggcuacuagaacaaagcggugcuuuagcagacgccaccaucuacaaagcauccguagcugcaaaagccaaagauggagcauacaucgguaugaaaacaaaauacucuguauuugcagauguuacaaaguacggaggcaugacgaaaauuaaaaaugccuauucaauaauaguacaauacacaggcaaaaagggugaagaaauaaaagaaauagucccauuaccaauuuacuuaaucaauagaaaugccacagauauagaauuaauagacuauguuaaaagcgucauuccaaaagccaaggacauuucaauuaaauaucgaaaacuuugcauaaaucaacucguaaaaguaaaugguuuuuacuacuaucuuggaggcaaaacuaaugauaagaucuacauagauaacgcaauugaauuaguuguaccacaugauauagcaacauauauaaaacuacuugauaaauacgaucuacuaagaaaagaaaacaaaacucuaaaagcaucaaguauaacaacaaguauauacaauaucaauacuuccacgguuguaucauuaucaaauaaaguaggaauagacgucuucgauuacuucaugagcaaacuaaggacuccacuauauaugaaaaugaaggguaacaaaguagacgagcuaucaucaacaggacgauccaaauuuauaaaaaugacuuuagaggaacaaaguauauaccuauuggaaguauugaaccuuuugacaaauaguaaaaccacauucgacguaaaaccacuagguauaacaggaucacgaaguacuauuggcguaaaaauccacaacuuagacgaauuuaaaauaauaaacgaaagcauuacaggucuauauagcaacgaagucacaauaguauga

SEQ ID NO: 5606 - RNA, 4200 nt, Artificial Sequence
  Cas9 variant
augaaaacaaucuuaggacuggaccuagguacaacaaguauaggaugggcuuugguaaaagaagcggaaccuuuuucagacgaaaaauccgaaaucguaagacuaggagucagaguaauaccauuaacaguagaugaaagaacgaguuuugaaaauggcaagucaauaacuacaaacgcacuaagaacacagaaaagggguaugcgcagaaaccugcaacgauauaagcuaagaaggcaagcccuaauagaagaauuaaaaaguacagguuggauaggcaaugauuuuauauuuucagaaaccggcccaggauccacauuucguacauuaagacuaagggcaaaaucagccucagaagaagugacucugggugacuuggcacgaauccuucuacaaauaaacaagaaacguggauacaaaucaucgcgaaaaauggugagcagcgaugacggccaagccauagauggaauggcaguugcgaaagaaauguacgauaagggacuuacaccaggagaauaugucuaccaaagaaugcuggaaggaaaauacgcaauuccggaguucuacaaaagugauuugcaagaagaauuugauagaaucugggcuuuacaaaagagcuuucacauagaacuaacagacgaacucuaccgaaaacuuucugacagaaacaaaucccaaacuugggccauaugucgugaugaauuaggaauacaagggcucaaaucaaguuucauaggaaaagagagacuuaaagaggcuuauagauaccgucaucucgcugcuacucaagaaguaaauauggaaguacuaacuugugcacuacaagaaauaaacgggcaaaaggcaucgcuaaguggacuauuaucuaaaauaagugauaggaguaaagaauuauaccuaaauaaucuaacuguaggacaaaugcugcuuaaaagaauagaagauaauccaaacaauucgcuuaaaaauauagucuuuuauagacaagacuauuuggaugaauuugaaagaauauggaccguacagagcaaauaucacacagaacuaacucacgaauugaagaaaaggcuacgagacauaauaaucuucuaccaaagacccuuaaaaucgcaaaaaggccuaaucucacuaugugaacuagaaacaaaagauaucgaaguagcuauugauggaguaaagaaaaugaaaaacauaggaccaaggguauguccacgaucaucaccauuauuucaggaguucaaaauuuggcaaacaauaaauaacauauuugugaauggcgcagcauuagacgaugaagacaaaagcgucauugcaaaagaacuaauguuuaaagacaaauuaaaagauucggaccugcuaaaacucuuauuuaaaacuacaaaaggccaaucagugaauuucaaagaggucgauggaaacagaacaauggccacacuuaugaaagcauguuuuaaaauugcugaaaauuuaggauaugacgacauaggacuauccaaacuguccagugaggaucaaaugguaagaauagaaggaauauucaaagaacaaggauuuaaaaccggauucuuacacuucgauagcucauuagcuucaccagaauuugaaaaccaagauaguuacagguuauggcaucuacuguacagcuacgagggagauaaaagcgcaucagguaaugaaaguuuaguaaaaugcauaauggaucuaugcaguauggaugaaggaagugcgaaaauacuagcuucauguacauuccuaccugacuauggaucccucucagcaaaagcgaugcgcaaaauauugcccuacaugaaagacggucuggaauauacagcagccugcgcaauggcaggguauagacacagcaaacguagcuuaacaaaagaagaacuugauacaaaagaauacucugacagauuaucauuacuaccuaaaaauucuuuaagaaacccaguagucgagaaaauacuaaaucaaaugauaaacguaguaaauucaguaauugauguuuauggaaaacccgaugaaauaagaaucgaaauggcaagggagcuaaagaaaucagccaaagaaagagaagaagcccaaagagauauagcuagcuccacggcagaaagccaaaaaguaauagaaauauuaaaaggugaaccauucuuucuucaauucccaacuagaaacgacauaauaagauacagauuauaucaagaacuagcucaaaauggcuuuaagacacuguacucgaauacguacauacccaaagacaaguuauuuuccaaagaguucgauauagaacauaucauaccacaagcacuuaucuuuaaugauucauucgcuaauaaaacacuagaaagcagacagugcaaucuagaaaaaggcaaagagacagcuauggacuacguaaaaucaaaauaugaugaaacaggcguccaaacauacugcgacaggguaaacgguuuaauagguaaagggauaucgaaaacaaaagcgaaauggcuacuuauggaagguaaagauauaccagaagauuuuauaaaccgagaauuaagggacucccaauauauugcaaagaaagcacgugaaauacuagaaagccuuguuaaauuuguuguccccacaacgggauccgugacugcaagacuacgugaagauuggcaacuuguaaauguuaugcaagaauuaaauugggaaaaauaugcgagauuagguuuaacaggagucagagaagacaaagaugguagacguauaccguuuauacaggauuggacaaaacguaaugaucauagacaucaugcuauggaugcauuaacaauugcauuuacucgaagacaauuuauacaauaucuaaaucaccuuaauucaaaaauagauguaguaagcugggauaaaaaggaccuugauuuaagagauuacgaccuagaagacaucaaauuuggaaacuuaagugcaggagaucgcuacggaauagugaaggcauuacaagauaaguuucuauauaaagacggaaaugacaaauauagauuuguuccgccaauaccauuggacgaauuuaggcgucaagcaaaagaacaacucucugauauccuaauaucuuucaaggcgaaaaauaagguuugcacuagaaauguaaauguaacuaaaaauaaaggaggagcaaauagaaaggcacaacuaacacccagaggaccacuacauaacgaaaccauauacggaucuaguuuagaguauguaacgaaggagaaugaaaagauaggcucuagcuucgacacagaaagaauaacaacaguuugcaagaagaaauuuagagaugcacuagcaagaagacuagaagaauuuggaggggauccgaagaaagcauucacgggcaaaaacaguccagagaaaaacccaauauggguugaugaacaccacucagaacaaguaccagcaaaaguacgcaccgugacaaugggacagagauuuacaggaagaaaaccaauagacgcaacacuuaaaauagaaaaagucauugauaaacgcauaagagaaauacuacaagcacgucuagacgaguucgauggaaaagcagcaaaagcauuuuccaaucuagaugaaaauccaaucuggcuuaauaaagaaaaaggaauagccauuaaaagaguuaccgucucuggaccagcaaaucccguaccuguccgauucaagagggauaaagaugguaaaccuauuauagaugaugcagguaaaacaauaggagcggauuucguuacaccuggcaacaaccaucauaucgcuaucuuuagagacucaucaggaaaacuucaagaacauccaguaucauuucuugaagcaacaaucgcuaaaucacacggauuggacguuauagauagaaacuauaacaaagacgaaggcugggaauuucucuucacacuaaaacaaaacgaauauuuuguuuuuccgaauagugaaacaggauucaacccacuugauuaugaccuuaccgacccccgaaacuacgcugaaauaucacccaauuuauauagaguccaaucuauuuccacuaaugauuacuucuuucgacaccaucucgaaacaacaucagaaaagaauaacuccuuguacgguaucacauggaagcgaauuagaaaugccagugcauuagaagguuuaguaaaaguaaggauagacaaccuaggccgaauaguugccgucggugaauacgacuga

SEQ ID NO: 5607 - RNA, 4200 nt, Artificial Sequence
  Cas9 variant
auggagacccaagcgacagcucaacuuaucaguggacauuuaaaaggauacccaauuuacgauuauuucguaggacuagauauaggaacuaacagcguagguugggccguaacaaaccggauuuacgaguuacuaaaauuuagaagccauaaaaugugggggaguagacuuuucgaagaaggucaaacugcagucguaagaagaggauuuagaucaauaagaaggagacuagaaaggagaagauuaaggcuaaaauuacuugaagcguuauuugcagacgcuauggcacgcgucgauuccacauucuuuauacguuuaagagaaagcaaauaucacuacgaagacaaaacaaccggacauaaaucaaaacauauauuauucauugacgacaauuauacugaucaagauuauuucgcagaauauccaacaauuuaccauuuaagagcugaucuuauggaaaacggaaccagcgacauacggaaacuuuuucuagccguacaucauauauugaaauacagaggaaacuucuuauacgaaggugcgacguuugacaguaauuccagcuuagacacuguauuaaagagagcacucgaacagauugaauuucacauuuuuaaugcaacaucugaagacgcuuuacauucuauucuugauauagucaaauuacaggauaaaacaaaaucugauaaagccaaagcgauagaaagccuaguagacaccuacauuacagacaaaguagaaucuucuuguacugacaaagaaaaaaaagaccuauugaaggccgauaaaaaaagauuaagggcuuuugccaauuuaauauuaggucuaaaugcuaacuuaaccgauuuauucggaacuauagaagaaaucgaagaagacuucgugaaacuacaaauaacaggagauaccuaugaagaaaaacgagaugauuaugcgaaaguauggggggauacaauaagaauaauagaugacuguaaaucaguauaugauagcauaauccugaugucuauaaaagaacccggccuaacuauaucccaaucaaaaguaaaagcguuuaacaaacauaaagaagauuuagcaauccuaaaacgcuuacucaaaucagacaaauacauauacaaaaauauguuuaaagcagaugaaaaaggacuugcuaauuauguccacuacauaaagcagggacggaaaaacgaaacagggugcucuugcgaagacuucuauaaauauaccaaaaagguaguagaaucacuaccagauucuuccgauaaagcauacauucuuaacgagaucgaacuacagaagcuguuaccucuacaaagaauaaaagauaacgguguaauaccguaccaacuucauuuagaagaacuuaaggcaaucuuagaaaaaugcaaagacacauuuccauuuuuaaacacugugucagauggauuuacaguagccgaaaaacuaauaaaaauguuagaauuuaggauaccuuauuauguagguccgcucaacccaucacauagcauagacaaaggaggauucgcuuggguggaaagaaaagaaccuggccaagugacgccguggaacuucgaagacaaaauugauagggagaaaagcgccgaagcauuuaucaaaaaucuaaccaauaaaugcacauacuuaaucggugaagauguccuaccaaaaucaaguuuacucuauucugaauucauguuauuaaacgaacucaauaaucugagaaucgaugguaaaccucuagaacaagcgguaaaaaugcauuuaauugaugcaguauuuaaaaaagaacacaaaaagcaaacaaaaaacagaauaauugaauuuuuaaaagacaacaacuauauccuagguaagcauaaaccagaaguugauggucuugaugaaagcauuaaaggagaucuugcuucguacagagauaugaaaagaauacucggugacgauuucgacgucucaauggcagagucaaucaucacaagcauaaccauauuuggcgaaucaaagaacaugcuaagggaaacucuaaggaagaaauucggaucaauuuuaucagaggaccaaauucgcucacucgcaaaacuaagguacagagacuggggaagacugagcaaaaaauuuuuaauaggaauagacggaugugucaagggagaagaugguacaccagguacaauaauugauaugaugaggaauacgagccacaacuuaauggaacuauuaggggacacuuucucauuuauggaugugaucauagaagaaaacgacaaauugaccaaaggacaagucguagauccgcaugaaaucauagaagagcuagggcuaucucccgcagucaaaagggcgguauggcaagccuuacgaauaguagaugaaguaauacauauaaaaaaagcuuuacccucaagaauauucguagaaguagcacgcaccaacaaagacgaaaaaaaaaaaaaagauagcagaaaaaaaagacuacaagaacuauacaagagcauucaaaaagaaucacccgaauggcuaucaguuaccagggaugaaucagauaaacuaauaucaaacuuagacagggccgaugauagcaguuugagaucaaaaaaauuauaccuuuacuacacucaaaugggacgcugcauguacuccggacgagucauagaccuagaucaacugaacaccgauaaauacgauauagaccauauuuacccaagaucucuaacaaaagacgacucauuugauaaucucguguuaugugaaaggcaggaaaacgcaaaaaaaucugacaacuauccaauagauccagauauccaaaacgccagaaaacccuuuuggacuuucuuaaaagaccagaauuugauaucaagccguaaauacgaacgucuuacaaggguacuaccauuagaagcagaugauuuaacaggcuucaucgccagacaguuaguagaaacaaaucaaucaguaaaagcagugacaacacuucuaagacgacuauaucccggaguugacguaguauucguaaaagccgaaaauguaaccgacuuuaggcaugauaacgauuucauaaaaguaagaucacuaaaccaccaucaucacgccaaggaugcauacuugaacaucgucguuggaaauguauaucacgaaaaauuuacaagaaacuucagaaaauucuugaaaaaaaauggcgcuaaaagaacauauaaucuagcacguauguucgacuucgaugucaugaguacaaaugcaaaagauggaaaagcaugggacauaaaaacaucaaugaauauaguaaaaaagaugauggcaagcaaugacguaagaguaacaaaaagacuaauggagcaaaaaggagcuuugagugaugcuacaguauacaaagcuucgguugccggcaaggcaaaaggaggagcuuauauaggaaugaaaaccaaagacucaguauuuucugacguauccaaguacggaggucgaacgaguaucaaaaacgcuuacucaauagucguugaauauacagggaaaaaaaaugaaauaauuaaagaaaucguaccauugcccguauauuugauaaacaggaacaaaacggaucaggaauuaauucacuauaucguaucuauuauuccucaagccaagaacguaaguauaauauauaaaaaacuauguauaaaucaacucguaaaaguuaacggcuucuauuacuaucucggggguaaaaccaauaacuauuucuggauagacucugcaauacaagucguaauagcugacgaauggauaccauaccucaaggucuuagaaaaauuugacguaaugcgaaaacaaaauaaagaacuuaaaguaggcacagugucgacuucaauucaaaaccaagguaaaaaaguaguuauaaaaauauuagaagagcggaauguggaauuuuuuucuuaccuagucgguaaacuucauaguucaauauauucaaaaaugaaagguaauaaagcuggugaacuagccacaaaaaguuuggaaauuuucguaaauaugucgcucgaaaaccaauguauauaucuaauggaguuacuaaacuuacuaacaaauaaaaaagccccugacguaaaaccuuuaggcauuacagcguccagagguacaauaggauccaagguaucaaaccaagaugaauuuaaaaucaucaaugaaucuauaaccgguuuguauagcaacgagguaacaauaguauga

SEQ ID NO: 5608 - RNA, 4200 nt, Artificial Sequence
  Cas9 variant
augaacuuaagaaauacaacggaugaauacaauauaggacuagauaugggaacuaauuccguggguugggcaguaacagacaaagccggagcaaucgcccauuuuaaaggcaagccgacauuggguuccagguuauucgaugcagcacaaacagcagcaggggcacguauucauagaucacagagaagacgauauguucgaaggagauggagacuagaucuauuacagagccuuuuccaagaugaaguaucaaaaguugacagcgaguucuuuugcagauuaagacagucaagguuauacguuggcgaccgcgaaaaaggacaugcagauuauacauggccuauuuuuaaugacucagauuucaaugaaguagauuacuauaaaagguuucccacgauauaucaccuaagaaaauggcuaauggaaacggaugaaaaggcggauauaagacucauuuaucuugcaacacauaauauuguaaagcauagagguaacuuccucagagaaaacaauaaaucgcuuaguucaagagaugcaaacccggcucaagccguaaagagcuuaagacucgcgcuaaaugauugguguucagaaagagauuacgaaugcgcuuggaaaggcgaagaagaugacggagcaauugaugaagcaauucuuaacguauuagcagauggggaaaaaggacguucggaccaggcuaaagaaaucgcuaaacuaacaggcguagacugcggagaugccaaacaaagcaaacaaugcaacgaagcaauagcuaaagccauaguaggguuaaaaguagaaaugaaaaauauuuucggcgaauuuccugccgagaaaacaucguauauuuacuuaagcagcgacgaagacguagaagcgguuagagaaaguugucccgacgauaguggagaacuuuuccaggcuuuaugcaaauuauauagcgccuauauacuucaagaacuucuaaguuacgccgacccaucaggacaaacaauaagugcaaauaugguagcaaaauauaaacaauaugggagagacuuacggcuacuuaaagaacuuacaagaacauaugcaccacaaaaauaugauuuauucuuuagaggugaaacauaugccgguucaucagauuauguuguagaugaagcacgagguuacacaagauauaacuuaggcacaacaaaagcaaacuacgaugauuuccagaaaagcguaaaagaacuauucaaaggaacagaugcuuuacaagacgaaagauaccaagaaaugaugguagcauucggggaacaaaaauuucuaagaagacucaaaacaucggauaauggaucaaucuacuaucaauuacaccuugaagaauuacauacaauauuagaaaaccaaggaaaacauuacccauucuuacuaagcgaagaagauaaaauagaaaguuuagucucauuuagaauaccuuauuauguuggaccuuuaaccagaaagaaugcagcuauaggccacgaugguaaagaaagauuugcguggucgucgagaaaagacggcauggaacaugcugucauaacuccuuggaauugggaagaaauuaucgauagagacaaaagcgccgaagauuuuauaaugcgaaugacuggagauugcacuuaccugcaaggggaacccgucuuaccaaaauguagccuauuauaugaagaguuuugugcucuuaacgaauuuaauggcgcacacuggacuguagauggagaugacgaaagaagauucgaugcugcacaaagggaacguauaaugugugaucuuuuuagaagaaccaggucaguaacauacaauaaaguaagcgauugguuagaaagaaaauacaauuuuaccggcgcucgcguaagagguggacaaggugagcacgguuucgagucaaaacuagguaguuauauauucuuuugcaaagacgucuuuaaaacugauggauuagaugaagccgacuauacuaugauagaacaaauaauacuguggucaacacuguuugaagaccgugauauacuaaaaaggaaaauagaagaggcauacggaggagauagacuaacaucagagcaaauaaaaguaauauguaagaaacgauuuacuggauggggacgauuaucuaaacguuuacucacagauauaaaaguuaauacugauacaggaaggaaaucuauaauggacguguuaagagagggcaaccccaauaauggucagaggucacgaaccaugguuuuuauggaaguacucagagaugaagauuuaggauuucaaaaagccauagaugguuuaaauagagauuauuuuagggaacauaauaacgguuuaauggacgucaaugacuuaccgggaucccccgcaauucgaagaagcauaaaccaagcagugagaauugucgaugaaauagcaucuauagcgagaaaagaaccaacaaauaucuucauagaaguaacucgagaagaagaugaccccagaaagaaagguaaacgaacuaaaagaagauacgaugcaauaaaaucugcauuggaaaaauucaagaaagaugauccuagucucuggaaagaguugugugaaaaagcacccggagauauggaugaaagauugucauuauauuucaugcaaagaggaaaauguauguacagcggaagaccuauaaaaauagaggaacuacauacaggaaaauacgaaguugaccauauuauuccacgaaguuauauaaaagacgauaguuuugagaacaaagucuuaguauacagagaggaaaaucaacacaaaacugaugcuuuauuaauugacaguucaauaagacaaaagauggguggcuacuggcguauguuacaugaugcaaaauuagugggcgauaagaaauuuagaaaucuauuucguaaucauauagaugacaaagcgaugaaaggauuuguagccagacaaaucguagagacaagccaaauggucaaauuaguacagacauuauuugaggcacgauauccaaacacacggauaguaccaguaaaagcaggaauaucacacgacuuaagagaagcugcaggauuaguuaaaugucgugaggcgaaugauuuccaccaugcccaugaugcuuuccuagcuugccguauaggauuguucauucaaaaacgucauccgagcgucuaugacaauccaauaggauuagcucggauaaugagggacuaugcaagaaugcaagcaagagaauacaaaaagagucauugucuagcucauacacaaggguuuauaguaaauuccuucuuaucuucuggauuugaugaagaaacuggggaaauauuuaaagaugauugggacgccaaagccgaagucgaagguauccguagagugcugaacugccggcaauguuuuaucucgagaaugcccguagaaggagauacccgauacgguggcagguauuggggugaaacaauauacucaccgaagggaaaacacaaacaugaaauaccauuaaaacaagggcuagacccgaaucuauacgggggauacucagaucucuuguauagcuacuucuugaucuacgaagcuagugaugugaguucaggagagcgaguccugcgauucauagguauuccgaccaguauagcggcccguauggcaaaccaaaagcgucuugaagaauacguaagcagacuugcguuacaggaaaaccuagagcauguuagaaugguucgaaaaauuaugaagaaacaauuaaucgaaguagacaauugcagauuacuuguaaccgcugccgaugcaguaacaaaugccacagaacuagcuuuuucauuagacgaaaugaaaauaauuucuacuugugcuaaauguauaaacggugcagauccaucagcuauugauaaaauaggcaacgcgcaagauucuuucuuugauaauuuaaaacgcagagguagcgaucggugcgcccuccuauuuagucaauuaaaauuagauaaacuaucgcaaaauuuuuacaugaucucaucagaugauaaaucuaaaauacuaauaucaauauuagaccgcauaagagcaaaaagcaacaguguagacuuaucauuagucggaggggcaaaacaugcugcgcaaaugaaauucgauuuuaaugcaaaauugaauaacccugcauccucauucgucuuaauagaucagucaguaacagguauguuugaaagaagaacacgcauagguuuauga

SEQ ID NO: 5609 - RNA, 4203 nt, Artificial Sequence
  Cas9 variant
augaaccuuaggaacgccacaggagacuacucaauuggcuuagaucuaggaacuaauucuguuggcugggcgguaaccgacucaaacgggucaauggcgcauuucaaaggaaagccaacucucgguucaagacuauuugacgcagcagaaacggcagcuggagccagacaacacagaggucaaaggagacguuauguucgcagacgauggcgauuagauuuauuacagggguuauuccaagacgaaguaaacaagguagauagugaguucuucauuagacugagacaaagcaggcuacauguugaagacagagcagaaggacacgcaggauacagauggccauuguucaaugacacugacuucaccgaaaaagauuacuacaagagauuuccuacaauauaccaucugcgaaaaugguuaauggaaacagacgagaaagccgauaucaggcuuauauacuuagcagcucacaauauuguuaaacacagaggaaacuuucucagagaagacaauaaaaaccucaguucccacaaugcuaauccagcagaagcggugaggucauuaagacaagcccuugaugauuggugugccgaaaggggauauguaugcgcauggacauccguagaugaccuagcagaggcggauucacacauacucgacauauuaacaaauucuaaagaaagacgugcagaccaagcgaaagaacucgcuaaacucuucgguguagauuguggagauacuaagcaaaguaaauccuguaauagcgcacuagcaaaagcaguagucggucuuaaaacagaauuaaaagacguuuuuggagaauuuugugcagagaaaacagcuauacacuuaucaucugacgaugauguagaagcuaucagggacgcaauaccggaugauucaggagaacuauuccaaguauugugcgcgguauauuccgcuuauguacuacaagaguuacuaaguuaugcuccaggacaaacuaucuccgcuaauaugguagcaaaguaugaucaauaugggaaagacuugaaauuauugaaaaaucuagcaagaacauaugucucacgcgaaaauuaugacgcauucuuucgaggacaaacuuaugaagauaguaaugauuauaauguagauaaagcccaaggguacacacgauauaaccuaggaaccacgaaagcaucauaugaugacuucaagaaaagcguugaaaagcuauuuaaaggcacacaagcugaacaagauaagcguuaucaaggaaugaugaaacgcuucgcugaagaaaaauuucuaaggagguugaaaacaagcgacaaugguaguauauauuaucaauuacaccuugaagaauugagagccauccuaaagaaccagggcaaacaucaucccuuccuauuagaagaagaaaagaaaauugaaaguuuaguuuccuuuagaauacccuauuacguuggaccacuuucaaguaaaaacgcgucacuugaccacaaaggaaaacaaagauuugcuuggucugaaagaagacccgguaugaaagacacaguaauaacaccauggaauugggaccaaaucauugauugcgaccaaagcgcagaaaaauucauacuaagaaugacaggagacuguacuuauuuacaaggugaaccgguauuaccgaaaugcagucuacuguaugaagaauauugcguauuaaacgagcuaaauggugcuagauggacaauugauggggaugacuggagaagauucgauguagcacagagagaaggcauauugcaugaucuauuucguaaaacuagauccguggcauacaauaaaguugcugacuggcuugaaagagaagaaaauugggcgaaugcucauguuagagguggacaaggcgaaaauucuuuugaaucgaaguugggaucauacauauuuuucugcaaagauguauuuaaaacagcggcacuagaugaagcagauuacccaaugauugaacaaauaauauuauggaacaccuuauucgaagaccgagcaauauugaaaagaaaaauagaacaggcauacggagaacaccauggagggaaacuaacugaugaacagaucaaagucauauguaagaaaagauucacaggguggggacgauuaaguagaaaauugcuaacaggaauaaagguggaugccgauacaggaagaguaaguaucauggacguuuugcgagaaggaaaccccaaugaaggucaacggucucgaaccauggugcuaauggaagugcuaagagacgaagacuuagguuuucagaaaaagauagaugacuuuaacaaagcauauuuugccggacaaggugaaggucuaaugaguguaaaugacuuaccagguaguccagcaauacgccgaucuauaaaucaagcaaucagaaucguugacgaaauagcgagcauagcaggaaaggcuccuaguaacguuuucauagagguaacccgggaagaagaugauccgcgcaagaaagggagaagaacaaauagacguuaugaagauauuaaaaaugcuuuagaaaauuuuaaaacagaagaucaagaauuauggucagaauuauuagggaaagcucccaaugaucuugacgaaagacuaucgcuauacuucaugcaaagggguaaguguauguauucugguagaccuauaaaguuggaagaauuacauacaggaaaauaugaaguagaccacauaauuccaagaaguuacauuaaggacgauaguuuugaaaauaaaguauuaguguguagagaagaaaaucaacgcaaaacaaaugaaaugcuuauagacccugcaauaagacgaagaaugggagauuauuggaggauguuacauaaagcaaaauuaauaggagauaagaaauuuaauaaucuuuuuaugcgggaccgaauugaugauaaaacauuaaaaggguucguggcaagacaauuaguagagacaucccaaucggugaaacugguacaaacacuuuuagaaguacgauacccaaauaccaaaaucguaccuguuaaagcaaauauuagccaugaucuuagagaagcagccgacuuagucaaauguagagaagcaaacgauuuccaucaugcacaugaugccuauuuagccuguaggguagguuuauuuauucaaaaacggcauccuagcguguaugcaaaucccauaggacuaucaagaguaaugagagacuacgcaagaaaacaagcuggcgaauuuaauaaaacucauaguauggcacauacuaaaggauucauugucaacaguuuuaugacgagcgaguucgauaaagaaacaggugaaauauucugggaugcagaagcagcgguugaagauauacgcagaguacucaauuaucgacaaugcuucaucucaagaaugccagucgaagacacaggcgcuuuuugggaucagacuauauacuccccuagaucuaacaagcgauuagaauuacccuuaaaagacgacuuagacccgaauaaauacgguagcuacagcagagaacaauuugcguauuucuucauauacgaagcaagagaugcgaagaaaucuaaaacaguauuaagauucgcgcaaguaccaguaagagugacaucagcuaucgcaagagauucaagcaagcuagacgaauaugcaucaggucuagccguacaagaaggauuagaguucacaaaaaucauaaggcgaagaauuuuaaagaaacaacuuuuagaauuaaauggggacagauuaguaauaacaggugcaaaggaaguccgaaacgcgaccgaauuugcauuuacucuagaagaaacugcacuuguagcuauguguucagagauugcuagagaaggaguuccaucugaaauugcuucugacguacaaaguauauccagccaacuaucagaccuauuucuagcacuaauagaaagagggcuaacaauaggaguaagacuucauggucagcucaaacuaggccaguauuuacgacaauucgaagaugcagcacuuagagacaaggcaaaaguaaucauaggaauaauaaguauaaccaauggcgcaacuaauacauuagaucuaagcagccuaaaugguaguaaaaauguuggacaaguaagaauaacccauaauaaacuuuuaaacgauaagaguacaaguuacgucuuaauagaucagaguguuaccgguauguuugaacgacgaacaaggauuggcuuauga

SEQ ID NO: 5610 - RNA, 4203 nt, Artificial Sequence
  Cas9 variant
augaaaacaaucaccgaagauuacauacuagguuuagauauaggaacaaauucaugcgguugggccguaauggacaaaaaaaaccguuuauuaagauuacgagggaaaagagcaaucggcagccaucucuuugaagaaggacauagcgcagcugaccgacgaucuuuuagaacaacgcgacgaagacuaaaacgacgcaaauggcggcugagacuucucgaagaauuuuucgcugaaccaauggccaaagucgaccccgcauucuuuguaagacuucaucaauccuggguguccccacuagacaaagacaggaaaaaauaucaugcgaucguauucccgacagcaaaagaagaccaugaauucuaccaugacuacccuacaauauaucaucuucgagacgcauuaaugagagaggauagacaauucgacuuaagagaaauauuccuagccauucaucauauagugaaauacagaggaaacuuuuuacaggauacaccaguaaauucauucguagccucgaaaauagacguagcuagcuuucuaaccaacguaaaccaagcauacgcggauaaauacggggaagagcagaauuuuauagaacuaaacgaaaacaacgcagcagcuauagaagcgguaauaagaggaaaagacaaagacaaaacuaccaaacaacuugauaaagcaaaaaaaaucacaaaacuacuacaaucuucaacaaacaaauaugaaaaaaacguuacaaggcaaauugcuaaugcaauaauugguuacaagacucaguuugaaaccaucuuaggaaaagauauagacaaaaacgauaaagcggauugggaauucaaacucagugauggagacgccgacgauaaacuagaaaauuugcugccagaauuugacgacaacgaccaauacaucgucgccgaaauaaaaaaacuauucgguucaauugcgcuaucgcaaaucguuuaugaaaacaugacuuuaagccaauccaugaaaugcaaauacaaagaucauggcgaagacuacgacuuauuaaaacaauacauagcuacgcuaucugaccauagucaaguacgaaaacuauuacuggcauaugacuuguauguaaauaauagacacggacgccuacuagaggccaagaaagaguucaaacaagacaaagcacuaacccaagaugaguuuuauaaaauaguaaaagaaaacuuagacgacucacaauuagcccaaaaaauccuucaaaaaaucgacgaagguaaauucaugccaaagcaaagagugaauaaaaacggauacauuccguaucagcuacaccaaauagaguuagaccaaauaauagcuaaccaaaguaaguauuaucccuuucuggcagaagaaaacccugucaaagaacacagaaaacaagcaccuuauaaacuagaugaauuaguacgauuuagaguuccauacuacguaggaccacuuaucucuccagaugacaaaagaaaagaugaacagcaaaauaaaaaccacgaaauguucaaauuugcauggaugaagagaaaagaugacaauggagcaauaacaccuuggaacuuugcccaaaaagucgaccgugaaacaucagcuaacagauuuauaaaaagaaugacuguuaaggauacauaccucaucggcgaggauguacuuccggcccgaucucuauuauaccaaaaauuugaaguacugaaugaauugaacaacauacgaguuaaugguaaaagauuagaaccaaaauuuaaacaaaaaguauucaacgaacuguucaaacaaaaaaacaaaguaacaaaaaaagcauucaaagaauucauacuacaaaauacaggaaugaagacagcugaaauagacggcuuagcagacccaacuaaauucaacuccucuuugucgucauauuaucacuuaaaauccacuaagguuuuugauaaacaacuagacgacccacaguaccaagcagauuuugaaaagauaaucgaauauucaagcaucuucgaagaugccgaaaucuaccaagaaaaacuacacaaagaaauaaaguggcuaaccccagcacaauucaaagcaauagcaaauuggagacuucaaggcuggggcagacucucacgcaaauuacucguugaauuaaaaggaaaaggaggagagaauaucaucuaucagcucuggacaacacaaaaaaauuucaugcaaauaguaaacgaaccagaauuaaaaaaagcuaucguaaaagaaaaccaucaagcaacggaagaaaaaggaauagagaaaauacuagacgauucauucacaucgccagcaaauaaaaaagccaucaggcaaguuauaaaaguagucgacgacguaguaaaggcugcagggggcaaaaaacccgcacaauuugcuauagaauuuacaagagaaccaaaguggaacccacauuuaagcaauauuagaggaacaaaacuucuacaaguauaugaagauacagcaaaaaaauuagucgaccaaagucuuacagauucacuccgugaaaauaugaccaacagaaaucuacugaaagaugaauacuuccuauacuuuauacagggaggaagagaugcguacacuggaaagaaaauugacauagaugacauaccaaaaaaauaucaaaucgaccauauccuaccgcaaagcuuuauaacugaugauuccuuagacaauagagugcuuacagaaauagaaauaaaucagaaaaaagggaaaaaauacgcuagccacuuauucgcucccaaaccagcuuuuggucucaaccaauccaucucagaaauguggaaaacuuggcaaaaggcaggccuuauuucacaaagaaaacuaaacaaucuauuauucgaucccgaccuugugaaggacaaacaaaaaaaaggcuucauaaaucgacaauuaguagaaacaucacaaaucaucaaacugguuucaauuauccuacaagauaaauuucccgauacggaaauaauaacgguaaaagcgggauauaauacugcucugcgaaaagaacugaaacuuuacaaaagucgcgaagcaaacgacuaucaccacgcaauugaugccuauuugacagccauaugcgacaacuuucucuaccaaguguauccuaacuuuaggccuuuuuucguauacggccaauucaaaaaauucucacaagacaccgacaagcaaaaaaaagcugucaaauacuauggcuuaaaaaacuuccuauuaccacuuuuagacgauucuacaggagacgaagucaugguaaaccauacaaaacacgucguauuccauaaacaacgugauauauucaacagacuaauccaagccuacaauuacaaauauauguuaguuucuagagaaacuacaacagagaacucaaacauguuuaauaugacaauauauccacguggggaaagagaucgaaaaaaaacacgcaaauuaauaccaaaaggaaaagauuuagauccugcuauauauggaggcuauucggggaauacugaugccuauaugguaauagucaaaauagagaaaacaaaagaaacuuuguauaaaguaguaggaguccccaugcgugcauuagcaucccucaaaaaagcucaaaaagaaggaaauuacgaccaagaauuaaauaaaguacucgagccacucauaauguucaacaaaaauggaaaaaguaaagcugguauaaaaggauucaccguaguuaaggaucauguacacuucaaacaaguagugauagacggagacuccaaguuuauguuauacucagcucaguacagagcaaacgcaaagcaacucacucuaucccaagaaacaaugaaaguaguuaccgacaauacagacgauauggaccaaaaaaacgcagacaaagaucaacuauuacucaacgcuuacgacgaaauacuagaaaaggucgaccaauaccuaccauuauuugauauaaacggcuuccgucagggacuacacgauggucgagcaaaguuugccgcacuaaaaacaagugaaaaaaaauauacccuaaaaaacguacugaacggacuacaugacaaucuaguaacaccaaaccucaagaauauaggcauaaagacccccuuuggacuuaugcaaagcaguucuggaauaacauuaucaccaaacgcaaaacucguauuucaaagcccaacaggauuauuugaaaaacgugucaaauuaacaaauuuauga

SEQ ID NO: 5611 - RNA, 4203 nt, Artificial Sequence
  Cas9 variant
auggguaaacaaaaauuuaacgacuauuacuugggauuugacauaggaacaaacucagcagggugggcagucacagaucugcaauacaaacuguuacgcuucaauaagaaagauauguggggaucaagacuuuuugaugaagcacaaacauccaaggaaagacgaguauauagaaacagucguaggcgacucgacagaagaaaaaagaggcuaaaacuauuagaggaacuauuucuagacgaaauuucaaaaauagacaauacguucuucaaaagacugaaagagucaaaucuuuauaacgaagauaaaucaauaaaauuuaauuaccccuuauucaaugacaaagacuauacugauauugacuucuauaaugaauacaaaacaauuuaccaucuaagaaaagaucuaauauucgaggauaaaaaauuugacaucagauuaguauucauugcacuacaucauaucuuaaaauaucgaggacauuucauauuugaaggucagucguuugaagagaucaaaagcuuugacaguaucuucacgcaacuaucuuccuauuuccucgaaaacuucgacuuuaacauagacguuucuaucaaagaaaaacuagaagaaaucauauugagcgacaacacuaaaagcaucaaaaaaacagaauuuaaaaaaauauucagugacaauaaaguacuauccguccucaacauggcuauagggucaaaaguaucauuaaaagacguauucaacaaugaagaauuaaaagaacaaaagauuaguuuuucagagauagauuaugaaaaugaaaaaagagaugaguuuuaccaguuacucggcgaagauauauuuuuaaucgaucucgcaaaaaaaauuuaugacuucaugguacuaaaaaaaauccuaaaaaauacagacagcuucuccgcaucgaaaguagcauuauauugcgaacauaaaaaagaccuagacgaccugaaguacauauuuaaaaaauaucucacgaaagaagacuauuuuaaauucuucagauccaaugucgaaaaaaucaacuauccaagcuauauaggacuaaauaaaaucaaaucaaaaaaaauaauaaaagaaaauaaaugcucaaucagugauaucaacaaagaacucaagaacaaguacuuaaaagauaucaaauuagaagcgaaagacaaagaauuauuuaaucgcauauucaacaaacuagaugaauucaaauuucuagaaaaacuaaaaucuucagaaaauucaacaguucccuaucaaguacaugagauagagcuaaaaaaaauacuagauaaccaaagaaaauauuacccuuuuuugaaugaaaaaauugacggaaagucggucuaugaaaagauaauacagcuuuucgaauucaaaaucccauacuauaucggcccucuaaauacagauccaaauguaaaaggaaagaauacauggguagugcgaaaagaugaaaacaacaaaacgccgauaacccccuggaacuucgaacaaaaaguagauaugcaaaaauccgccgaagaauucaucaaaaggaugacaaaucguuguacauaccuaaaagccgaagacgucauagcaaaaaacagucuccuuuaugaagaauuuauccuccuaaaugaauuaaauaaaguuacaguagauaaugaaauucuacauccaacauugaaaaccgaaauaaucaacgaauuauuuaaaacaacagucaaaguaacuaaaaaaaaauucauagaauuucugaaaaaaaaacaagcaguuaaugacguagaaucaauuacuggaaucggugucgaguucaacugcaaacuucaaggguacaauacauuccgcaagauacuaggaaaaaaaauugaaaauguaaacgugaaaaacuuugucgaaaaaugcauugaacuaaagugucuauaugggucagauaaaaagcuguucgaaaacgcaauuggaaagauauacagggaauacaauauaacagacgaagaauucaauaaaauuaaccgccuuaacuucaauaaaugggcaagacuaagcaaaaaguuucuaacugaaauaucauucgaaaagaccgaugguacaaaaagguuugaaucuguuauagaagcauugcgcucuacaaacuauaaccuaauggaacuacuaucagacaaauuuaaccuacaaucaaaaauagaugaaauaaauggagaagaugacuucucaaacauagacauuaaagaauacguagacaaauuauaugucucaccuagcguaaaaagaaguauaauacaaacauacaagauagcaauggaaauuaaaaaaauaacaaagaaagauccuaagaaaauauucauagaaauggcaaaggauaaaggagagaaaggaaaaacaacagaaaaacgaaaagacaaaauaaaaaaacuguacaaaaacauaaaagauacauuauccgacuacugcaacaaucugcaggaccucacucuacaaguagaaaaauaugacgacaacagacugcggcaaaagaaacucuuuuuauacuucaugcaaaugggaaaaucuauguacacaggcagaugcaucgaucuagaagaccucuucaauaauaaugucuaugauauagaccacaucuacccacagaguaaaguaaaagaugauucguucgauaauauugucuuaguugagaaagaagaaaaccaucgaaaaucaaaugaacuccuaaaagaagaaauccaaucaagaaugaauaauuacuggauauucuuacgcgaaaauaaauuuaucucaaaagaaaaauacaaccgacuuacaagaaaaaaagacuuuaccgacgaggaacugggugauuucguugccagacaauugguaaccacucgacaaucaacaaaagaaauagcaaaauucuucgaaaaaauauucgaaaaaacaaccguaguauacagcaaagcaagccuagugagugaauucagggaaaaguacgacauaauaaaaguacgagaaguuaacgacgcucaucacgcacaagacgcauacuuaaauaucguaguaggaaacguauucaacacaaaauuuacaaaaaacuacuggaaauuuaccaaagauauaaaaagacaaaaugaagaaaauccaaaugagaagaagggauacaaccuaagaaaaauauacgaaucagacguauucuguaacgauucaguagcaugggucuacucgaaagagaacccaaaguacaauacaauaaacacagugaaagauauggucuaccgaaaaacagccaauauaacaagaaugcuagucgaaggaaagggucaacucuuuaaucuaacuauaaaagauaaaacacaacuuaaaaaaaacgugggaaacauagucgcaaacacaccaaucucacuaaaaaaccgcaagcuacacuuaaacucaguagaaaucgcaaaaaaauaugguuauuucgacagucugaacaacgcauacuucguucucuucaaauaugaagaaaaaggcaaagaaaaaauuggauucgauagcauaaccauugcauacaaagaacgauuaaaaaagaacuuggauaucgaaaaauuucuagaaaacaaaggauacaaaaacaguaaacucauccgcaaaauauuuaaaaaccaaaagguacucauaaacggauaccccuacuugcucaaaucauucaauaaacaaagccaaaucaaauuuaacaacuucaaaauauuauaucuuaaugaaaauaaucuaaaauuugccaaagaugcaauaaaguucgaaaaaaacaaugcaaaugucgaucuaaaaaagcaaaaguauauagucucauuccuaaaaaaaaagaaacaaaaugaaauuaaugaaacauacgaagaaugcaucgacagacuaaacgacgaauucgauacccuauucuuaaaacuuugcgacauacaaaaguccuccauuuauaccaauuacaaacuacaagacuuuucaaguaauaaaaaaagcauugaaaucaaagauaaauuugauaucuuuaagagcuuagaucuguauaagaagucuaaacuaauaaaagaauuucucaacuauuacaaauaugaaaaaaacgaucuagacuucucccuaauagacauugauaaaaaggcuaacugcauacaaaagcacuucacugaagaccuuguaaaagacuucguuauaguugaugaaucuguuacagggcuauucguuaaaaaagaacgacuaaaauga

SEQ ID NO: 5612 - RNA, 4203 nt, Artificial Sequence
  Cas9 variant
augaaaacuauuaccgaagauuacauacuaggauuagauauagggacuaacaguugugggugggcggucauggacaaaaagaauagacuucuacgucuacgcggaaaaagagcuauaggcucacaccuuuuugaagagggacacucagcagcugacagacgaucauuucgaacaacuagaagaagacuaaaacggagaaaauggcgacuucggcuauuagaggagaucuucgcagaaccuauggcuaaaguagacccagccuucuuuguaagacuacaucaauccugggucuccccauuagauaaagacagaaaaaaauaccacgcuaucguauucccaacugcaaaagaagaccacgaauucuaucaugauuacccuacaaucuaccaccuacgcgaugcccucaugagagaggacagacaauuugaucuaagagaaauauucuuagccauacaucauauuguaaaauauagaggaaauuuucugcaagauacaccugucaacucauucguagcaucuaaaauagaugucgcuucuuuucuuacgaacguuaaucaagcuuacgccgauaaauacggagaagaacaaaacuuuauagagcucaacgaaaacaaugcagcugccauagaagcagucauaaggggcaaagacaaagauaaaaccacuaaacaguuagauaaagcaaagaaaauaacgaaacuuuuacaauccucaaccaacaaauacgaaaaaaacguaacaagacagauagcaaaugccauuauagguuacaaaacacaauucgaaaccauauuagggaaagacauagacaaaaacgacaaagcagacugggaguuuaaauuauccgauggagaugccgacgauaaacucgaaaaucuguugccugaauuugaugauaacgaccaauacauaguagcagaaaucaaaaaacuguucggcucaauagcacuaucacaaauuguuuacgaaaacaugacacugucucaauccaugaagugcaaauacaaagaucacggcgaugacuaccauuuacuaaaacaguauauugccacacuuagugaccauggacaaguaagaaaauuacuucuagcauacgaucuauaugucaauaacagacauggaagauuauuggaagcaaaaaaagaguucaagcaagacaaagcacuuacucaagaugaauucuauaaaauaguacgugaaaauuuagacaacucacaauuagcucaaaaaauacuacaaaaaauagaagaagagaaauucaugccuaaacaaagaguuaauaagaacggcuuuauaccuuaucaacugcaucaaauagaauuagaucaaaucauagcuaaccaaucaaaauacuauccguucuuagcagaagaaaauccggucaaagaacaccguaaacaagccccuuauaaacucgaugaacucgucagauucagaguuccuuacuacguagggccuuuaauauccccagaugacaaaagaaaagauaagcaacaaaauaaaaaccacgaaauguuuaaauuugcauggaugaaacgaaaggauaauaauggugccaucacgccguggaacuucgcccagaaaguagaccgagaaacaucugcaaacagauuuaucaaaaggaugacuguaaaagauacauauuuaauaggcgaagacguguuaccugcgcgaagccuacucuaccaaaaauuugaaguacuuaacgaacuuaauaauauaagagucaacgguaaaagacuagaacccaaauucaaacaaaaaguauuuaacgaacucuuuaaacaaaaaaacaaaguuacaaaaaaagcuuucaaagaauucaucuuacaaaauacaggcaugaaaaccgcagaaauagauggacuugcugauccaacaaaauucaauucaucccuaucaucuuacuaucauuuaaaaaguacgaaaguuuuugacaaacaauuagacgaucccgaauaucaagccgacuucgaaaaaauuaucgaauauagcucgaucuuugaagacgcugagauauaucaagagaaacuacauaaagaaauaaaauggcuaauaccagcacaauucaaagcaauugcaaacuggagacuacaaggcuggggucgucugagccgaaaauuacuaguagaguugaaaggaaaaggaggugaaaauauaauuuaccaacuuuggacaacacaaaaaaacuuuaugcaaauugucaacgaaccugaguuaaaaaaagcaauuguaaaagaaaaucaccaagcaaccgaagaaaaaggaauagaaaaaauauuagaugacucuuuuacuucccccgccaauaaaaaagcaauccgucaagucaucaaagucguggacgacguagucaaggcugcaggaggaaaaaaaccagcucaauuugcuaucgaguuuacaagagaaccaaaauggaacccucaauuaucccacaucagaggcacaaaacuguuacaaguauaugaagauacagccaaaaaacuggucgaucaaagucuaacugauucauuaaaagaaaauaugacaaacagaaacuuauuaaaggacgaauauuuccuauacuucauccaaugcggacgagacgcauauaccggcaaaaaaauagauauagcugauauacacaaaaaauaucaaauagaccauauacugccacagaguuucauaacagacgacucacuugauaaccgaguacuaacagaaauugaaauaaaccaaaaaaaacauaaaaaauacgcaagccaucuauucgcaacgaaaccagcauucgguuugaaucaaagcaucagcgaaauguggaaaacauggcaaaaggcaggacuaauaagccaacgcaaacucaauaaucuccuuuuugaccccgaccuagucaaagacaaacaaaaaaaaggauucaucaacagacaacuaguagaaacaucccagauaaucaaacucgugaguauaauccugcaagacaaauuuccagacacagaaaucauuacagucaaagcaggcuacaacaccgcacugcgcaaagaauuaaaacuuuauaaaucgagagaagcaaaugacuaucaccaugcaauagaugcauaucuuacagcaaucaacgacaauuuuuuauaucaaguauauccaaacuucagaccuuucuuuguauauggacaauucaagaaauuuucacaagauacugauaaacagaaagaagcuaucaaauacuacggauuaaagaacuuuuuagaaccguuacuagacgacuccacaggagacgaaguuaugguuaaucacaccaaacacguagucuuccacaaacaacgagacauauuuaacagauugauacaggcauacaacuauaaauacaugcuaguaucgcgagaaacaacaaccgaaaauucaaauauguucaacaugacaauauacccgaggggagagagagacagaaaaaaaacaagaaaauuaauaccaaaagguaaagauuuagacccagcaauauauggaggauacucaggaaauacagacgcauauaugguuauugucaaaauugaaaaaacaaaagaaacacuauacaaagucguugguguaccaaugcgugcauuagccagccuaaaaaaagcacaaaaagaaggaaacuacgaccaagaacuuaacaaaguauuagaaccuuuaauaauguuuaacaaaaacggaaaaucaaaagcagguauaaaagguuucacagucguaaaagaccacguccauuucaaacaagucguaaucgacggagauucaaaauuuaugcuuuacuccgcucaguaccgcgcaaacgcgaaacaacucacacuuucacaagaaacgaugaaaguaguaacagauaauacugaugauauggaucaaaagaaugcugacaaagaccaacuauugcuaaacgcuuacgacgaaauccucgaaaagguagaucaauaucuaccacucuuugacaucaaugguuucagacaaggccuucaugacggacgagcaaaauucgccgcucugaaaaccagcgaaaaaaaauacacgcuaaaaaauauuuuaaacggccugcacgauaaccugguaaccccaaaucucaagaacauaggaauaaaaaccccuuucggccuuaugcaaucgucauccggaauaacauuaucaccuaacgcaaaacuuguuuuucaaucaccuacaggucuauuugaaaaaaggguuaaacuaacaaauuuauga

SEQ ID NO: 5613 - RNA, 4203 nt, Artificial Sequence
  Cas9 variant
augaaaacaauacuagguuuggaucuaggaacaaauucaauagggugggcccuaguaaaagaaacagaaaacuccaaugagaaaagcgaaauaauaaaacuaggaguacguguaaacccacuaacugucgacgagaaaacaaacuucgaagcaggacgaccacuuucaacaaacgcugauagaacagcaaaaagaagcgcgagacgcaauuuacaacgauacaaacuaaggagaaagaacuugauagauuugcuaaucaaacauagacuaauagauaaagacacaccacuuacagaaauaggcaaaaacacgacccaucaaacucuagaauuaagggcaaaagcagcaagagaacgcauagaacuagaagaccuugcgagagucuuuuuagcaauuaacaagaaaagaggauacagaucaucaagaaaaguaaacaacgaagaagaaggacaaguaguagauggaauggcaguugccaagaaacuauacgaugaaaaucuaacacccggccaauaugcguaugaacuacuauccaaagguaagaaauacguaccugacuuuuaucgcuccgaucuacaagcagaguucgacucuauaugggaauaucaaaaacaguuuuaugcggacauacuagaugaugaacucuauaacgcauuaaaaggacaaggacaacaaaauagccgaaaacgauuccuagcuauaaaaggcguuuacacagcugaaaauaaaggcaaacgagacgaaguaaaauuacaacauuacaaauggcgaagugaagcaauaacacaaaaacucaguauugaagaaguagcauauguacuuguagaaauaaauaacgaucuaaauaaaucaagcggcuaucuuggagcaauauccgacagaucuaaagaauuauacuucaauaaagaaacaguaggcgaaaaucuauggaaacaaauucagaaaaacccucacaccagcuugaaaaaucaaguguuuuaucgccaagauuaucucgaugaauuugaacaaauuugggaaacacaagcacaauuccauccccaacuaacucuagcuuuaaaagaacaaauaagagauguugucauauucuaucaacguaaacuaaaaagccaaaaaggcuuacucagcuucugccaauuugaaagcugggaaauagaaagaaaagacgagaauggcaacguaauccuaaauaaaaccacacaauuaccaaaaagacaaacggucgguagaagaguagcacccaaaagcucuccauuguuucaagaauuuaaaauauggcaaaauaucaacaaccuggagauagcuaaaauauccgacggaaauucgaaaaacaagaaagaaacagaagcacuauccgacgaugaacgaaaacucuuguucgaagaguuaaacuugagaggaaaucugucacaaaaagaaguucuacaaauauuaggacugaaagacaaagaauauaaaacuaauuuuccagaggguuuggaaggaaaccgaacaaaugcagcuuuauucaauauauaccaacaaaucgcagaaaacgaaggauacggcgauuggaccaagaaaucagcgcaagaaauaaaagaagaauuaaaagcaguauucccucagauuggcauacaagcugauauacuagauuuuaaugcagaacuagacggaaaagaauuugaaaaucaggcaagcuaucaacuauggcacuuauuguauucagcagaagaagaugauaaaauaaacgaagaagaccaaauaauauacggaaacagugcagugagucucaaaaagaaauuaugcgaaaaauucgguuuuacaccugaauacgcaaaauggauagcaaacgugagcuuacaagacgauuauggcaauuuaucaacuaaagcaaugaggaaaauaauaccauaccuaauugauggaaacgacuauucagaagcaugcgcauuagcagguuacaaucacucgaauaguuuaacaaaagaagaaaaugauaaucgagaacgacuuaacaaauuggagcuccuacccaaaaacagcuuacgaaacccagucguagagaaaauucuaaaccaaauggugaacguugucaaccagguuauagaaacuuacggaaaaccugaugaaguaagaauagaacuagcaagagaacucaagaaaagcgcagaagaaagagcagagaugaccaaaggaauaaacgaagcaacaagaaggaaugaagacaucaagaaauuaauaacuaagaacuuuggaaucccuaauccaacaaagaacgauguaguacgauauaggcucugggaagaacuagcaccguuagcauacaaagacguguuuacuggacgccaaaucaagaaagaagaucuauuuagcucgaagauagacauagaacacauaauaccaaaagcgcuguuauuugacgauagcuucucuaauaaaacucuggccuucagggaaacuaaccucaagaaagcagaccguacagcuuacgguuucauagaaucugacuacaaugcaacacucgaugacuauauacaacgaguggaaacacuauauaacaaugccaagggcacaaucucaaagggcaaaaggaauaaauuacuaauggcccagaaaaaccuaccagauggguucauugaaagagacuuaagaaacucacaauacauagcaaagaaagcuaaaagcaugauugaaaaaguguucaacgaugucaauguuacgaguggaucaauaacagaccgauuaagagaagauugggaccuaauaaacguaaugaaagaauuaaauuucccaaaauacaaagcauuaggacucacugaaauagaagaacguuaugauauaggacaagagaaaacuaagaaaguggaaguaauuacagauuggacaaaaagaaacgaccauagacaccaugcuauggaugcucuuacuguugcauuuacuacaaaaucacauguacaauaucuaaauaaucucaacacaauacacucuuuaaaaggagacgaaguagaccuagaauuaaguaaacucuauggucugaaaaauaccaucacagaagucguaaauaagaaaaggaaguuuauuccgccaaugccaaauuuucgugaagaagccaagaaacauauagagacaauacugguaaguaucaaaaauaaaaauaaaguauauacuaaaaacaucaacaaaaccaagaaagagucaggauaccacaccaaagagcaacugaccccucgaggacaauuacacaaagagacaguauacgguaaaucuaaacggccuaugaacaaaccaacgaaaauuaacaagaacuuuaguuuagaacaagcacaauuaauuauaaauguacaagaaaaagagcuaguauuaagacacuuagcccaauucgacaacaaccccgcaguagcuuucgauacaaagacuuuaaagaaaaugccgcuucucaaaaacggagaaccauugaaagaaguauuaugcuucgaggaaaucuuuacaauacgaaaagacauaacaccagacuuaaagauugaaaaagucgucgacgagaaaauaaaagcaauucuggaacaaaggaaaaaggauuuugguggcaaugcuaaagaagccuuuuccgacuuagacaaaaacccaauauggcuuaauaaggaaaaagguauaugcauaaagcgaguaacuauaacaggcgucagcaaugcugaagcauugcaucaccaaaaagaccaccuaggucgcgaaauacuagaugacaacggaaauccaauacccgcugauuuuguaucaacaggaaacaaucaucacgucgcuauauacgaagacgaaaaagguaaguuacaagaaaaaguaguaaguuuauaugaagccguagcaagagcaaaucaagguuugcccguagucgauaaaggacuuaacgaagauuuaggauggaaauucuuauucacaaugaaacaaaacgaaauguuuguauuucccaaugacgacuuugauguaaacgauauugauuuacuagaugaaaacaaugccaaaauuauaucacaacaucuauuccgcguccaaaaacuagcaacuaagaacuauauguucaggcaccaucuggaaacgaacguucaggaaguaaaagaacuaaaugacaucgcauauaaaaguaucagaucaaccgaaccccucaaaaauaucaagaaaguaaggauaaaccacauuggcaaaauugugcagguaggugaauauuga

SEQ ID NO: 5614 - RNA, 4209 nt, Artificial Sequence
  Cas9 variant
auggcaaagaaagacuacacaauaggucucgacaucgguaccaacucugucgggugggcaauaauugacgacaaccuaaaacuacuaaaaagaaacaugaccauaaaaggcaauaccgauaaaaaaucagucaagcgggaccuauggggaagccuacuauacaguggaaauagcgacaaaacuacuucagcagcagaugcccgaagcaaaagaggacuuagaagaagauuacgacgaagaaaauauagauuggaucgccuuaaacaaauauucagugaaauaaucaaugauaaagccccuaauuucuucgacaaacuaaacgaaucauuucugaaucccaaagauaagaaauacgguaaguaucaaauauuugacacagaaaaagaagaaaaagacuacuaucgacguuauccuacaauuuaccaccuaagaaaagauuugauagaaagcucaaaaaaacaagauauuagacucguguaccucgcauuagcacacauacuaaaaucacgcggaaacuucuuauucgaaggcaacauagacgacuuaaaaaacgacuuugcugguauauaugaagaaguaguagaacuauguaugaccauuaaugccgaagacguagaucucgaauucgaagaagucgacaaacaaucacucaauucaauuauaaaaaacgaggacauaagcgaaaucgaacaaggacuagagaauuuugccgacgaacauguuaucuucaaagaacaaaauaaaaagaaaaaugauuuauucucaaauuguuguaaaauaauuugcggccauaccgucaaagcaaauaaauucgcaucagaacucgacucagaauuauuuauaagcuucaaaucagacgauuaugucgacgugaucgauguuauacaaucuggaaaugaaaacauagcaaaucuacuacuggcuuguaggaaagcauacgauuacaucauguucaaccgacuuguugacuuaaauauagauagcccagcaaaauuaagcagcaacaugguaagucuauacaaccaacacgagaaagaucuaaaagcauauaaaaaauuaauuaaagaguuuaauaaguucaaaagaucaaauggaugcaaggaucuagaaaugauuaucuuaacagcugacgacauagacagcuuuagaaaaaaaguagacaagaaggaagggaaauuaaauggcauaaauaaaaaaauuacacacgaacaagcauuaaagaaacaauuaaaagacaugaaaaaaauauuagaggacaaaaauacagaagcagaagacaaacaaauaaaugauauauuaaaaaugaucacaaguauagaagaacguguaaauaaaagcuguuuucuaaaaaaccucagaagcaccgacaacgccucaauaccaaaucaaauacagagacaagaaauggaagccauacuugacaaacaagcuaaauucuacccuuuucuaaacgaacacaaagacgaauugcuacaacucuuguccuuuagaauacccuauuacguuggaccauuagucaauaaaaaauauagccgauuugcauggcugguacgaaaagaaggccaggugcagaaaauaacaccaacuaacuucgauggugucguugauaagcacaaaacugcagaaaaguuuauggaaagacucaucggaaaagauguauaccuaccaaacgaaagaguccuaccuaaagccagcuuauuguaucaagaguacugcaucuucaacgaacugaccaagguagcguauauagacucaacaggaaaaaagaacaauuuuucaagcgaagaaaaacucaacauauuugaaaaacuauucaaaacaaaaagagagguaacgaaaacagacuuaugcaaaugccuaaauaacgugugcaaacucaaggaaaaaguaaaagaaacagaaauaauaggaauaaaagccaaauuuaacgccaaauauucaacauaccaugaucuuaaaaaaauaaacggcauggaacaauugauagcggacgaagaaggaaaaccccugugugaggauauuauaucuauuuuaaccaucuuugaggacaaagacaucagauuaguaagacuaaaagaacuccuuugccaaaauaaagacuuaauaaacaaauuuagccuuagugccgaaaaacucgcaaaaguauuaucuaccaagcacuacaaaggauucggcaauguuagcgcaaagcuaauuaacggaauaagagauaaaaacugcaaaacaauucuugacuaccuaauagaggacgauaaagaggcauauuacggaagaaauaauccuaaccgaaauuugaugcaacugguaaaugauucacgccuagcguuuaaaggacagauagauagagagcaaaauacacauuuagaggaccuuucccuagaugaauuccuugaugauuuauauguuucuccaucgauuagaagagggauuagacuaacaauaagacuaguagaugaacuaguagaaaucaugggcuaccucccaaaaaauauagugauagaaaugccuagagaagauggggaaaaaggaaaaauugcagacaccagauauaguaaauuagaaaagauguuaaaaaaagaugcagcacuagaagaucuauauagaguauuaaaaacauaugagaaaaauaaaaaagcacuggcuaacgacgccuuauaucuauauuucuuacaaaauggaagagauauguauacuggaaaagaaauuaaucuaucagaauuacauucauaugauauagaucacauuaucccaaaguccuucaaauacgacgauucccuugacaacaagguacugacagcaaaaaaaaugaacauggacaaaagaacaggagccuuagaucacaauauaaucgagaaccaguguggguuuuggagaguauuacuacaacaggauaaaauaucauuagagaaauauacaaaccuaaugaaaacagaauucacagaagcagacaaagcaggauucauaaugagacaacuaguagaaacaaggcagauaacaaaguuuguagcaagguaucuagacaacaaauuuaauggacugaucagcgauccuaaugauaaagugaacauauugcuuccacgugccagucuuugucaccaauuuagagaaacauucggauuuuacaaaguccgagaauuaaacgauaugcaucacgcucacgaugcuuacuugaacgccguuaucgcaaacacacuuaacaaaaacgcguaccuaucggaccuccuaaaauauggcgcauacucaaaauacaaaaaaaauggcuuuaacaacaguaacggcauaauggauuauuucggcaauacacaauuuaauugccuuuucgugguggaaagaacacucgacaaauguagaguuaauauaguaaaacacccagaaacugcaagcggugaauucuacaaugaaacgauccaaaaaaacaaaguaaacggaggaaguaguacuaggagcuugaaaaguagcguaaaaguccuccaaaacacagaacaauacggaggauuuacaaacgucaauaaugcauauuuuauacucuucgauuauaaagcuaaaucgaaacuaaaaagaaagcucauaggaguaccuauaguagauagacaaaaauucgaacaagauccgguaacauaucuggaagcaaaaggcuuugaugaacccaaacuggugcaaaaacuacuaaaguacacguuacuugaauacgaagauggaaaaagaagauaccuuacagggguaacaggaaaaagaugugaacuaguuagagccaaccaauugcuauuaccacgaaauaugauggcauuauuacaucauuuacaggaguggcaaaaacacgacuuuggaauaaaggaaaugaccaaaguaauaaaaaauacaaacaacauagaagcgaaauuugauaaauuauuugaacauaugaugaaauucaucgacaaguacagugaaccaccuaaaauaguuucaucuaaaauaucggaagaauaccacaaauuaagagaaucauugugccaagacgauaauaaaaucaaaauauaugcagaaauagguaaagcccuauuaagcuuauuacacuuagucgacucuaagucggcaugcguuuucaaauucaguggacuagaaauaaacagaauacgauaucaauccaucaaugaaaaaaaagaaccaguaauaauauuccaaucgcuaagcggacuccgcgagucuagauacaaauacaaucaauga

SEQ ID NO: 5615 - RNA, 4209 nt, Artificial Sequence
  Cas9 variant
augaaauugagaaaugcaaaagacuacagcauaggauuagacguugguacuggcucaacugggugggcaguaacaacuuuagacggggacuuauucacuuucaaccauagacccacauuagguagccgauuauucgaaucagccagcacagcccaagaaacacgagaagcacguggagcucgaaggcguuuaaaaagacgaagauggaggauaucacuacuucaagagcaauucgcagcagaaauggaaucaugcgauuccaacuuuuucaucagacuaaaucaauccagacuauggcaagaagaccggacagagcaaggaaaaggauaccuauucggaggaaaaccuauauuaugcggagcacaaauuuuugcaaaugaacaagaauacuaccaacaauuuccaacaaucuuucaccuaagaaaauuccuagucgagugcuccgaacaaguagaucuaagacugauauacuuagccuuacauaacauagugaaauaccgagggaacuuccuuuaccaagacaacaaaacacuaaacguuaggaauuuuaacuuagauagccaaauugcugacuuuuuggaucaacuacaauuauggugcgaaaauaacgaccuauguuuccaugaaauagauggaacuacaacacuagcaucacaacuaaauaccuguuuccaccaacaaagcaaucaacaaaagaaagacacuuuaaaaacuuucuuugcaacaugcauagagaaugacaaaauugcuggugaacuaaccaaagcauuacuugguuacaaaacagacuucaaaauaaucuuuaauaucgaaggugaaaaagaugaauacaaagcaaaaugcaacgaagaggagaaaauacuaaaacugcaggaaacaauagacgaugccaaucaaguauuacuacaaagcauacuaaaccuauauagcggaaucaucguagaaaagauccuaaauaacacagcaguuaaaaaugaauccgcccaaugcacacuaucagcauaucauugcuacuccuacgcacuauacucaaaacaauuacgaaccuuaaagaaauuaguaagaaaauauaacccacaaagauacaaugaaugcuucaaccuaagugcggaagaccccaaagcaaagaaacaacuauguacauaugcaagauauaaugcccaacauucuaccgacuacgacgaguucaagaaauauaucaaagauuuauuugaaaacaccgacgcuguaaacgaugcagccuaccaacaaaugaaacaagacuuugaugaagagaaauuucucaggagacagaaaacaagugauaacggcguauacccauaucaauuccaccuugaggagaugcaacuaaucauugaaaaccaagcccaacauuaccccuuuuuaaccaaaauuaaacccaaacuagaaucucuaguaacuuucaggauaccauacuacguuggcccacuaacacaaaaaggaauacaacgcaauggcagaaaauucgcauggucuaaacgcaauaaagaugcagaaaaccaaagaauuuauccauggaacugggauucuauuaucgacaaaucagcaagugcagaagcauucauccuaagaaugacugguaaaugcacuuaccuauacggcgaagacguacuuccaaaagaaaguuuacuauaucaagaauuuugcgucuuaaaugaacuaaacggagcaagauggaauugugauggcgaaagaagaaugccgcugucgaacaaagacuguaaagcaauuuauagacaacuauuucuaaagaaacaaaaaguuucauaugccgauguaucaaacuaccucaaagcccaaggacacaucaacaauuccgucgccgguggacaaggagaacacggguucgaaucuacuuuaucaucacaucacuucuucagaaaauuauuuaacgucgacgccgccaacgacuuaacagcccaacaaauagaaacugcugaacaacucauauuguggggaacaauauuugaagauaaagaaauauucgaacagaaaauaaaagaacgauucggagauauguuuuccaaagacgaaauuaaaacaauagcacgcagaaaauuuagcggaugggguaaauguucaaaacaacuacuauccggucucacaguggaaaccccacguggaagagagucaaucauagacguucuucguaacgggcaccccgaaaacggccgaacccucguuuuuaugcaaguaauaacugacaagaaacucgaauuugauaagaaaauagaggaauacaacaacgaacacuuagcgaaaacaaaugaaucuguccucgacacagcaauaaugucaccagcaauaaaaagaggcguaaaucaagcauuacauauaguaggagaaaucagaagaaucaccaaacaugauccaacaugcauuuacauagagaccacuagagacgaaaaagauggaaaacauaacacacguacuucaucacguuauucaucgcugaagaaaaaccucgaaaccuuaaaaucaaucgacaaagcaaacgcuccugcaauaaaacacaguuuagaacuccuagaaacauauaagaaacaaaacauugacgacaaauuauuccuauauuuuacgcaaaaugguaaauguauguacucaggaaaaagucucgacauuaauaaucucucauccuaccaaauugaccacguuaucccccagucauacauaaccgauaauagcuucgacaauagaguacucguauaugcaucugaaaaccaacgaaaaagcgauucauuacuacucucaucaguaauacaggcaaaacaagaaccauucuggacaucauuggaaaaagcaggccuuauauccgaaaagaaacauaacaauuuaaaacgcaaaagucuaucagacgcucaaauaaaaggcuuuauuaacagacagcuaguagaaacgagccaaauuguaaaagugcuuagggacgaacucaguagaauacuaccagauacaaaaauaauaccagucaaagccucacucucacaugacguuagaaucgcuuguaauuuguacaaauccagaacagcaaacucuuuucaccacgcacaugaugcacuauuagcaucuacuaugggaagguucguucaaacacgauuucccgacauguaugaaaacccuguaagauaugugaagauucuaagagcauauauagcccaaucaaaacuccaacauucugcucaaacaagaaauuuugacuccagaucauuuauggcccacuccuucuucugugauuacaguaaugaaaauggagacaccauauggaacuccgcauccgaaauagaaagacuacguagagcauugaguuauaaaaaucuuuaccuaacaagaagaccauucauagacgcaggacaauuuugggaucaaacaauauacaguccacaugacaagaagaaaacaccagacucauuaauaccacuaaagaaaaaucucgacacacaaaaauaugggggcuacucagguaaagacuaugcccacuuuuucauuuacucagucuuaaauaaacaaggagacgucgaauacagguucgauggcgucccacuauacauagcagcgaacaucaaccgugacgauagaggugcacuggcacaauaugcaaaacaacucguagaacacgaaaacguaccgaaugcuaaacgaaaaacuaaagaccuaguguuucaacgaauagaaagggcuugcguucccaaauaccaguuaaucuguauaagccaauguaguggagacucagaccgcucaguaucugacuacuauuauauaacgggcaagaaagaaguuagaaaugcacuucaacucgcauucccaaugcauuuauauggcgcuauuaacgcaauagaagacaagaaagaacuagaugauucagcacuugaagaacugguuguauacauacuacgaaacgcuccccguauagcaccagacguuuuuagaagacuaaaucucacugaaaaacuagcagacugucuggauaucccagaccgcauugaauuacaaaacuccauuuacggauuauucaacuuaauaaacgcagaaucaaauguaguaaaccuacaaauuuuugggggagccaaaacugcugguguaaaauuaauuaaccuaaacagcuuauugaaugaccccgcaaccacaguaaccuucauagaucaaucagucacuggaauguuugaacguaaagaaacgaucggaauaaguuga

SEQ ID NO: 5616 - RNA, 4209 nt, Artificial Sequence
  Cas9 variant
augggcaaacaagaauucaaugacuacuaccuaggcuucgauauaggaacaaauagcguuggcugggcaguaacagaucagcaauacaaacuccugagauucaacaaaaaagacauguggggaucaagauuauucgaggaagccaagacagccaaagaaagacgaguauauagaaacagcagaagaagauuggaccgacgcaaacgaagacuaaaacuauuagaagaauuauucuuagacgaaauuuuaaaaguagacaguaccuucuucaaaaggcuugaagaaucaaacuuauacaaugaagacaaauccaucaaauucaacuacccucucuuuaaugacaaagacuacaccgauaucgacuuuuacaaagaauacaaaacuauauaucaucuucggaaagcauuaguauuugaagaucgaaaauucgauauacgauugcucuucauagcauuacaccacauauuaaaauauagaggccacuucauauucgaaggucaaucauuugaagacauaaagagcuuugacuacauauucacugaaauccaagacuggauuuuagaaaacuucgagaucaauauagauauaaaccuaaaagagaaacuagaagaaaucauacuaagcaacaacaccaaaagcauaaaaaaaauagaauuuaaaaaaauuuucagcgacaauagaauucuagcuauacuaaacauggggguggguugcaaaguagauuuaaaagacgucuuuaacaacgaagaacucaaagaccaaaaaaucuccuuuaccgaaauagacuacgaaaacgaaaaacgagacgaauucuaccaacuauuaggagaaggaauauucaucguagauuuagcaaaaaaaaucuacgauuucaugguucuaaaaaaaauacuaaaaaacucggacuauuucuccgaaucaaagguagcacucuacgaagagcacaaagaagaccuaaaucgccuaaaauauaucuuuaagaaauauuuaaaaucuagugacuauuacaaauucuucagaucaaauucagagaaaaccaauuauccaucuuacauuggucuaaacaaaauuaaaacaaaaagacuaauagaaaauaacaaaugcuccaucagcgauauaaacaaagagcugaaaaacaaguaccugaaagauauccagguagaagcagaagacgaagaauuauuuaauaggauccuacacaaaauaaacgaaaacaaauuccuagaaaaauuaaaaucauccgaaaauaguaccguaccauaccaaguacacgaaauagaacugaaaaaaauauuagacaaucaaagaaaauaucacucuuuucucaacgaaaaaagugacggcaugacccuuugugaaaaaauaauaaaauuauucgaauuuagaauaccuuauuauguaggaccauuaaacacaaacccaaacaugaacaaaaaaaacaaaaacacauggguagugaaaaaggaagaaaacagcaaaagcucaauaacgccauggaauuuugaaaaaaaagucgacgaacagaaaagugcagaagaauucauaaaaaggaugacgaacagauguacauaucuacgaggugaagacguuauaccaaaaaacagucuuuuauacgaagaauuugugcuccugaaugaacuaaauaaaguaacaguagacaacgaauugcuacauccuacacugaaaaacgaaauaauagacgaacuauucaagaccacaguuaaaguuacgaaaaaaaaaauuacagaauuccuuaaaaaaaaacaagcuauaucagauguagaaucaauaacgggaauugacguagaauucaacggaaaauuacaaggauauaacacauuuagaaaaauacuaggugaaaaaauagaaaaccucaacauuaaaaaauucgucgaacgaugcauagaacuaaaaugucuauacggcagcgacaaaaaacucuucaagaacgccguaggcaaacuuuauaaagaauacaacguaacugacgaagaauucacaaaaauuaauaagcugaauuuuaacaaguggggcagguuauccaaagaauuuuuaacaggaauuagauuugaaaagacugacggcaccgaaagguuugaaagcgucauagcagcguuacgauccacgaauuacaauuuaauggaauuauuaucugacaaauucaacuuacaaaguaaaaucgacgagauaaacggugaagacgauuuuucgaacauagacauaaaggaauacgucaaugaacuuuacguuucaccaagcguaaaacgaucuauaauacaaacauauaaaauagcgauggaaaucaaaaaaauaacgggaaaaaacccaaagaagguauucaucgaaauggcgaaagggggaggagaaaaaggaaaaaggacagaacgaagaaaagacaaaauaaaggaacucuacaaaaacaugaaagacucacuaucugacuacugcaacaaccuacaagaucuuagcucacagguugaaaaauaugacgacaauagacuccgacaaaaaaaacuuuuuuuguauuucaugcaaauggguaaaucaauguauacaggcaacgauaucgaccuuucagaacucuucaauaauaacauauaugauauagaccacauauacccacaaucaaaaguuaaagacgacucguucgacaacaucguauuaguagaaaaacaagaaaaucacuccaagagcaacgaacuacuaaaaccugaaauccaaagcaaaaugaacaacuacuggauauuucuacgagaaaauaaguucauuucaaaggaaaaauauaauagacugacaagaaaaaaaaacuucacagacgaagagcucggagacuucguagcgcgucaacuagucacuacacgucagucuacuaaggaaguggcaaaacuauuugaaaagauauucgacgguaccgaaguuguuuacucaaaagccuccuuaguaagugauuuucgggaaagauuugauauaaucaaaguacgugaaguaaaugaugcgcaccacgcacaggacgcauauuuaaauauaguggucggaaacgucuuuaauacuaaguuuacaaaaaauuacuggaaauuuaucaaagaaaacaauagaaaaaacgaagaaaacccaaacaagaaagaaggauauaauuucaagaacaucuacgagagcgauguuuuccgcaaugaggacguugccuggguauucucaaaagaaaacaaagaaauaaacacuauaaaaacaguaaacaaaaugguauacagaaaaacugucaacaucacagagaugcuagucgaagguaaaggacaauuauuuaacuuaacuauaaaagacaggacacagcuaaaaaaaaaaguaggaaacauaguugccaacauucccaaaucacucaaaaaccgaaauacuaaauuaaagagcgacgaacuagccaagaaauauggauacuuugacagccuaaacaauucauacuucguacuuuucaaguacgucgaaaaagaaaaggagaaaauuggcuucgacggaauaacaauaguggauaaagaaaagcuaaaaaaaaauucggacauagaacgcuuuuuagaaaacaaaggcaacaaaaacgccaaacuaauccggaagauauucaaaaaucaaaaagucuuaauagacggcuaucccuaccuccuaaaaucaugcaacaaggauaaagcaaucagauucgacaacuuuaagagcuuauaucuagaugaaaacgaccugaaauucacuagagaugcaauaaaauucgaaaaaaacaacgcagacauagacuugaaaaaacaaaaguacauaaucuccuuccuaaaaaaaaaaaaacaaaacgaaaucaacgagacguaugaagaauguaucgaaagacucaacaacgaauucgacacacucuuccugaaccuaugcgacauacaaaaaagucccauauacaaaaauuauaaauuaccagacuucauauccaagaaaaacgucguagagguaaaagacaaauucgaagucuucaaaaaucuagaauuauacaauaaaaguaaacuaauaaaaaacuuuuuaaacuauuucaaauacgacaauaauaaauuagacuuaauagccauagguauagacagcaaagcaaacuguauucaaaaacacuuuacagaagauuuaauaaaagauuucguaauagucgacgaaagcgucacggguuuauuugccaaaaaagaacgacuagaauga

SEQ ID NO: 5617 - RNA, 4209 nt, Artificial Sequence
  Cas9 variant
augacauaucgaaauuaucauauaggauuagacauaggaacaucaucaguaggauuugcagugcgauaugauaauggugagcuaguccauaagaaaggaucaaaccuaguuggagcacguuuauucaaagaaggugaaacggcugaagaaaggagacuaaacagaggagcaagaagaagauacaaccgcagaaaauggcgccugaaccuacuaaaucagauuuuuaaaccauuaauagaaguaaacgaccccaccuucuucaaacgacucgaacaauccaaucuaguaaauuacgacaaguccgagagcuucagucuacucaauaaucaaagcgaugauaagcugcaucaacaauuuccgacuaucuaucaccuccgagacuaccucaugaaaaguacagaaaaggcugacauucguuuaaucuaccucgcaguccaccauauaguaaaguacagaggaaacuuccuugaugccagcccuguugauagcuucgaagcaaguaaucucaaaguugaugaaauucugacacaaauaaaccuauuacuagacaaccucaccgaugaucuaagacuuaacacucaauauguuacagacauagaacaaacauuacuauccaauaccgaaagcaacaaagauaaggaaaagguaauccaaaaacuucuauuacacaaggaagccaucaagauagauaaagaccgaacugcacaaaucgcaaaacuuguacucggauacaaagcagacauagcaaaacuguuuggcauaaccgaaaaauuacaaacuccaaaacuagaacuaagugcggcuaacagugacgaugcccuuauggaacuuucagcagaacuaaacgaagaccaaauuggaauacuccuccaacuuaagacccuauauucaagaguaagacucaaucaaaucauaccuaguggaacuucccucuccaagagcaugauagaaaaauacgaacuacaccacacacaauuaaagagcuuuaaagaaaauauucuccucaaauugagaagaaacacagcaguacgccgcaauuuagaacuagccuaugcacucuauguaggcaacgcacaaacaaaacaggaaguauucgaaccaaagaaagcgcgcuuuaccuccgaugacuuugcaucacucaaagcaaacgcgaaaucagcaucuucaguaaaagaagcccccaaaaacacaaaaacaaaacuaacaacugacgauuuuuacaacaucuuaacagaauuauuugcaaccuucgaaagcgaacugagugcagacgaagauaugauaaaagagguagaacaaauuaagaaagcaauaaccggagacaauuaccuucccaaacaacgaacagaccaaaacggaaacaucccacaccaauuacaucagauagaacuacgccaaauauuacaaaaccaauuaccacauuauccagaaauggacaaaaucaaugaacaaaaaccaauagagaaauuaguaaccuuucgaguacccuauuacauaggaccacuuauaacuccagaggaccaacaaaaauccagcgcugcaaacuuugccuggaugaaaagaaaagagcagggagcaauaacgccauggaacuuugacgauaaagucgauagaaugcaaucugcuaccaauuuuauuaaacgaaugacugucaaagauacuuaucuaauaaacgaggacguuuuaccagauagaucccuccuauaccaacguuucaaaguuuuaaacgaguuaaaucuaguaaaaguaaauaaccaacucuuguccauaggagaaaaacaagcaauuuaccacgaucuauuugagaaacagaaaacuguuagcaccaagaaacugcaaucauaccuacaaagcgaacaagguuauggagacaacaucgaaauauccggauugucaaacccagacaaauuuaauaacggacuuaccaccuacauagacuuuaagaacauauuuggugauuuaguagaagauacaacaaaacaaaaagaguucgaacaaauuaucgaauggaguacuguauuugaagaucgagccauauucaaagcaaaacuacaagaaguuaacuggcucacagaagaacaaaucaaagccuuaguagcuaaacgauacucaggauggggaagauuaaguuaccgacuacuagcugaauuaguuaaugacaacggagaaagaauuauugacaucuuauggaacaauaaaggaagcaaccucaugagcauaguaucacaagaugaguuccaacaacaaauagccaggaucaacucacacgaaguacaggaauuagggauggagucaguauuagcaaacgcauacacuuccccacaaaauaagaaagcaauaagacaaguaaugaaagucguagacgacauccaguuagccaugaacggacaagcucccacaucaauaaguaucgaauuuaccagaaaaccagaagaaaacagugaaaucucaaaaagcagauaugaaaccaucacaucaauuuaccaaucgcuuucgaaagauauagaaaaagaaguaaaagauaacuuaaacaaaaacaaaucaagccuaaagaaaaaucuuucagauaaauauuaccuauacuuuacgcaacuuggccgagauaucuacacgaaucaaccaauuccauucaaugaaauaccuuauuaugacaucgaccauaucguaccacgguccguggaaaugaaugacucauuaaacaacagggucuuaguagcgaaaagcauaaaccaaauaaagaaaaacaaugcaccuaucgauucaucacuaaaaauuaccagcgaaacucgacaacuauggaagaaauuauuagauucuggcuuaauuacuaaacagaaauauuauaaacuaucaucuucaaucaaaaauacuguauccccuuauguaaaacaaggcuucauuaacagacaauuggucgaaacaucucaaguuaucaagcuaguagcgaacaucuuaggaacaaaauaccaaaaugaugauacggaaauaauagaagucaaagcacaucuaaacucagaaauaagaaaaacuuucgaauuuuacaaauuacgagagcucaacgacuaccaucacggauucgaugcauaccuaaccacguuagucggaggauauuuauauaacagauacccaaaacuacgaucguauuuugucuauggagaucacaaacggcuagauaaagcccaauuaagugaacuaaagaauuuuaauuuccuacaugguuuaacaaauccuaaaucaggaagcgauggauuaauaaccgcgagcggaucacaacaaguaguucuagaccguaaugaaaccauaaaaagacuaaauaaaauauaccgcuauaaauacaugcuaauaaguagggaaguauucacuaaacaaggacaguucuauaacgaaacaaucuaccccgccaagccgaauaccgccaaaaugauaccacucaaagacaauaagccgucagaagucuacggaggauacuccuccucuaacguaucaaaaauagcgcuaauaaaagagaaaaauacagacaacuaucaauuuauaggaaucccaauuaggagcaucgccaaacucaaacaagcaaaagcaaauagcaaaacaguuuaucaaacagaauuaaaccggguuaucaaaagcguacuagccagccaaaagacaaagaaacaaaaagaauuugaaguuauacuagauaauguaaaauacaaccaaguaguaguugaucaaggagaaaaauauuaucuaggauccccuuauuauaagaaaaaugccaaacagcuaguuaucagccccgaaucugucaaaauauuggcagauaaagcaacagcagaucuacccgaacaagaagcgcacaacaaauuaaugacaguuuaccaggaaauagucgacguccucaacaaacauuucgccuuauaugacauuaauaacguucguaagaaauuaaacgacggccuaauaaaauuuucacaacucccuaacuaugacgaaacaucuaaaaaucgauucgauauauccaaaucuauuaaaacaaaauaugcagucauaaugcguauauuaucaggaaucaaaaaccaaacaucagaaguucccgaauuaggcuugaaaucaccuuuaaacaaaaugcaaacuaaaggaggaauaaaaauauccccggaagcaaaaauauacuacucauccccaacuggaauauuuagucacuuuaaacaagucaaaaaucucuga

SEQ ID NO: 5618 - RNA, 4209 nt, Artificial Sequence
  Cas9 variant
auggaacgcauauuaggauuagaucuaggagugucaucaauaggaugggcacucguagaagaagauguuaaaaaucccgaaaauaauaaaaucauaaaacucggcguaagaguuaaccccuuaacaauagacgagaaaaccaauuuugaaaaaggcaaaucaauaaccaccaaugcaggaagaacaagugcacggucagcacgccgaaacuuacaaagauucaaacugcgacgaaagaaacuucucgaaauccuaauacauuacaaaauaauuaaaaaugacgcaguacuggccgaaacuggcaaaaacacgaccuuccaaacccaauacuugcgagcaaaagcagcacgagagaaaauagaacuagaugaacuagcuagaguccuacuacuaauaaacaagaaaagaggcuauaaaagcagcagaaagguacagaacgaugacgacgguaaagcaauagauggacuaucaguugcuaaagaacuauacgaaaagaacuauacgccaggacaauacgcauaugacuuauuaaaaagagguaaaaagcaaauacccgacuucuaccggucggaccuacaaaaugaauuagaucgaauaugggaauuucaaaaacaauaucaccccgacauauuaacagacgaauuuaagaaagaacucgagggaaagggccagagagcaacagcagcaauuuucuuaaacagauauaaaaucuacacagcagauaauaaagguacccgagaggaaaagaagauucaagccuaccaauggcgaguagaagcacuaucacaacccuuagauguaaaggagguugcuuauguuauagcagaaauaaauaauaaccucaauaauaguucuggauaucuaggagccauaagugauagaaguaaaaagcucuacuucaacggacagacaaucggagaauaccuauucgaagaauuaagcgcaaauccucacaccagauuaaagaaucagguauucuauagacaagacuaccaagacgaguucgagaaaauauggaaaauacaaacaaaauuucauccugaauuaacaaaagaauuaaaagaacagguaagggauauuguaauauuuuaucaaagaaaacuaaaaagccaaaaaggccucauuucguucugugaauuugaaucacgagagaucgagaucgaagaaaacgguaaaagaaaaagaaagaaaguaggucucaaaguggcaccaaaaucaagcccacuauuucaagaauuuaaaauauggcaaguacuaaacaauaucgaaauuaaaaacgaggacgaaagaagauaucuugaaccagaagagaaagagcuccuuuuuaaugagcuaaacugcaaaggaaaucugacaucccaaaaauguuuagaauuacucggauuuaaaaguaaagaugcaaagcucaauuucaagguagucgaagguaaccgaacgaaugaaaaauuauacgaugcauucuugaaaauacuagaauuacagggauauaacguauucgaacuauugaaaauaaaagaagauaaagacgaagcaaaacuuucagaguuaaaagcaagugcggacgaaauaaaaggaaugauuaaagagauauucaacgccaaucuaaucaauacaaguauauuagauuucaaugcugaacuagaaggaaaagacuucgaaaaucaagcaucuuaucaauuuuggcauuugauguauagcuaugaaggggacaauucaccauccgguaaugaaaaacuauaugaacuucucgaaaagaaauucggauuuaagaaagaacauuccaaaauccuaucaacaauaguuuucagucaagaauacggcagucuaucaacaaaagcaaugagacguauauaucccuauauaaaagacaacaaauacagcgaggccugucuucuugcgggguacaaucauaguaaacauucccugacaaaagaagaacuagaaaauaggaaacuaaaagaacaauuggaaguacugcccaaaaauucauuacgaaauccaguaguagagaaaauccugaaccaaaugauaaacuuaguuaaugcuaccauaucagaauacgggaagcuagacggcgucagaaucgaacuggcacgagaacucaaaaaguccgcacaagaaagagaagacauggcaaaaagcauuaacgaggcaacacuucuacaucaaaaauacgcuaccauacuaaaacaggaguucggcguugugaauccaagucgcaaugauauuauaagauacaaacucuauauggaacuuacugucaauggauacaaggauuuauacacuaauacuaagauagaaaaagaaaaucuauuuaccgacaaauaugacauagaccacauaauaccgcaauccagauucuuugaugacagcuucaguaauaaaguauuagugccacgucaaucuaaucuugauaaaggaaaucucacagcguaugacuucaugagcaacaaaggaucagaacgagaggaacacuucuuaaauguaauaaaggaauuacuggacaaaggaagcauaaguaaagcgaaauaugaaaaacucaaaaagaaaggauuagaaaucggagaugguuuuauagagcgagacuuaagagacacucaauacauagcuaagaaagcaaaagaaauccuauucgaaauaacuaauucgguaguaacaacaucagguagaauuacagacaaauugcgaaaagacugggacuuaguaaauauaaugaaagaauuaaauuuagacaauuauagacgacucggacuaacagaaauuguaagaaacuccaaaggcgaagaaaaagaacuuauaccagacuggacgaaaaggaacgaccacagacaccaugcuauggacgcguuaacgguugcauuuacaaccagaaaccacauucaauaucugaacuacuuaaacgcacgaaaagacgaaaaacauaaagaacaccaaaauauuuaugcaauagaaaacaucauaacugaaguaauagagaagaaaaaugguaguaaaacaaggcgauuuaaagccccaaugaacucauucagacacgaagcaaaacaacauuuaaaagaaauccuaguaagccauaaaacuaaaaauaaaguagugacaaguaauauaaacaaaaccaaaaagaaaggaggaauccacaagaaaacagaacugacaccaaggggucaguuacacaaagaaacaguauaugguaguaagaaauuuuuacaaaguagggaagaaaaaguaucggcgaaauucgauuaugaaacgauacucaugguggugaaccccauacacagaaacgcucuauuaaauagacucaaagaauaugguaacgaccccaagaaagcguuuuccggcaaaaaugcaauuaauaaaaauccaguauacuuagaugauaguaaaaccgacaucuuauccgaaaaaguuacacuaucuugguacgagaccggcuacacgauaagaaaaucaguuacaccugauaacuucaaagauuacaaaaaccuugagaaaauuaccgauuuaggcauaaagaaaauucuaaaagaacgccuagaccaauucaaagguaacgcaaaagaagcauuuucuaauuuagauaaagaucccauaugguugaacgaagaaaaagggauagcuauaaaaacaguaacuauaacggggguuagcaaugccgaaucacuacacuuuaagaaagaccaucuaggaaaagaaauacuagaugaaaacgguaacaaaauuccaggggacuucguauccacaggaaacaaucaccacuuagcuaucuaccuagaugaagaagaaaaacuagacgacaaaaugguuacuuucuacgaagcaguccuuagagucaaucagggauuaccuguaauugacaaagauuacaacaaggaaaaaggauacaaauucuuaaugaccuugaaacagaacgaaauguucguauuuccuaaugaagauuucgaucccaacgaaaucgaccuacucgaugaacgaaacuuagaaagaauaucuaaacaucuuuuucggguacagaaaauaaguaaagucggauauggcaacucauucguacgagacuucguauuccgucaccauuuggaaacaaccgucgaagaacgaaaagaauuaagaaacaucacguauauacaauuaaaaagccucgagggucuaaggaauaucaucaaagugagacuuaaucauuuaggaaagauaguacaaauaggggaauauuga

SEQ ID NO: 5619 - RNA, 4215 nt, Artificial Sequence
  Cas9 variant
augacgaaaaauauucugggucuggacuuaggaguaucaucaauagggugggcauuaguccaggaagacagcaaaaacccagaaaauaauagaauuguaaaauuagggguacgugucaauccacuuacagucgacgaacagauaaauuuugaaaaaggaaaaccuauaacaacaaaugcuucccgaaccuuagcaagaagcgcuaggcgaaaucuucagcgcuucaaauucagaagggcgaacuuaauagacgugcuuaagaaaugcaauauacuaaaacagggagauuugcuaacagaaauaggcaaaaauucaacauuccaaacccaagaacuccgagcaaaauccgcgaaagaaaaaguagaauuaucagauuucguacgaguccuauuacucaugaacaagaaaagaggauaucgaucaucccggaaagccaaaaaugaagaugaaggucagauaauagacggaaugucaguagcaaagaaacuauacgaagaaaaccuaaccccaggagaauauucauaccaauuauuaauagaaaauaagaaacaacuaccagacuuuuaccggagugaccuucaaagcgaguucgacagaguauggaaauuccaaaaacaauuuaauccugaaauacuaacagaugauuuauacaaagaauuacaaggcaaaaacaaaaaugccacaugggcaguucuuaaagagccuuucucacuugugggaauuaaacaaauaggaacuauacaagagaagaaagcagaaaaauacuuuuggagaucagaggcaguuaaaagacaacuagacuuugaaucccucgcagucguauuccaagaaaucaauaguaaucuaaauaacucaucuggauaccucggggcaauaucggaucgaaguaaagaguuguacuucaauaaccaaacaguuggagaauaccuauuccaacaauuaaaagaaaacagucauaccaaacucaaaaaccaaguauucuaccgacaagauuacuuggacgaauuugagaaaauaugggaaacgcaaaguaaauacuacaaagaauuaacuaaagaacuaaaagaagaaaucagagauauaauaaucuuuuaucagagaaaacuuaaaucacaaaaaggauuaauaucuauuugcgaguucgaaaaucgcgaaauagaaauaaccgaaaacgguaaaaucaaaaagaaaacaguaggcuuaaaaguugccccaaaaaguagcccccuguuucaagaauuuaaaauauggcaaguccugaauaacuuaguauuucaaagcauagaaaguaaagaacucuuuccccuggaccuagacauuaaagaaucaauauucaaugaagucaacaucaaaggaaaucuaucggccaaaaacgucuuggauuuaaugggauacaguggcaaagaauggaaaacaaauuucaaaaacauagagggcaacagaacgaaugagaaccuauacacagcuuuucugaaaauaaucgcaucagaaggaauagaguucccaaaagaauuuaaacuauccauugaugaugacauaaaagucagcaaaauagacauaucaucagagaaaauaaaagaauuuauaaaagaaaauuuccuuaaacugggaauaaauacgucaauacuagacuucaacccagaacucgacggaaaagacuucgaaaaacaagaauccuaucaacuauggcaucuauuauacagcuacgaaggcgacgauucugcuagcgguaauguaaaacuuuaugaacuccuggaaaagaaauuuggcuuuaaaaaggaacacaguaaaauacuugcagacguaggauuuagcccagacuacggaucacuaaguucuaaagcaaugcgcaaaaucuacccauauauaaaagaaaauaaauauucagacgcuugccaccuugcugguuauaaucacaguaaaaauagcuuuacgaaagaucaauuagcaaauagaauauugaaagaacaacuggaaauauuacccaaaaaugcauuacguaaccccguaguagagaaaauacuaaaucagaugauaaauuugguaaaugaaguaauaaaggcuuaugguaaaccagacgaaauuagaauagaacuagcuagagaacuaaagaaaaaugcagaagaaagagcaaacaugacuucagauauaucaaaagccacacugcugcaucagaaauacgcagaaguucuacagaaagaguucgguaucaaggcaccuagucgaaaugacauaauaagauacaaacucuaccuugaacuagagaaaaauuuauucaaagauuuauauaccgacguacaaauaaaacgagaagaauuauucacggauaaauaugauaucgaccacauuauaccccaaucacgauucuuugacgacucuuuuucaaacaaaguauuaguuccacgaggggcaaaccuuaagaaaggcaacuucacugcccucgauuauauggaaauagaagggaaagaaaaacucgaaaaauuccucaauauaauaaaagaauuauuugauaaaggcgccauaaguaaagcaaaauucgaaaaauuacaaaagaaagguucagaaaucggagaaggauuuauagaacgagaucuacgcgauacacaauacauugcgaagaaagcaaaagaaauacuauucggaauaacaaauucagucauaucuacaaguggaagaauaacagacaaacuacgagaagacuggaaucuaguaaacacaaugaaagaauuaaauuuagaaaaauaccgaaaacucggucuaacagaacuaauugugaacucuaaaggcgaagaaaaagaaagaaucauagacuggacaaaacguaaugaucacagacaucacgcgauggacgcucuaaccguagcauuuacaacacacaaccauauccaauaucuaaauuauuuaaaugcuagaaaagaugaaaaacauaaagaacaccaaaauauauuugcaauagaaaauacuauuacagaaauugucgagaagaaaaacggcagcaaagaacgacgguucaaacuuccaaucaaaaacuuuagaacagaagcaaagaaacaacuggaagaggucuuaauaagccauaaagccaaaaauaaggucguaaccaaaaacauaaacaaaaucaagaagaaaggcucgauaauagcaaaaacugagcucacaccacguggacaguuacauaaagaaacaaucuacgguuccucaaaauuucugaaaacuaaagaagagaaaauaucaggcaaauuugaccucgagaugauacaaaaaguacaaaaugaaaaauacagaaacgcgcugcuuaaacgauuacaagaauuuggaggagacaguaagaaagcauucacugguaaaaacgucauaagcaaaaauccaaucuucuuaaaugcagagaaaacagaacagcuucccgaaaccgucacccuagcaugguacgaaacaggauauacuauacgaaaagucguaaacccggauaauuuuaaagauuucaaaaacauugaaaaaguaauagauaaaggcguacgcgauauacuaacugaaagacugaaagaguucaacggaaauuccaaagaggcuuuuuccaaccuagagaaaaauccaauauggcuaaacaaaucaaagggaaucagcauaaaaaccgucacaauaacuggcauaaacaacgccgaagcacuacauuacaagaaagaccaccuaggcaaagaaauacuugaugaaaauggacaacgaauagcaguagauuuuguaucaacaggaaacaaucaccacguagcaaucuacgaagacgacaacgggaaccugcaagaaaaaguaguaaguuucuacgaagcgguagaacgugucaaccagaauuuaccaauuauaaacaaagaauacaacuucgaauuaggauggaaauuuuuguucacaaugaaacaaaacgaaauguuuuuauucccuagcgaugacuucgauccaaaagaaguagaccuauuugacgauaaguaccuuucccuaauaagcaaaaaucucuucagaguacaaaguauaucuauaguccaauacggcaauaguguaauaagagauuucaaguuccggcaccaucuagagacaucugucagcgacgaaaagaaacuucaaggaguaacauaccaacagaucaaaucauuacaaccacuaaaagacauaauuaaaauaagacuuaauaaucucggaaagauaguacaaaucggcgaauauuga

SEQ ID NO: 5620 - RNA, 4215 nt, Artificial Sequence
  Cas9 variant
augaaagggaacauugagaaaaagaaacaagaguucaacgacuacuaccucggcuuugauauaggaaccaacucaguaggaugggcuguaagcgaucuaaguuauaacuuacuacgauuuaauaagaaagacauguggggagccagacucuucgacgaagccaaaacagcuaaagaccgaagaguaaaaagaaacaguagaagaagacuugaaagaagaucuaaaagauuaaaauaccuagaagaaauauucgaaacagaaauaugcaaaauagacaaaaacuucuuuagaagacuagaagaaucaacacuccacaacgaagacaaaacauuugacuucagauucccaauauucaacgacgaaaacuacacugauaaagaauacuauaaagacuucccaacaguguaucaccucaggaaugaacugaucaaaaaugaaaacaagaaauucgacauaagacuuauuuaccuagcaauucacaauauauuaaaauauagaggacauuucauuuucgaaggacaagauuucgacucuguaacagauuucaaagaaguauucucagaacuuucugcguaccuaucagaaaaucuagaagaaaaucuugacauuaacuuaugcgauaauauuaaagacauaauaugcuccaaagaaaauaaaacgaguaaaggaaaaucguucgucucacugauagacaguaaaguaauacaaucaguauuaagauguugcauaggauaccgaguaaaauucaaagacauuuucauaaauuacgaagaaaaagagaaaaacgaaggaauuaaccuaucagaaauagaauacgacgaaaaacgagaugaaaucgcacucagcuuaggugaaaauauacuucuaauagauauuuguaagaaaguguaugacuucaugauauugaacaauauacucaaaggaaauaaauauauaagcgaaagcaaagucaacuuauaugaugaacauaaaugugaucuauguaaccuaaaauauauauuuaagaaauaucuacccaagaaagauuauuucgaauuuuucagaaacgaaaacaaagagaaaaauuauguuucauacauuagcagcucccuuaauaacgguaaaaagaaaaauaccugcacgcaagaagaccuuaacaaagaaauaaaagaauauaucgcaaaaauaaaagaauacgaagaaaaugaugcaguauuagagaaaaucaacuuaaaauuaaaugaaaauaaauuacuuccuaaacuaaaaaccaacgacaauggaguaauacccuaccagauccauaaaauugaacuagagaaaauacuucaaaaucaaaguaaauacuaugacuuccuacuagagaaaauagacggaauaacgaacauagaaagaauugaaaaacucuuuaccuuuaggauucccuacuauauaggaacucucaaaggaaaauuuucaugggcaaaacuaaaagaaaauaagaaaauaacccccuggaacuuugagaaaauaguagacauggaagaaagugccaaagccuucauagaaagaaugucaaaucgaugcucauacuuaaaaacagaaaacguacuaccuaaaaacucauuauuauacuccgaauaugaacugcuaaaugaacucaacaaaguaaaaaucaaaaaugaauuuaucaauguuguacuuaaaaacgaaauaauagacgaacuauucaaaacaacgucuaaagucaccaaaaagaaauucguagauuaccucaaaaccaaacaaauauucguagaaaaagaagauauauccggcuuagacaacgaauuuaaaucuaaacucgauuccuacauaaaauucaagaaagucauaggagacaaaauagacacccuaagagguuauaauuuuguugaaaaaugcauugaauuuaagugcuucuacggugacgacaaaaaguuauucaaaaaugcaauaaauaauacugaauuuaaagacuacgucagugaugaugaacuaaagaaaauaaauaaaaugaaauucaacaaguggggaaggcuaaguaaaagauuacuaacagaaauaugcuucgaaaacguaauagaaagcgaaucauucgaaaacaucauaguagcccuacgcucaacuaauuacaacuucauggaguucaccaguaagaaauucaaccuaagugaaaagguugccgaagaaaaccaagaaaacacauuagaaaaauucaacaucaacgaauacguagaugaacuauacgucucuccaucugucaaaagaucgauaauacaaacguacaaaaucgcaauggaaaucaagaaaauaacaggcaaaaaccccaagaaaauauucauagaaauggcucgaggcggcggcgaaaaggguaagaaaaccgaaaaacgcaaagaaagaauaaaaacccuauacgcuaacaugaaagacaguaacgaagaauuucucaacaacuuagacaauuuaaaacucucaguggacaauuaugaugacaacagacuacgugaaaagaaacuauuccuauauuuuaugcaacuaggaaaaagcauguauacaggcaaaaauauugaccuuaaugaacuguuauucgcaaacacauacgacauagaucauauaauaccacaaucaaaacuaaaagacgacuccuucgauaacauaguacucgucgagaaaacaauaaacaaagauaaagauaaucgagacuacuuagaugaaucgauaagacuacgaaugaacaaauuuuggaacuuucugagagaaaaaggcuucaucaccauugaaaaauacaacagacuaagaagaaacacuuacuucagugaugacgaacuaucuggcuuuaucucacgacaauuaguaacaacuagacaaagcacauuagaagucaagaaacucuucgaguucauauuccaaaacacagacguuguaugcagcaaagcaaaccuaguaucagauuucagagaaaaauaugggauaaucaaaguccgagaucuaaacgaugcacaccacgcacaagaugccuaccuaaauauaguaguugguaauguauucgauacaaaauucacuaaaaauuacuggaaguucauagaagaccgucgaaagguagacaacauaagggagacauacaauuucaagaaaaucuucgauuaugacguuagccgaggugaaaacguagcauggcugaaagacuacagcaucaacacaauaucugaaaugauaaacaagaaaacagccaacauaacacaaaugauuacagaaggaaaaggacaacuuuucgaccuaaccauucuaaagaaauccaaaauagacaagaaauuaacagucauaccaaauacaccaaaaauauuaaaaucaucacuaaaagauucauguaaaauagcagaaaaauauggauauuucucaacucuuaugcccgcauacuucguaguauucaaauacauagauaaaaacaaagaagucuucggcuucgaucgaaucuucauauucgacagagagaaaauaaacaguaaugaagauauugaaaaauaccuggaggauaaagguuacaacucccccaaauucauccggaaaguaaaccucaaacagaaaauuuuauuaaacggauacccauacagaaucgucggauucacugauaacaagcuagaaaucaaaaacucaaaacaauuuuauucugauggagaacaccuuaaauacauaaaacacuuauccgcguucuauaauaauaauaauaacgugaaaaauggcgaauaccgcaucaacuucuuaaagaaaacauccgaaaacgacagaaaugagacgaccgacgaagcaaaagaacgccucaauauagaguucauaaaauuauacgaguacuucugugaacgccuaaacucuaaaaucuacgccaacuauuacaauucaaagaaauacgacgaacucauagaaguguucgacugcuucaaaaacuuaaaccuacucgacaaagcaaaacuccucuuagaguucuuaaaaauauuuaagaaagauacuuacggaaauuuuaaacuucuagaaaaaccagaacuagauaaaaacggcaagcaaaaacuagacaaaaacggcaacuuaaguuucgaagggcucaguauggcauucggaaaauuaaauggcaagaaauuuaaacagcuaguagaaaaggauauacaguucgucgacgagucaguaacaggucuauuugaaaagaaagaaggacuagaaaaauggcaagauggugaacaguga

SEQ ID NO: 5621 - RNA, 4215 nt, Artificial Sequence
  Cas9 variant
auggccaagaaaauucuaggacucgaccucggcguuaguucgauagggugggcaauagucgaagaagaugcagaaaacguuaugaauaauaaaaucguaaaacuaggaguaagaguuaauccuuuaacaguagaugaacaaauuaacuucgaaaaaggaaaaccaauaacaacaaacgcaggaagaacacucguuagaggugcaagaagaaaucuccaaagguucaaauugagaagauuacaccuaauugauauacuacagaaaagaaauauccuaaaacaagcagauuuacuggccgaaaguggcagaaacagcacguuccaaacacaagaaauccgagcuaaaagcgcaaaacaaaaaguagaauugagugaacuagcacgaguacuuuuacuaauuaacaagaaaagaggauauaaaaguaguagaaaagcuaaaaaugaagaugaaggccaaauaguagacggcaugaguguagcaaagaaacuuuaugaagaaaauaccacuccgggagaauauuccuacgaacuacucaaaucaggcaagaaacaacuaagcgauuuuuaccguucagaucuacaagcagaauuugaucgcguauggaauuuccaaaaacaauuuuacccugaaaucuuuucagauaaucuauauaaagaacuccaaggcaaaaacaaaaaugcaacauggaaaauacuagaaauuccauuuagccucguuggcauaaaacaaguaggcacaacccaagagaagaaaauagaaaaauacuucuggaggucagaagcgguaaagaaacaacuagauuuugagagcuuagcgguagucuuucaagaaauaaacucuaaccuaaacaauaguagcggcuaucuaggcgcaauuuccgaccgaucgaaagaauuauacuuuaacaaccaaacuguaggcgaauaucuacacugccaacuaaaagaaaauccccacacaaaacucaaaaaucagguguuuuaucgacaagauuauuuagacgaguucgagaaaaucugggaaauacaaucaaaauaucacaccguccugacuaaagaacucaaagaagaaauaagagauguaauuauauuuuaccaaagaaaacuaaaaucccaaaaagguuuaauaucaauaugcgaauuugaaaaucgggaaaucgaaauaacagaaaacgguaaaaucaaaaagaaagaagucggacucaaaguagcaccaaaaucuucacuacucuuccaagaauuuaaaauauggcaaguucucaacaaccuacaauuccaaaacauagaaaguaaagaaauuuuuccccuagaccuagacuguaaagaaagcauuuuuaacgaaguaaauauaaaagguagaauaagcgcaaaagcaguccuagacguauuaggauacucggggaaagaauggaaaaccaauuuuaaagacauagaaggaaauaauucaaacgaaaaccuauauaacgccuaucuaaaaauaauugcaaacgaaggaauagaauuuccaaaagaguucaaaugcaaucuagaugacgauaucaauguguccaaaauaauuugcagcgcuggaaaaauaauugaguucguaagggaaaaauucuccgagcugggcaucaacaccaguauauuagacuuuaauucagaacuagaaggaacaaauuucgaaaaacagaaaaguuaucaguuauggcacuuguuauauaguuaugauggagaugauucacccagcggcaaucaaaaauuauacgaauuguuggagaagaaauuuggauucaaaaaggaacacuccauaauucuagccgauaucggauucccccaagaauacgggucacuuaguaccaaagcaaugcgaaaaauaauaccccaucuaaaaacaggauuaccauucgccaagaaaucggauaaugauacaauacuuucggcgacugcgauggcgggauacaaucacucaaaaucacugacaacugaagaacuaaccaagcgaguacuuaaagaacaccuugaaauuuuacccaaaaacucucuacguaauccgguaguagagaaaauacuaaaucagaugauuaacguuguaaaugaagucauaaaagaauauggaaaaccggaugaaaucagaauagaacuagcaagagaacucaagaaaaacgcagaagaaagagcaaacaugacaagugaaauaggaaaagccaccauucaacaccaaaaauacagugagauauuacaaaaagaguucggaaucaagaguccaucgagaaaugacaucauaagguacaaguuauaucucgaacuuucgaacaacggauucaaagaccuauauacagauauacaaauaaaaagggaagaacucuucacagacaaauaugauauagaucacauaaucccacaaagucgauuuuucgaugauucauuuaguaauaagguccuaguaccaagaggggcaaacuugaagaaaggaaaccuuacagcguucgauuaucucgaauccgaaggcaaagacacguuagaaaaauucauaaauaccauaacggaguucuaugauaaaggcauuaucacaaaagccaaauaugaaaaacuacagaagaaagguacagaaaucggagacggauuuauagaaagggacuuaagggauacucaauacauugcuaagaaagcgaaagaaauacuauucggcauaacaaacaguguaguuuccacauccggaagaauaacagauaaacucagagaagauuggaaccuagucaacacgaugaaagaaaugaaccucgaaaaauauaggaaacguggacuaacugaaacuguuauaaauagcaagggcgaagaaaaggagaaaauaaucgauuggaguaagagaaaugaucacagacaucacgcuauggaugcccuaacagucgcauucacaacacacaaccacauacaguauuuaaacuauuuaaaugcaaggaaaaaugaagaucacaaacaacacaaaguaauauccaauauagaaaacuuaaucacaaaaguuuuugagaaaaagaauggaucaaaacaacgaagguuuuuagaaccaauacacaauuucagaaucgacgcgaagaaacaucuagaagaaauccuaauaucacauaaagccaaaaacaaagucguaaccaaaaauauaaacaaaaucaaaaagaaagggucuauaauagcaaaaauugaacuaacuccaagaggccagcuccauaaagaaacaaucuauggcagcucaaaauaccuaaagacaaaagaugaaaaauugucaggaaaauucgaucuagaaaccauaaacaaaguccaaaaugaaagauacaagaacgcacuacucgaacgucuaaaaguauuugguuacgauucuaagaaagccuucaccggcaaaaacauccuagcuaaaaacccaauuuucuuaaauaucgaaaagacagaacaacuuccagaaguucuuacuuuagcaugguaugaaacaauauauaccauacggaaaaguauuaacagcgauaauuucaaagacuacaaaaauaucgacaaaguaacagauaaaaaggugcauaacauacucacagacagacuacgagaauuuaacggaaauucaaaagaagcauucagcgaucuagagaaaaauccgaucugguuaaauaaaccaaaaggaauagcaauaaagaccguaacaauaacaggcgucaacaaugucgaagcauuacauuacaagaaagaccacuuuggaaaagaguuccucgaugaaaaagggcauaaaauaccaguugacuuugucuccacuggaaacaaucaccacguagcuauuuacgaagauacggccggaaauuuacaagaacggguacuuuccuuuuaugaagcaguugaacgaguaaaccaaggauuaucgguaauagauaaagaauauaauaguagucuaggauggaaauuuuuauuuacaaugaaacaaaaugaaauguuucuauuucacagcgaagacuucaacccacaagaaauagaccuauaugacgagaaaaaccuaagacucauaagcaagaaccuauuuagaguccaaaaauucacaguaaaagacuacuuuuucagacaucaccuagaaacaaacguggaagauaauucuaaacucaaaggagauaccuggaagcgagaaggccuaaacggaauacgcggcauauugaaaguacgccuaaaccauuuaggaaaaauaguacaaguaggagaguauuga

SEQ ID NO: 5622 - RNA, 4215 nt, Artificial Sequence
  Cas9 variant
augagcaagaaaauauuaggacuggaccucggcacaacaagcauaggaugggcguuuguacgcgaagcagaagauuuucaagaagaaucaucuauagaacguauaggaguaagaguuaacccgcucacuacagacgaacaaauaaauuucgaaaaaggaaaacccauuucaguaaaugcagauagaacgcucaaaagaggagcacgucgcaaccuucaacgauauaaacaaagaagaacaaaccuuauccaacuauuaaaacaauauaaaauaauaaaugaaaauacuauacuagcagaagacgacaaaaauacgacgcacagcacauacgcguuacgggcaaaagcagucagcgagaaaauuagcaaagaagcauucgcuagaguccuguuaaugauaaauaagaaaagaggguacaaaagcaguagaaaagcuaaaaaugaagacgaaggacaagccaucgacggaaugucaguugccaaacgauuauaugaagaagacauaacaccaggacaauuaugccuacaacuacuaaaagaaggcaaaaagaaacugccugacuuuuaucuaagugauuuacaagcggaacucgagaaaauauggaacuuucaaaagaaauuuuacccagaaauucuaacagacgaauuuaagaaagaaauugaagguaaaggacaaagagcuacaucugccaguuucugggcaaaauacaaauucaacacagcggaaaauaaaggcucacgcgaugagaagaaaaugcaagccugggaauggcgaagcaaagccauaaacacacaacuaacaagagaagaaguagcauauguuauaacagaaaucaauaacaauaucaauaauuccucgggguacuuaggagccaucucagaccgaucaaaagaauuauacuucaauaaagaaacuguaggagaauacuuauuccgacaauuacgcuauucaccccacacgagagucaaaaaucagguauucuacagacaagauuacuuagacgaguucgaaacuauaugggaaaaucaaucaagauaucauaaugagcucacaaacgaacucaaaucugaaauacgagacgucgugauauucuaucaaagaaaacuaaaaagucaaaaaggacuuauaucauucugcgaauuugaaucaaaacaaaucgaaauccagaaagacggaaaaauaguaaagaaaauaauaggacuaaaagucucgccgaaaucaagcccccuguuccaagaguucaaaauauggcagauacuacagaauuuagaguucacaaauaaagaaacuaaagagaagaaaguaccagauuucgaagcgaaaaaucuguuauucgaagaauuaaauauaaaaggaaaccuaaaaggcgaaaaagccauagaaauauugggcuacaaaccaaaagaauggcucgucaacuauaaagaauuagauggaaacaggacuaaucaaguacuauacgaagguuacuuaaaaauacucgaagucgaagguuacgacauaaaagacuuauugaaaauaaaauccaacaaagaugaaguuaauuuaucugaacucaguaaaccaguauccgagauaaaagaccuaauuaaaagcauauucgaaucucugaauaucaacacagcaauauuggauuucaaucccgaauuagaagguaaagacuuugaacgacaggcuucauaucaacuauggcacuuacuguacucuuacgaaggugacaauuccaacacuggaaacgacgaguuauaccgcuuauuauaucagaaauucggcuucgggaaagaacacgcacaaauacuugcuaaccuaucauuuucccaagauuauggcucacucucagccaaagcaaugagaaaaauauacccauuuauaaaagaaaauuccuacucagaagcauguucacucgcuggauauaaucacagcagcaguauaacuaaagaggaaaaugacaaacgcgaauuaaaagaaaaauuagaguuacuccccaaaaauucacugagaaaccccguuguagagaaaauucuaaaccaaaugguaaauguaauaaaugcaauuauagccgacccuagcaugggcaggccagaugaaauaagaauagaacuggcccgagaacuaaagaaaaaugcagccgaaagagcagagaugacaauacauaucaacaaagcaaaaagugagcacgauaauuaccggaaaauccuaacgacggaguuuggaauacccaauccaacacgaaaugacauuauacgcuacaaauuguaugaggaauuaaaaguaaauggauauaaaacauuauacagcaauacauauauccccagggaaaaauuauuuucaaaagaauuugauguagaacauaucauaccgaaagcacuucuauuugaugauucauuuaguaauaaaacaauaugcgcaagacaagaaaaccuagacaaaggcaauaaaacagcauuugacuuuauccagucuuucuacgguaaagaaaaauuugaagaguacuuacaacgaauagaaagucuagcuaaaauuaaagaaggagauacauuuguaauaaguaaagcaaaauacaagaaauuauuacuuccagaaauagagauaggcgagggauucauagaacgcgaccuaagaaacucacaauauaucgcuaagaaagcaaaaagcaugcuucuagauauuugcaaaacaguuguuccgacuacugguaguauaacagacagacuucgagaagacuggggauuaauaaauauuaugcaagaacuaaauuuugagaaauacaagaaacuuggacuuauagaaaugguagagaagaaagauggaaguuucaaagaacgaauaacagauuggacaaaacggaacgaucaccgacaucacgcaauggaugcacuaacuguagcuuucaccaaacacaaucauauccaauauuuaaacuacuuaaaugcuaggaaaaacgaaaaccauaaaaugcacgguaacguaauagccauagaacaaaaagaaacugaauuacugguagacaguguaggcaaacguaaacgaaaauucaaauuaccgauaaguaauuuccgugagguagcaaaaaugcaucuagaaaauauccuaguaucauauaaagccaaaaauaaaguugcuaccaaaaauaaaaacagauucaaaaccaaaaacggugaaaaaguaaaaauagaauuaacuccacggggccaguuacacaaagaaacggucuaugguaaaaugaagaaauacgaaacuaaagaagagauaauaggaucaaaauucgacgaggcaaccauacuaaaaguagcaaauuuagagcaaagaaacgcacuccuacaacguuugaaagaaaacaauaaugauccuaagaaagcauuuuccggaaagaacagccuaaaaucuaacccgcuuuacuauggaguagauucaaaaccaauaccagaaagaauaaaaauaguauggcucgaagacgauuacacaauacgaaaagagauuacaccagaucugaaaauagauaaaguuaucgauauuggaauaagacgaauacuagaaaacagacuagcagaauuuaauggaaacgcaaaagaagcguucaguaaccuagagaaaaaccccauaugguuaaacgaagguaaaagaauugccauaaaaagaguuacaauaucaggaguuaaaaacgcagaaacauuacacuauaaaaaggaucaucuuggacaugaaaugcuugacaaacaagggaaaagaauaccugucgacuucguuaguacggguaauaaccaucauguagcgauauacaaagaugauaaaagcgaccuucaagaaaaaguuguauccuuuuaugaagccguagaacgaaucaaccaagaacuacccauaaucgauaaaaguuucaaccaugaccuagguuggcaauuccuauuuaccaugaaacaaaacgaauacuucguguucccucgcgauggauucgacccguacgaaauagauuuacuaaauccagacaauuauaaaauaauaucacccaacuuauucaggguacagaaaauagccacgaaaaacuacguuuucaaucaccaccuagaaacuaaagcagucgacggggaacuacuaaaaacgaagaaagauuuaagcgauauaacauauagguuuauacaaacaccaguaaauuugaaaaauauaauaaagguacggauaaaccauauaggacaaauagugaaaauaggagaauauuga

SEQ ID NO: 5623 - RNA, 4218 nt, Artificial Sequence
  Cas9 variant
augaaaaccauucuaggacuagaccuagggacaaauagcauaggaugggcccuaguuaaagaagcagaaaauagcaacgaaaaaucagaaauaauaaaauuaggugugagaguuaauccacugacuguagacgagaaaacuaacuucgaagccggaagacccuuaagcacaaaugccgaucgaacggccaaaagaucagcacgucguaaccuccaaagauacaaacuacggaggaaaaaucuuauagauuuacuaaucaaaaaucaacuaaucgacaaagauacuccacuaaccgaaauaggcaaaaauacaacacaucaaacacuugaauuaagagccaaagcagcacgagaacgcauagaacuagaagaccuagcacgaguauuucuagcuaucaauaagaaaaggggauaucgauccucuagaaaagucaauaacgaagaagaaggucaagcaguagacggcauggcaguagcuaagaaacuguaugacgaaaauuuaacaccaggacaauacgcauacgaacuauuaucuaaaggcaagaaauaugugccugauuucuacaggagugaucuccaagcugaguucaacgcaauaugggaauaccaaaaacaauuuuaugcagauauucuagacgaugaauuguacaacgcauuaaaaggacaaggacaacaaaauaguagaaaaagauuccuagcaauuaaaggaguauacacugccgaaaauaaaggaaaacgcgaugacguuaaauugagacacuauaaauggagaucugaagcaauaagcaagaaaauuaacauugaagaaguagcauacgucuuaguggaaauaaauaacgauuuaaauaaaucaagcggauaucuaggcgcaaucucugauaggaguaaagaacuuuacuucaacaaagaaaccguaggugaaaacuuauggaaacaaauacagaaaaacccacacacaucucuuaaaaaccaagucuucuaccggcaagauuaucuagaugaauuugaacaaauaugggaaacucaagcacaauuucacccacaauuaacacuagcauuaaaagaacaaauaagagauguuauaauuuucuaccaacgaaaacuaaaaagucaaaaaggacuauuaaguuucugccaauuugaaucaugggaaauagaaagaaaagacgaaaacgggaauguaauauuaaacaaaacaacucaacugccaaaaagacaaaccguuggaagaagaguagcacccaaaagcucaccgcuguuucaagaauuuaaaauuuggcaaaacaucaauaaucuagaagugacuaaaauauccgaaggagcuagcaaaaacaagaaagaaacggaaacauuaucagaugacgaacgaaaacuuuuauucgaagaacucaacuuaagagguaaucuaucucaaaaagaaguacuacaaauuuuggggcuuaaagacaaagaguacaaaacaaacuucagcgaaggucuagaaggaaauagaacaaaugcugcacuauucaacauauaccaacaaauagcugaaaaugaaggcuaugguuucgauuggucaaagaaaucagcacaagaaaucaaagaagaacuuaaagcagucuuuccucaaauagguauacaagcagacauacucgacuuuaaugcuaaucuagacggaaaagaguucgagaaccaagccucauaucaacuauggcacuuacuauacucagcggaagaggacgauaaaaucaacgaggaagaccaaauaauauauggcaauagugcagugagucucaaaaagaaauuaugugaaaaguuuggcuucacaccggaauacgcuaaauggauagcaaauguauccuuacaagaugacuaugguaaucuauccacaaaagcaaugagaaaaauaaucccauacuuaauagacggaaacgauuauucagaggcaugcgcauuagcuggauacaaccacagcaacuccuuaacaaaagaagaaaaugauaaucgagaauuacuagacaaauuggaacuacuacccaaaaauucucuaagaaauccuguugucgagaaaauccuuaaccaaaugguaaauguaguaaaucaagugauugaaacauacggcaagccagacgaagucaggauagaacuggcacgagaauuaaagaaaagcgccgagaaaagagcagaaaugaccaaaucuauaaaugaagcaacuaggagaaacgaagacauaaagaaacuaauaacaaaagauuuuggaauaccaaacccaacgaaaagcgauguagugcgauaucgauuaugggaagaacuagcuccacuagcauacaaagaugucuucacaggcaaacagauaaagaaagaagauuuauucagcagcaaaauugacaucgaacacaucauaccaaaagcauugcuauucgaugacagcuuuucaaauaagacauuaguuuuucgcgaaacaaaccuaaagaaagcugacagaacagcguaugauuuuauugaaucugacuauaaugcaacacuagaugacuauauacaaagaguggaaacacuauacaacaauaccaaaggcacuauaagcaagggaaaaagaaacaaacuauuaauggcccagaaaaaccuuccagacggauucauagaacgugacuuaaggaauagccaauacaucgccaaaaaggcaaaagcaaugcuauaucaaguauucaaagaugucaacguuacaagugggucgauuacagauagacuacgggaagauugggaucuuaucaauguaaugaaggaguugaacuuucccaaguacaaagcauuaggacuuacugaaauugaagaacguuacgauaucgggcaggagaaaacaaaacgcgucgagguaaucacagauuggacgaagagaaaugaccauagacaucaugcaaugaacgcacuaacgguagccuucaccacaucuucccacauccaauacuuaaauuaucuaaaugcuaggaaaaaugaaagccacaaggaacauaaaaacaucaaaggaauagaaaacaaaauaacccacaagcaaaaagauaaaagaaaauuuauaccaccaaugccaaauuucagagaagaagccaagaaacacauagaaaccauucuugugagcaucaaaaacaagaacaaaguuuauacgaagaacauaaacaaaacuaagaagaaaagcggacauaacacaaaagaacaauuaacuccacgaggccaauuacauaaagaaacaguuuacgguaaaucaaagcgcccuaugaguaaaccaacuaagauaaacaaaaauuuuagccuagaacaagcccaauuaauaauaaacguucaagaaaaagaguuaguacuucgacaccuagcucaguuugauaacaauccugcuguugcauuugacacgaagacauuaaagaaaaugccacugcugaaaaauggggaaccacuaaaagagguucuuuguuuugaggaaauuuucacuauaagaaaagauauaacacccgaccugaaaauagagaaagucguagacgagaaaauaaaagcaauuuuagaacaaaggaagaaagauuuuggcggaaaugcaaaagaagcauuuuccgaccuagauaaaaacccaauaugguuaaacaagaagaaagggauaugcaucaaacguguuacuauaacaggcguauccaaugccgaagcacuacaccaucaaaaagaccauuuaggacgagaaauucuagacgauaacgguaaucccauucccgcagacuuuguaucaacggguaacaaucaucacuuggcagucuaucuggauucggaaggcaaacuacaagauaacaucgugucauucuaugaagcgguaguuagaacaucacaggguuuaccaguaguagacaaaggguuaaacaaagaucuaggauggaaguucuuauucagucugaaacaaaacgaaauguucguuuuuccuaacgacgauuuugacaucaacgacuuugacuuauuagaugacaagaaagcagaacucauuucaaaacauuuauacagaguacagaaaauaucuaaaguuucagccggaaacaguuucguccgagauaucguauucagacaucauuuagaaacaacagucaaagaaguaaaagaauuaaaagacauuaguuauauacaacuaaaauccuuagaaggauuaagaaauauuaagaaaguacguauaaaucacauaggcaaaauaguacaaguaggagaauauuga

SEQ ID NO: 5624 - RNA, 4221 nt, Artificial Sequence
  Cas9 variant
auggaaaagaaaauaauuggaauagauuuaggggucacgucuaucgguugggcauauguaauugaggaugaaaacggccauuccagaaucuugagaaucggcacuagaguaaacccauuaacaacagaagaacucaaaaauuuugaacaaggaaaaccgauuacagaaacggcagaaagaacucuaaagagaaguaugagacgaaaccuacaaagauacaaacagagaaggacaaacuuaaucaacguucuccugaaaaacaaacuaauaacugaaacgacugcacucgcggaagacgguaaaggcacaacacaucuaacacacgcacuacgcgccaaagcagcauacgcccaaauuccucuagaagauuucgcacgaguucuauugauguuaaacaagaaaagaggauaucggagcuccagaaaagucaaaacggaggcagauggucaagcuauagacgguauggcaguagcaaagaaacucuacgaagaaaauauaacaccuggacaacuaugcuacacucuacuacuacaggggaagaaaaccuuaccggauuucuauagaucugaucuccaaguagaaauggaaaaaguauggacguuucagaaacaauuucaccaagcaaucuuaaccgacgaauuucguaaauauauagccggaaaaggacaacgagcaaccgccgcauccuuuuggggaaaauauggauuuaauacggcugaguucaaagguagcagagaagaaaagaaacuaaaaagcuaugaauggagaucacaagccauuacaacucccuuaucucaagaagaagucgcagccguaauaacugauauaaauagcaauauagcgaacaguagcggguauuugggcgcaauauccgacaggaguaaagaacucuucuuuaacaaacaaacagucggacaauaucaauacaauuugcugcaacaaaauccucauacaaacuuaucaggucaaguauuuuacagacaagacuauuuagacgaguucgaaacuauaugggaaacacaagcgacuuuccacaccaugcuaacgccuucccuuaaagaagaaaucagagacauaguuauauuuuaccaaagaaaacuaaaaucucaaaagaaacuugucagcauaugugaauuugaaaaacguauuuuagaaccccuucaaggcgacaaaguaguaggcuacaaaguggcucccaaaaguucaccguuauuccaagaguucaaaauuuggcaggcuuuaggacgaauggaaauccaacacaaaguaacaaaagaaagacacuuccuagaucuagaugcaaaacaauuauuauuugaugaacuaaacguaaaaggagaucuuacgaaagaaaacgcuuuaacgauauugggauuuaaaccaaaagaaugggaaugcaaccuacuaaaauuggaagggaacagaaccaaucaagcccuuuacgaggcuuaucucaaaauucucgaacuagaaggcuacgagguuaaagaucuguuaggguuaaaacuugauaaagacgauauaaaauuaucagaacuaccaguagacgcagcagacaucaagaaaaugguacgagaaauauucgaaacucuuaauaucaaaacuagcuuacuagacuuuaaugcuacucuaccagguaaaaguuuugaacaacagcacgccuaccaauuauggcacuuacuauacaguuaugaaggagacaauucaccaagugggaauaagaaacugcaagaucuccuacaggcaaaauuuggcuucacaaaugcacacgggcaaauacuugcaaacguaucauuagaaacugauuaugguucauuaucagcaaaagcaauacgcaaaaucuuuacacauauuaaagaaaaucacuauucggcagcuugcgcauuagccggcuacaaccauucuaguuaccuuuccaaagaagaaaacgagcaaagaauccuaaaagaucgucugacaauuuuacccaaaaacucgcuaagaaauccagucguagagaaaauuuuaaaucaauuaauaaaucuacuuaauaccauauucgaugaccccuaucuaggcaaacccgaugaaaucagaaucgaauuggcacgagaacugaagaaaaacguacaagaaagacaacgacuaaacacagaaauaaccaaaaacaauacagaacaugaaagaauaacaaaaauauuaauuaaagaagauaauaucaaaaacccaacaagaaaugacauaauacgauauaaauuauaccaagaauugaaacauaacggauacaaaacccuauauaguaauaccuacauaccaagagaggaacucuuuggcaaaaacuuugauaucgaacacauaauaccacaauccaucuuauucgacgauuccuucuccaauaaaacauugugcgucagaaaagagaauaucgauaaagcagaccguacugcaauggauuucauaggaccauauuuuggagaagauaaagugcaagaauauauaaaucggguagaaaugcuucaccaaauaaaccucaaaaacccagaagaaggcauugggaaaggaaaauacaagaaacuuuuaaugaaagcaagcgaaauaggacaaggauuuauugagagggaccuaagagauacucaauacauugcgaagaaagcuagacaaauguuauuagaagucacaagaaccgugguggcaaccacagguucaauaacaaaacgauuaagagaggacuggggacuggucaacguaaugcaagagcuaaacauggacaaauaucgacaacaaggcuuaacggaacuuauugaaaagaaagacgguagcacaaaagaacgcauuacagauuggacaaaacgaaacgaucauagacaucaugcuauggaugcacuaacuauagcauuuacgaaacauucacauauacaauauuuaaacaauuugaaugcacgaaaaagugaugacaagaaaggaaaagaaauuuucggaauagaacaaaaagaaacagaaaaagucaaagacgauacuggacaaacccagagaagauuuaaacuccccaugccugacuuucgacaagcagcaaaacaccaccuagaacauuuauuaaucuccuucaaagccaaaaauaaaguauuuaccaaaaacaaaaacaaauauaaaacgaaaaauggagaacaaguuaaacuugaauuaacaccucgaggccagcuacauaaagaaacaauauacggucguauuaagaaauauguaacacacgaagaaaaaguaucaaguaaauuuaacgcacagcucauucaaacaguagcaaacucuaaauacagauacgcgcuguuaaaacgccuugaagaaaauggaaaugacccaaagaaagcauucacaggcaaaaacagucuagacaaaacuccacucuuuguagaugcuacccaacaagagaaaauuccaccagucgucaaacuuguaucuauugagcaaggauauacaauccgaaaagauauaacgccagagaacuuuaaagacgcaaaaaguauagagaaaauaguagauguaggaauaaggaaccuucuacaccauagguuagaaacauauaacggcaacgaaaaagaagcauucuacaaccuagauaaaaaucccauaugggucaaugaaucaaaaggaauaugcauaaaacgaguuacaauaacaggcgugacaaacgcugaaccacuacauuacaaaagagaccaccauggaaaaccgauacucgauaauaauggaaacagaacaccagcggauuuugucucaacaggaaacaaucaucacgccgccauauauagagacgccgcaggaaaucuacaagauaacgucguuucauuuuaugaagcuguggcacgaguaaaucaaggccuccccaucauugauaaauccuuaaacaaagaacuuggauggcaguucuuauucucucugaaacagaacgaauguuuuguuuucccaaaugaaggcuucgacccacuagaaauagaucucuacaauccagcuaauaacaaacuaauagcugcaaacuuauuucgaguacaaaauuucucacgauuacaauacggaaauaauauuaucagggauuacaauuuuagacauauauaugaaacaucuguggaaaaucgaaaagaacuaaaagacaucgcauacaaacaagucaaaucacuuccuaucuucgagaaaauaauaaaaguaagaauaaaccauaucggccaaauagucaaaacgggcgaauacuga

SEQ ID NO: 5625 - RNA, 4224 nt, Artificial Sequence
  Cas9 variant
augauaagaaacauacuaggacuugauuuaggagugucaucuauugguugggcuuaugugcaagaagacaguaaaaauucagaaaacaaucguauaauaaaacuaggaguaagaguuaacccucuaacuguagaugaacaacuuaauuuugaaaaaggcaaaccaaucacaacgaaugcuggaagaacacuugcacgauccgcccgccgaaacuuacaaagauuuaaauuaagaagaucuaaccuaauggacguacuuaagaaaaacaacauauugaaagaaacagauuuacuggcagaaguagguaaaaauucaacuuuccagacacaagaacuacgagcaaaaucugcaaaagagaaaauugaauuaucagaauuugccagaguguuauuauuaaucaauaagaaaagggguuauaaaucaucaaggaaagcuaaaaacgaugaagauggucaaauuguagacggaauggcuguagcuaagaaauuauucgaagaaaacuuaacaccuggcgaauauucauaccaacugcuacaacaaggcaagaaacaacuaccggauuucuacaggagugaucuacaagcagaauuugacaaaauuugggacuuccaaaaacaguucaauccagaaauauuuacaaaugaauuauacgaaaaauuacaaggcaaaaauagaaaugcuacauggaaagaacuagaguucccauucucauuaguuggcauaaaacagacaggaacaaugcaagagaagaaaguagagaaauauuucuggagguccgaagccgugaagaaacaacucgacuucgaaagccuagcaguaguauuucaagaaauuaacagcaauuuaaacaacucaucaggguaucuuggugcaauaagugacagaucaaaagaauuauacuucuauaaccaaacaguaggggaauaccucuuccaacaacuuaaaacaaacccacauacaaaacuuaaaaaccaagucuucuacagacaagacuaucuagacgaguucgagaaaaucugggaaacacaaaguaaauaccacaaagaacuaacaaaagaacuaaaagaagaaauccgagacauaacuauauucuaccaaagaaaacuaaaaucacaaaaaggacuaauuaguaucugcgaguucgagaaucgagagaucgaaaucacagaaaauggaaaaaccaaaaagaaaacaguaggacuaaaaguugcaccaaaauccuccccucuuuuccaagaguucaaaaucuggcagguauuaaacaauuuacaauuccaaaacaucgaaacaaaagaaguguucccaauagauuuagauuuuaaacaaagcauauucgacgaagucaauauaaaaggcaaacuaagcgcuaaagacguacuugacuuaguaggcuacucaggaaaagaguggaaaacaaacuuuaaagaaauagaagggaauuacacgaacgaaaacuuauacacggccuucuuaaaaauaauagcaucuaaagaaauugaauuucccaaagaauuuaaaaucacaauagaugaugaaauaaaaguaucaaaaauaaacgcaagugccgaaauaauuaaauuauucgugcgagaaaaauucuccgaacuagguauagacacgagcauacuagauuuuaauccugaauuagaaggaagugauuuugaaaaacaagccucauaccaguuauggcaucuacuauacucauacgaaggugacgacucaaguucagguaacgaaaaauuauaugaacuacucgaaaauaaauucggauuuaagaaagaaaauucuaaaauuuuagccgaaauaggcuucucacaagacuacgggagcuuaucuagcaaagccaugagaaaaauauacccuuacauaaaagagcauaaauauucagucgcaugcagcuaugcugguuacaaccauucgaaaaauucacucacaaaagaacaacuugaaaaccgaauacucaaagaaagacuggacauucuacccaaaaacucucuaagaaacccggucguagagaaaauccuaaaccaaaugaucaacuuaguaaauugucucauagaugaauauagcgaaaaagauaaagauggacagaucgucaaauauuucaaauuugaugaaauaagaauagaacuagcaagagaacucaaacuuaacgcggaagaaagagcgaccaugaccucagaaauuaacaaagcaaccauacaacaccagaaauacgcugaaguccuccaaagagaauuuggccuuaaagcgcccucgcgaaacgacauaauaagguauaaauuauaucuagaacuagccaacaauggauuuaaagaucucuauacagacgcaaaaauugaaagagaaaacuuauucaccgacaaauacgauaucgaucauauaauaccccaaagcagauuuuucgaugacucuuucucaaacaaaguauuaguaccaagaaaugcaaaucucaagaaagguaacuucaccgccuucgacuaccuagaaauagaaggaaaagaaaaacuagaaaaauuccucaacauaauuaaagaccucuaugauaaaggagcaaucacaaaggcgaaauaugaaaaacuucagaagaaagauuuugaaaucggagacggauuuauagaacgagaccuacgcaauacacaauauauagccaagaaaucuaaagagaucuuauucggaaucacuaacuccguaguaacaaccuccggccguauaaccgauaaacugagagaagauuggaauuuaauaaacacuaugaaagaacuaaaucuagaaaaauacagaaagcucggcuuaacagaaacuguaauaaacucaaaaggugaagaaaaacaaagaauaauugacuggacgaaacgaaacgaucacaggcaucacgcuauggacgcgcuaacaguagcuuucacaacccauaaccauauacaguaucuaaauuaccuaaacgcacgaaaagaugaaaaacacaaagaacaucaaaauaucuuugcaauugagaaucuaauuaccgagauaaucgauaagaaaaacggauccaaagagcgaagauuuaaagagccaguaaagaaccuaagagccgaagcgcguaaacauuuagacgaaauucuaauaagucacaaagucaaaaacaaaguggucaccaaaaauauaaauaagaucaaaaagaaaggcucaguaauagcaaaaacagaacucacccccagaggacaacuccacaaagaaacaauauaugguucaucuaaauuccucaaaacaaaagaagagaaaaucucuggaaaauucgacguugaaacaauucaaaaaguacaaaacgagagguaccggaacgcuuuacucaaaagacuacaagaguucgguggcgauagcaagaaagccuuuacugguaaaaacguaaucaguaagaacccuauauucuuaaauaaugagaaaacggaacaacuuccagaaacaguaacucuggcuugguacgaaaugggauauacaaucagaaaggcaguaaaucccgacaauuuuaaagauuucaaaaacauugagaaaaccauagacaaaggaauaagagacauacuaaccaaacgacugaaagaguuuaacggaaacagcaaagaagcauucucagacuuagacaaaaacccuauaugguugaacaaaucaaaaggaauaaguauaaaggcaguuacaauaacgggcauaaacaaugcagaagcguugcauuauaagaaagaccaccuaggaaaagauuuccucgaugaaaacggaaaaagaauagccgucgauuuuguuucgacagguaacaaucaccacguugcuauauaugaagacgaaaacggaaaucuccaagaaaaaguuguauccuucuacgaagcaguagagaggguaaaccaaaacuugcccauaaucgauaaagaguauaacucagaaucaggcuggaaauuccuuuucaccaugaaacaaaacgaaauguuccucuucccgagugaagacuucaauccuaaggaaauggaucuauucgacgagaaaaacguaaaccuaauuagcaaaaacuuauucagaguucaaaaguuuacaaucaaagacuacuucuuuagacaucauuuagagacaaauguagaggacuccagcccacuuaaaggaauaacguggaaaagagaaggauuaaauggaaucgaaaauauacuaaaaguaagacucaaccauuuaggaaaaaucgugcaaauaggugaauacuga

SEQ ID NO: 5626 - RNA, 4227 nt, Artificial Sequence
  Cas9 variant
augacaaaaaauauuuuaggucuagacgugggcgugaguaguauagggugggcacuaauaaacgaagacaucgaaaauccuaaaaauaauaaaauaaucaaacuaggcgugagagugaauccacuaaccguugacgaacaaauaaauuucgaaaaagguaagccaauaacuacaaaugcugguagaacccucgcaaggggggcacgacggaauuugcaacgcuuuaagcucagaagauuccaucuaauugauauacuacaaaaaaacaauauucuaaaacaagcagaccuccuagccgaagugggaaaaaauucuacauuccaaacacaagaaauaagagcaaaaucagccaaacaaaaagucgaacuaagcgaacuagcaagaauuuuccuacuaauaaacaaaaaaaggggauacaaaucuagccgaaaggcuaaaaacgaagacgaaggacaaauaauagacgguauguucauagcuaagaaacuauacgacgaaaaacuaacccccggugaauacagcuaccaacuguugaaagaaagcaagaaacaguuaccagacuucuauagauccgaucuacaaagugaauuugacaaaauauggaacuuccaaaaacaauucuauccugagaacuucucugacaaccucuacaaagaacuacaagguaaaaauaaaaacgccacauggaaaacacuugaaaucccauuuagucuagugggaauaaaacaaaccgguacucuucaagaaaagaaacuugaaaaauacucuuggcgaagcgacgcgguaaaaaaacaacucgauuacgaaaaacuagccguagucuuccaagagauaaauucaaauaucuauaacagcucaggauacuuaggugcaauaucugaucgcucgaaagaacuuuauuucaauaaucaaacggugggugaauaccucuauaaccaaauaaaagaaaacccacauaccaaauugaaaaaccaaguauuuuacagacaagacuacuuagacgaauucgaaaaaauaugggaaacucaaucaaaauaucacacaacucugaccaaggaauuaaaagaagaaauaagagauauuauaauuuucuaccaaaggaaacuaaaaagucaaaaaggacuuauaagcauuugcgaguucgaaaauagggagaucgaaauaaaggaaaacgguaaaaucaaaaaaaaaaccguuggucucaaaguugcacccaaaucaucgccacuauuccaagaguuuaaaauauggcagauauuaaacaaucuacaauuucagaauauugaaagcaaggagauauuucccauagacuuagacuucaaggaaagcauauuuaacgaaguaaauauuaaaggaagaauaucggcuaaagcaguucuugaccuacuagguuauucgggaaaagaauggaauccgaacuuuaaagacauagaaggaaacaacacaaaugaaaaccucuauaacgcuuaucuaaaaaucauagcagacgaagaauucgagcuaccaaaagaauuuaaauuaaacggcgacgaugaccucuacgucucaaagauagcaugcagcgcaucuaaaauaaaagauuucguaaaagaaaaguucucggaaauaggaaucaauacgucgauacuggacuucaauccagaguuagagggcaaagacuuugaaaaacaagcaucauaucaauucuggcacuuacuauauucuuaugaaggcgaugacucccaaucaggaaacgaaaaauuauacgagcuuuuggaaaaaaaauuuggauuuaagaaagaacacucaaaaauucuaaguaacauaggcuuuccccuagauuaugggaacuugucaacgaaagcaaugcguaaaaucauaccacauuugaaagcaggccuaucguuugcuaaaaaaagcaaagaagauaauauacucucagcaaccgcaauggcaggauauaaccacucaaacaguuacacaaaagaagaucuagcuaaaagaguacuaaaagagaaauuagaaguuuucccgaaaaacucacucagaaaccccgucguagaaaaaauacugaaccaaaugauaaaccuaguaaacgaagcaguugaagaguacgggacaauagacgaagugagaaucgaacuagccagagaacuaaaaaaaaacgccgaagagagagccaauaugacaucagaaauagggaaagccacacuguugcaccaaaaauacgcagagauauuaaaaaaagaauucgacaucccuguaccuagcaggaacgacauaauacgauacaaacuguaucuagagcucgcaaauaacggcuauaaagauuuauauacagacguucaaauaaaaagggaagaacuauuuaccaauaaguacgacauagaucacauaauaccacaaagccgcuuuuucgaugacagcuuuucgaauaaaguccuaguuccaagaggagcaaaccugaaaaaagccaaccaaaccgccuuugacuaucuagagaacgaagacaaacaaaaauuagagaaauuuuuaaacaucauuaaaaaucuauaugauaaaggagaaauaacaaaagcgaaauacgaaaaauuacaaaaaaagggaagugacauaggugaaggcuucauagaaagagaucugagagacacucaauacauagcaaagaaagcuaaagaaauacuguucgguaucacccacaguguaaucucgaccucaggcaaaaucaccgacaaauugagagaagacuggaaccuaguuaauacaaugaaagagcuaaacuuagacaaauauaaaaaacuuggauugacagaaacucuacucaauucgaaaggggaagaaaaagaaagaauuaucgacuggagcaaaagaaacgaccaucggcaucaugcuauggaugcacuaacaguugcuuuuaccacacauaaccacauucaauauuuaaacuaccuuaaugccaggaaagacgaagaccacaaacaacacaagguaauaucuaacauagaaaaccuaaucacuaaaguauucgaaaaaaaaaauggugcaaagcaacgacgauucauugaacccauaaauaacuuuagaguagaugcuaaaaaacaucuagacgaaauauuaauaagucacaaagcaaagaacaaaguuguaacgaagaauauaaauaaaauaaaaaaaaaagguuccguaguggccaaaacugaacucacgcccagaggacaacuacacaaagaaacaauauacggaagcucgaaauuccuaaaaacaaaagaugagaaaauaucaggcaaauucgaucucgaaacaauaaacaaaguucaaaacgaaaaauauaaaaaugcauuauuacaaagacuacgagaauucggugaagacagcaaaaaagcauuuaccggaaaaaacguuauaagcaaaaauccaaucuaucuagacgaggaaaagacccuacaaauaccagaaucuguaacacuagcaugguacgaaaugauauacacuauaaggaaacccguaaaucccgacaacuucaaagauuauaagaacauagauaaagucaccgaugaaaagauccgugccguacuuacagauagauuacgcaaguucaaugggaauucuaaagaagccuucucggaucuagagaaaaacccaauaugguuaaacaaaagcaaaggaaucgcaauaaaaacgguaaccauaacaggcaugucgaauguggaagccuuacauuauaaaaaagaccacuuaggcaaagagauccuugacaaaaaaggagaccguaugccugucgauuucguuaguacaggcaacaaucaccacgcagcaauauacgaagaugcgaaagguaacuuacaagaacgaguaguaucuuuuuaugaagcaguggaaagagucaaccaaggacuuagcguaguaaacaaagacuauaacgcaggccuaggguggaaauuccuguuuacaaugaaacaaaacgaaauguuucuauucccaucagaagacuucaacccaaaggaaaucgaucuauacgacgaaaaaaauuuaaaauuaauugcuaaaaauuuauuuaggguacaaaaauucggugagcuauccaaaagcggauuuugguuccgacaccaucucgagaccucugucgauguaaagaaagaauuacguaauuacuccuauuuggacuuuuauuccaaagauuucaugaaaacuauugucaaaguacgccucaaucacuuaggaaaaauaguacaaguaggcgaauacuga

SEQ ID NO: 5627 - RNA, 4230 nt, Artificial Sequence
  Cas9 variant
augucuaucaucaauuuucaacgaagaggacuaauggaaacacaggcauccaaccaguuaauaagcucacacuugaaaggauaccccauuaaagacuacuucguaggauuagauauaggaacaagcucaguaggaugggcaguuacaaacaaggcuuaugaacucuuaaaauuucguucucauaaaauguggggcucacgacuauucgaugaaggugaaucagcuguagcaagacgcggauuuagaucuaugcgaaggcgccuagaacgaaggaaauuaagacuuaaacuccuagaagaacuguuugcagacgcuauggcacaaguagauccuacauuuuucaugcgauuacgagaaucgaaauaucauuacgaagacaaaaccacaggacauucaagcaaacacauacuauuuauagauaaaaauuauacagaccaagacuacuacaaagccuacccgacaauauaccaucuucgagcagaacuaaugaaagauggcaccgacgacauaagaaaacuauuucuugcaguacaccauaucuuaaaauauaggggcaauuuucucuacgaaggcgcaacauucgauagcaaugcuaguacacuagacgauguuauaaaacaggcguuagaaaacauuaccuucaauuguuucgauuguaauucagcgauaaguucaauuggacaaaucuuaauggaagccggcaaaacaaaaucagacaaagcuaaagcuauagagcacuuaguagauacuuauaucgcaacagacacaguagacacaaguuccaaaacacaaaaagaucaaguaaaagaggauaagaaaagacuaaaagcguuugccaaucucguacucggacuaaacgcaagccuaauagaccuuuuuggauccguagaagaacuagaagaagacuuaaagaaacugcagauaacaggagacaccuacgaugacaaaagggacgaacuagcaaaagcauggagugaugaaauuuauaucauagaugauuguaaaucaguauaugaugcaauaauauuacucucaaucaaagaaccaggcuuaacaauauccgaaucaaaaguaaaagcguuuaacaaacauaaagaugaccuugccauucuuaaaucauuauugaaauccgauagauccauauauaacacaauguucaaagucgacgaaaaaggauuacacaauuacguucacuacaucaaacagggaagaacagaggagacgucauguaaucgagaggacuuuuacaaauauacgaagaaagucguggaaggauuaccugauuccaaagacaaagaauacauauuaucugaaauagaauugcaaacccuacugccauuacagcgaauaaaagacaacggagucauaccauaccaauuacaccucgaagaacucaaaguaauauuagccaaaugugguccaaaauucccguucuuaaaugaaguagcagacggauuuaguguugcggaaaaacucaucaaaaugcuagaauuuagaauaccauauuauguaggaccacucaacacacaucauaacguagauaacggagguuuugcaugggcaguuagaaaagcuagcggccgagugacaccauggaacuucgaugauaaaauugaucgcgaaaagagcgcagcagcuuuuaucaaaaaucugacaaacaaaugcacauaucuccuaggagaggacguccugccaaaaucaucauuguuauauagcgaguucauguuacuaaaugaacucaacaauguuagaaucgacgggaaaccacuagaaaaagcagucaaagaacaucuaauagaagcagucuuuaaacaggaucacaagaaaaugacuaaaaaucgaauagaacaauuuuuaaaagacaacaacuauauaccagaaaaacacaaacccgaaauuacgggacuagacggagaaauuaaaaacgaucuugccaguuauagggauaugguacgcauauuagggaacaacuuugauuuaucaauggcugaagaaaucauaacagauaucaccauauucggagaaagcaagaaaaugcugagagaaacgcuccgaaauaaauuuucgagcagauuagacgacgaagcuauaaagaaacuaucgaaauuaagauauagggauuggggccgauuaagucgaaaacuauuaaaugucauagaaggaugcgacaaagcaggagacggaacaccagaaacaauaauaauauuaaugaggaauuuuucauacaaucuuauggaauuacuuggagauaaauucaguuuuauggagagaauacaagaaauuaacgcaaaauugauagagggacaaaucguaaacccacacgacauuauugaugauuuagcucuaucgccugcaguaaaaagagcugucuggcaagcacuacgcauuguugacgaaauuguacauauuaagaaaacccuacccgcuagaauauuugucgaagucacaagaucaaacaaagcagaaaagaaaaagaaagacucacgccaaaaacgccucucugauuuauacgccgcaaucaagaaagacgacgcacucuuauccggccuuacgaacgaagaguucggaggucuuaaaagcggccucgcgaaauaugaugacgcugcacuucgaagcaagaaacuauaucuauauuacacccaaaugggacgaugcgcguauacaggugaaguaaucgacuuaucacaauuaaauacagauaauuaugauauagaucauauuuaucccagaucauuaacuaaagacgacuccuuugacaaucuaguuuuaugcaaaaggacggccaacgcccagaaaagcgauacauacccaauaucaaaagaaauacaaaaagcucaaaaagcauucuggauauuccuuaaacaacaaggccuaaucagugaaagaaaauaugaacgucuaacccgaauuacaccucugacagcggaugaucucagcgguuucauagcaagacagcuaguagaaacuaaccaaagugucaaagcugcaacuacacuucuucgaaggcuauauccuggaguagauguagucuuugucaaagccgaaaaugucacagauuuuagacacgauaaugacuucauaaaaguaagaucauugaaucaucaccaccacgcuaaagaugcauaccuuaacauagucguaggaaacguauaucacgaacgguuuacaagaaacuuuagggcauucuuuaagaaaaauggagccaacagaacauauaauuuggcaaaaauguucaauuacgacguaaauuguacuaaugcaaaagacggaaaagcaugggacguaaaaacaucuauggacacuguaaagaaaaugauggcaucaaacgauguuaggguaacaaaacgucuauuagaacaaagcggcgcucuagcagaugcaacaguauauaaagcggcagucgcagagaaagcuaaagacggagcauauauaggaaugaaaacaaaaucaucugucuuugcggacguuucaaaauauggcggcaugacaaaaauuaaaaaugccuauucaauaauaguucaauacgcaggaaagaaaggagaaguugucaaagaaauagucccccucccuauuuacuugacaaauagaaauacaacggaucaagaccucauugacuacguugcaaguauaauaccucaagcaaaagauauaagcaucaucuacagaaaacuauguauaaaucaacuggucaaaguaaacggauucuacuacuaucuaggcggaaaaacaaacucaaaauuuugcauagauaacgccauucaaguuauaguaaguaaugaauggauaccauacuuaaaaguacuagaaaaauucaacaauaugcgaaaagauaauaaagauuuaaaagcaaaugucaucagcacuagagcacuagacaauaaacacacaauugaaguuagaaucguagaggagaaaaacauugaguucuuugauuauuuaguuucaaaacuaaaaaugcccauuuaucagaaaaugaaaggaaacaaagcugccgaacuaucagaaaaaggauacggacuauuuaagaaaaugagucucgaagaacaaagcauucacuuaaucgaacuguuaaacuuacuaaccaaucagaaaacgacuuuugaaguaaagccauuaggaaucacagcuucaagaucaacugugggcuccaaaauaucaaaccaagacgaauuuaaaguuauaaaugaaucuauaaccggccuuuauucaaacgaaguaacaaucguauga

SEQ ID NO: 5628 - RNA, 4233 nt, Artificial Sequence
  Cas9 variant
augacuaaaaacauacuaggauuagaccuuggcgucucaucuaucgguugggcuuuaguacaggaaaacucaaaaaaucccgaaaacaauaaaaucguaaaacuaggaguaagaguaaauccauuaacaguagaugaacaaaucaacuuugaaaaaggaaaaccuaucaccaccaacgcuagcagaacacuagcgcgaagugccagacgaaaccuccaacgauuuaaacuaagaagagccaacuuaauagauguuuuaaaaaaaggaaauauacuuaaacaaggagaucuccuuacagaaauaggaaaaaacaguaccuuucaaacacaagaacuacgugcaaaaucugccaaagaaaaagucgaguuaucugacuucgucagaauacucuugcugauaaauaaaaaacgcggauacaaaucaagcagaaaagccaaaaaugaagacgagggacaaaucauagauggaauggcaguagcaaaaaaacucuacgaggaaaacauaacaccaggagaauauaguuauaaacuauuacaagaaggaaggaagcaacuaccagacuuuuauagaagugaccuucaagcagaguucgauaagauauggaauuuucagaaacaauucaacccagagaucuucacuaacgaacuauauaaaagacuacaaggcaaaaacagaaaugcaacauggaaagaguuagaaauacccuuuuaccuuguaggaauuaaacagauaggaacaaugcaggaaaagaaaaucgaaagauauuuuuggagaucugaagcaguaaaaaaacaacucgacuuugaaucccuugcuguuguuuuccaagaaauaaauucaaaucuuaacaauucaagcggauacuuaggagcaauaucagaccgaucaaaagaacuauauuuuaacaaccaaaccguuggcgaauaucuuuauaaccaacucaaaauaaauccacauacaaaguuaaaaaaccaaguauucuauagacaggacuaccucgacgaauucgaaaaaauaugggaaacacaagcuaaauaccauaaaaagcuaacaaaggaauuaaaagaagaaaucagagauauuguaaucuucuaucaaagaaaauuaaaaucacaaaaaggacuaauaaguuucugcgaauuugaaaacagagaaauagaaaucaccguaaacggaaaaaccaagaagaaaacaguaggacucaaagucgugccuaggucauccccacuauuccaagaauucaaaaucuggcaaagauuaaaugaucuugaauucaaaaauguagagacgaaagaaaucuuuccuuuagaauuagaacauaaggaaauucuguucggaaaccuaaauauuaaaggaaaucuuaguucaaaagaauuaauagaacaauuaggauacccaagcaaagaauggaaauguaacuuuaaagaaauagauggaaacaaaacacacgaaaaccucuacaccgcuuucuuaaagauuauagcaaacgaagggaucgaauuuccaaaggaauuuaaauugaguaucgacgaugauauaaagguuucaaaaauagauguauccagugaaaaaauuaaagaauuuaucaaagaaaacuucuuaaaguuagggauuaacacaucaauauuggacuuuaauccagaauuagacgguaaagauuucgagaaacaagaaucauaccaacucuggcacuuauuauauucauaugaaggcgaugacagugcuucagguaacgaaaaacuauacgaacugcuugaaaaaaaauucgguuuuaagcgagaauacagcaaaauacucgcagaugugggauucucucaagauuacggaucgcugagcucuaaagcaaugagaaagauauuuacauauauuaaagaaaacaaauauagugaagcuugccaccuugccgguuacaaucauagcaaaaacucacuuacgaaagaacaacuagccaauagaauccugaaagaacaauuagaaauucugccaaaaaacgcucuaagaaaucccgugguggaaaaaauacuuaaucaaaugauuaacuuaguaaaugaaguaauaaaagaauacggaaaaccugacgaaaucagaauagaauuggcucgagaacucaaaaaaaacgccgaagaaagagcaaacaugacaucagauauaucaaaagccacccuauuacaccaaaaauacgccgagguacuacaaaaagaauuugguaucaaagcaccaaguaggaaugacauuauccgcuacaaacuauaccucgaauuagcaaauaauggcuacaaagaccuauacacaaaucaaaaaaucgaaaaagaaaauauauuuacagacaaguaugauauagaccauauuauuccacaaaguagauucuuugacgauucauuuaguaauaagguacuagugccaagaugcgccaaccaagacaaggauaacuacacagcaguagacuacauagagaaaaaauacggcgaaagaggaaaggaagacuuccugaaccgaauacaccuaguuuuuaagucaaaagaagcaaucgccgguaaaagugaaagucagaucucuucuaugaauaccaaauuucugaaauuacaaaaaaaagggucagaaauaggagaaggauuuauagaacgagaccuaagagacacacaguacauagccaaaaaagcaaaagagauauuguucggcauuacaaacaguguaaucuccacaaguggacgcauaacugacaaacuaagggaagacuggaaccuugucaacacuaugaaagaacugaaccuagaaaaauacagaaaauuaggacucacugaacuaaucgcuaacucaaaaggugaagaaaaggaaagaauaauagacuggacaaagagaaacgaccaccgucaccacgcaauggaugccuuaaccguugcauucacuacucacaaccacauccaauaccuaaacuacuuaaaugcaagaaaagacgaaaagcacaaagaacaucacaacauauucgccaucgaaaauauaauaacagaaauuguagaaaagaagaacggaagcaaagaaagacgcuuuaaacugccaauaaaaaacuuuagaacagaagcaaaaaaacagcuugaggaaguacucaucagucauaaagcuaaaaacaaaguaguuacuaaaaacauuaacaaaacaaagaagaaaggcggagugguaucaaaaaucguacugacgccgcgaggacaauuacauaaagaaaccauauauggcucagcaaaauucuugaaaacuaaggaagaaaaaaucagugguaaauucgaucuagaaaccauaaacaaaguacaaaacgaaaaauuuaaaaaugcacuacuagauagacucaaagaauuuaacggagauagcaaaaaagcuuucacaggaaagaauguaccagcuaaaaaucccauauauuuaaaugaacaaaaaacagaacaagugcccgaaagcgugguacucgcaugguaugaaacaggcuacacaauccgcaaagcaguaaaugcugacaauuucaaagauuauaaaaacuuagaaaaaauuauagauaaaggaguaaaagaaauauuaaaaaauagacuaaacgccuuuaacggaaaugcaaaagaagcauucucagauuuagaaaagaaaccaauauggcucaaucaaucgaagggcauugcaguaaaaaccguaacuaucaccggaauaaauaaugcugaaacccugcacuauaaaaaagaucacuuugguaacgaauuacuagacgaaaaugguaaaaaaauaccaguagacuucguaucuacggguaacaaccaccacguagccauauacgaagacgcagacggaaaucuccaggaacgagucguuucuuucuacgaagccguugaaagaguaaaucaggggcuaagcaucauagauaaagaauacaaucaggaucuugguuggaaauuucuauuuacgaugaaacaaaaugaaauguucuuauuccccucagaagacuucaauccaaaggaaacagaccuauuugacgaaaaaaaccuaaauuugauuucuaaaaacauguuccgcguucaaaaguuuggaagccuacuaucgggcuuuugguuuagacaucaccucgagacaacaguugacuuaaacaguucauuaaaagacacaagcuacaaaguuauccaaucauguaacaaccuaaaauuaauaguaaaaguaaggcucaaucacuugggaaaaauaguccaaauaggagaguauuga

SEQ ID NO: 5629 - RNA, 4236 nt, Artificial Sequence
  Cas9 variant
augguaaaaaaagaauacuucauaggauuagacaugggaacaucaagugucgggugggcaguugcagacacaaacuacaaucuucucagagccaaaggaaaagacaugugggggguaagacuauuucccgaagcuagcaccgcagcugaccgacgaagccauagaacagcccgucgaaauaauaagcgaaaagccgcccgugaaggauuccuacgcgaaauauucgaagacgaaauaaauaaaauugacccaggauuuuucgaacgucuaaaagagagcaaauauuaccuagaagauaaacucacugauacccccuucguacuuuucgccgacaaaggauauaccgacaaagaauauuacgaugaauauccaacagucuuccaccuaauaaaagaacuaauuucagaaaagggccuagaaccccacgauauacgacuuguguauuuagcaugccuaaauauauauaaacauagaggucacuuucuaaaugauacccuguccggggacgguauagauaacaucaauaguuuauguaaugauuucacaucauacuuagccgacuauaaucaaaacuccgaagacgauggcacugaaaaaauggacuuggacucaacgguacuagcaggagucuucgaagaaacacugugcaacaaacauuuaaguaauucagccaaaaaacgagacuuaauugacaaacugggaauuacuaacaaaacuaaguaucuaacagaaaugauggcucucaucuccggacuagcaucuucaguaaguaauauguuugcaaaggauacuuaugacgaagaacaaaaaaaauuuaaacuuucauucaggucaagcaaucuagaugaagacaugguaaaaguacaagcaauguuaacaccugaagaauaugaaaugauauguauaaugaagaaaauacacgacuggucugucgucucuguaaucaugggaucacacaaauacauuagugacgccagaguugaacucuacgaaaaacacaaacaggaccucgcaaaauuaaaggcgauauacaaagaguaccuaccagacaaauacgaugcgauguuuagagagaugacagacaauaguuauagcgcauauguaggaaaagucucuagcaacaaaaaaucacaaacaggaaaucacaaaguacgaaugcaaagaagaggagcuaaaugcaaacaagaagacuuuuaugauagaauaaagaaagaaauaaauucaguuccccaagaagaaaaaauagauauauuacaagauauggaaacaaacucuuuucugccgaaacaacuaacuaacgaaaacgguguaauaccauaccaacuacauuuagcugaauuaaaaaaaauacuugauaaugcuuccacauauuuaccauuucuaaauuccgcagacgaaacggggauaaguaauaaagauaagauaauucagcuauuugaguucagaauacccuacuauguaggaccauuguuuaaauccgaaaaaaauaaaacaaaugcauggguaguaagaaaagagagcggaaaagucuauccauggaacuucaaugaaaaaaucgacgaaaaacagagugcagaaauauuuauagaaagaaugguaagacauugcacauaccuaaacaaugaaagcgccuuaccaaaaaacucauuaaaguaugaaagauuccgaguucuaaaugaacuaaauaacuuaagaauuaacggagaaaggauaaguccugaacuaaaacaacgaauauauaacgaacuauucaaagucaagaaaaaacgaaucacaaaaucaaugcuaugcgaguaccuauacaaaaacgguauagccgacaaagauucugaacuaagcggcuucgauggaacuuuugcuaaugcucuacuaaguuauggaaaauuccgagaacuauucaacguggauacacugacagauaaacaagaagcggcagcggaagauauaauaaaauggucaacggucuauggagauucaaaaaaguuucugcaggaaaaaauagaggaaaauuauggaccagaaucagaaaauccucucuuagauaauaaacaaauaaaaagaguaaugggauacaaauuuacagacuggggaaaucuaucgcgagaauuucuaaaucuagaaggagcagacaaagauaaugacacaacuacaggagaaguaaugccacuaauuacaagaaugugggaagaaaauuacaauuuaauggagcuuauguccaauaaauuuagcuauagagaugcguuagcagagaaaacggaagaaauagaaaaaacacugacagauauagaauacgaagaccucgaagauuuauauauaagugcucccgucaaaagaaugacauggcaaacuuuauuaaucuuaaaagaaauauaccaaauaaugggauacgcaccaaagaaaaucuucguagaaauggcgcgcgaagaggaagaaaaagugaacggaaaaggagccagaaaaaguucaagaaaaaaacgacuagaggauuuauaucgaaauugcaaagaugcgucuaaagagcuuucuacgggaauaaagaaugcugacgaagcaauucuccguagaaaaaaacuauaucuauauuaccuucaaaaagggaaauguauguacucuggaaaaacaauagacuuuaagagcuuauucacaaacaacuacgauauagaccacauauacccacaaagcguaguaaaagaugacagcuuagaaaacaauaugguacuagucgaaagaaacuacaauaacaaaaaaagcgacaccuuuccaaucuucuccgacuggcaaaacaaaaugaaaccuuuuuggacaauguuaaaggaacaaggguucaucaaugaagaaaaguacaaacggcuuacaagaacagacgaacuaacagaugaugaacuagcuaacuucguaaacagacaauuaguagaaacaagacaagcaacuaaaguaauugcggaacugcuaaaaaauucauuugaugauauagauagcaagauaguguacgccaaagcgggaaacgucucggaauucagacacaaauuuaguaugaaauaugauaaagaaacagaaaagagcucaguuauucacccagaacuagugaaaugccgaaucauaaaugacuuccaccacgcaaaugauaguuaucuaaacauaguggugggcaauauauacgauguaaaauucacacaaaaccccuacaacuacaucaaagaauauaaaaagcagaagaacaauucagcacuaagcgaacaagaaaaagaaaaguaccacauggacaaaauauucaacuuugacguuaaaagaaauggugaaguagccuggauaucaaggggcgacaauaaaacuuuagaaaccguauuaaaaguaaugagaaaaaacacaccaauagugacuagaaugaacuuugaagaacauggacaacuagcugaccuaaccauauauucagcaucagaugcccuaucaaaaaaaggugucggauacauaaaagugaaagcaagugacgccagguuagacguauuaaaauacgggggauacaaaaaauacaaaggagcauacuuuuuuuuagucgaacacacagaaaaaaacaaaagaguacguacaaucgaaaacaugccacuauacuuaaaaaaugaauugaacaccaaagaaaaaaucgaacuuuggugugcagauaaagaaaauggccuuggauugguggauccagacguucgacuaggaaaaauuaaacuauacucuaaaauaagaauagauggauucgaccuguaccuuacaggccgaacggguaauaacuuacuaacauccaaugccguacagcuuaaaauaggcucaaacaaaccuuccgacaaugacaaacuauuuuggagauacuacauaaacaaacucaguaaguacacagaaaacagugaauucguaagcauacaaaacaacauaaaguuauaugaccuguucguggaaauuaacaacgcgggaguauacuccaaacgucaaaacccgauaggcgauaaacuauuggaaggaagaagcaaauucauaaaucuaacguugucaaaacaaguagagacgcuguugggaauaauacgaauauauagucuugaaaaccaaggagcagaccuuaguaacauaggagggcaagaaaaaaauggaacaaugaaaccacacaaaagaaucucagacaaaaaagaaguuuugcucauaaaccaguccguaacagggcucuaugaaaguaaaauugauuuacugaaaauauga

SEQ ID NO: 5630 - RNA, 4236 nt, Artificial Sequence
  Cas9 variant
augaaaaacauuuuaggguuagacuuaggaacuaacaguauagguugggcacuaauaaaacaaaacgcagaagaaagacaaggaucaauacuuggaaugggaacaaggguuuuaccuaugucacaagacgugcucggagauuuuggcaaaggaaauuccguaucacaaacagcagcacgaacaggguacagaggaauaagaagacugcgagaaagauuccuauuaagaagagaaaggcuacauaggguauuaaauauacuaggauuuuuacccuacuacuaugcugcacaaauagacuucgacaaacgauucggaaaauucaaagcagaaacugaaccgaaacugcccuacaacaaugaaggauuuaucuucaaaaacucauuugaagaaauguuaagugauuucaaaauaagucaacccgaauuacuuuccggaaauaagaaaguaccguaugacuggacaaucuauuaccugcguaagaaagcaguaucacagaaaauagaaaaagaagaacuugcauggauccucuuaaauuuuaaucagaaaagaggcuacuaccaauugagaggagaagacuucgacgaagaaaaagacaaaacauuuguaacccuaaauguugacaaaguuauagacucaggcgaaaaaguaaaaggaaacauacuuuuugauauauacuuuacaaauggguggaaauacgaaaaacaaacaacaaaacccgaagauuggcuagguagaucaaaagaauuuaucauuaccgaaucguuacucaaaaauggcgaaguaagaagaacauuuaaagcgguagauuccgaaaaagauuggauagcgaucaaagcgaaaacagaacaagaaauugaaacggcacauaaaacaguagggucauacauauaugaugcaaucuuacaaaacccaaaacagaaaauuaaaggaaaauugguaagaacgauagaaagaaaauucuacaaagaagaauuaagaaaaauacuagaaaaacaaaaagauuuccauuuagaacuacaaaacgaggaccuauacuccgauugcgucagagaacuauaucguaauaaugacacccaccaacucucccuagccaagaaaucguucauucacuuauucuuggaagacauaauauuuuaccaaaggccauuaaaaucccagaaaagcucuguaagcaauuguacauuagaaugucgaaaauacagagacaaaaacggggcagaggguauccaauuccucaagguaauuccaaaaucaaaccccuauuaccaagaauuuagaaucuggcaauggaugucaaaccuuaagaucuacagaagggacgaugaugucaauauaacaagcgagugcuuaaaaacagcagaagauuacgaggaccuauuuguauuccuuaauauaagaaaagaggucgaccaaaaggcgugucuaagacauuuuaaacuaucugagaaaacacacagauggaauuacgucgaagauaagaaauacccguguaaugaaacuggaacaaugauaagcgaaagacuaaagaaaguuggagauucaccugauaauaucuuuacgagagaaauggaacaacaaauauggcacauuaucuacucaguaaacgacaaaacagaauaugaaaaagcacuaaaauccuucgcaaagaaaaaugaacucgauaaugacuccuucuuugaagcauuucgaaaauuucccccguuugauagugaauacggcagcuuuuccgagaaagcaaucaagaaacuguugccucuaaugagaauaggaaagcacuggaacugggaagcagucgaugagaaaaucaaaaacagaauacagaaaauaaucauuggagaguaugacgagaacauaaaagacaacauaagagagaaaacacuuucucuacagaaagaaagugauuuucaaggucuaccauuauggcuagcacaguauguaguguauggaagacauucagaggcuucaguagcugggaaauggaacucaguugaugauauagaggaguaccuaaaggaauuuaaacaacauucacucagaaauccaauaguagaacaaguaauaauggaaaccguuagaguagucaaagacauauggauaaaauaugguaacggugcggcagacuucuucgacgagauacacaucgaacuaggaagagaaaugaaacuacccgcaaaagaacgaaacaaaaugacccaaaagauaagugagaacgaaaacacgaacuuacgaaucaaagccuuacuagcagaaaugaugaacgauagcgaaguacaaaauguaagaccauauagucccaugcagcaagagauacuaaaaauauacgaagauggugcguuaaacagcgaaauaucaguugacgacgacauacuaaaaaucagcaaaacagcgcaaccaucaccaagcgaccuaaagaaguacaaacuaugguuggaacaaaaauacagaaguccguacacaggcgacauaaucccccuuaacaaacuauucacaacugaauaugaaauugaacauaucauaccacaaucacgcuauuuugaugacucauuuagcaauaaagugauaugcgaaaguuuggucaacagacuaaaggacaacuauauaggacuaggguuuauaaaacaauuccacggcuacaaaauaucagauaaaaccaaaguauucgaaguagaagaguacgaagacuucgugaaaaagaacuacgcaaacaaccgaagcaaaagaucaaaacuauuauuagaagaaauaccggaagaaaugauagaaagacagcuaaacgauacaagauauauuucaaaguauauuagcggaauacucucaaauauaguaagaaagaaagaaaacgacgaaggcguaaacucaaaagauauuauaccaggaaacggaaaaauaacuucccaacuaaaacaagacuggggacuaaaugacguauggaaugaucucauauuacccagauucgaaagaaugaacgaauuaaccaaauccucauauuuuacuguauggaacgaaaaauaccaaaaauuccuaccgaccguaccuguugaguucaguaaaggauuuagcaagaaacgcauagaccauagacaucaugcacuagacgccuuagugauagccugugcaaccaaagaccauguaaaucuucuaaacaauaaaucagcgaaauccgaaaugaaaagauaugaccucaagagaaaguuaaugaaauuugagaagaaaacuuaucaacacagccagacuggugaacgaauuguuaaagacgugccuguagaguuccucaaaccauggaaugauuucacuguagaagcaaaagaaaaccuugaaaagauaauaguaaguuucaagcagaaccuaagagucauuaacaaggcaaccaaccacuacgaaaaguggaucgaaaaagacaacguuaaaguuaagggcuuaguagaacaacaaggcuuaaacugggcaauacgcaaaccacuacauaaagauacagucucaggaaaaguugacuugcccggaauaaaaguccccaagggaaaaauacucacugccacacguaaaucgauugacacaaguuuugaucuaaaaacgauaaacagcauaaccgacacaggaguucagaagauccugaaaaauuaucuagaguauaaaggaaauucaucagaagaggcguucucaucagaaggaaucgaagauaugaauaacaacaucgaaaaauuuaaugaaggcaaauuacaccaaccaauaacaaaaguacgaauauuugaacuaggaucgaaguucccauuaggccaaauagggaacaagaaacauaaauacgucgagacugcaaaaggaacaaaccucuucuucgccauuuacgaagacgacaaaggaaaacguacauaugaaacaauaccacuaaacgaaguaauagagcgacaaaaacagggacuagcaccaguuacacugaaaucuaaaaaugacuuuuaccuaugcccaaacgaccuaguuuauguugcagcagaaggcgagagugucaacaaaaucgacuucaaauaugcuucacaggaguucauacauaacaucuauaaaguuguaucguuuaguggaucucaaaucuucuuugucaaacaaaacauagcaguauccauuguaaauaaagccgaguucucuacauuaaacaaaauggagagagcaguggauggaaagaugauaaaagauugcuguauuaagcuaaaaauagacagaauuggaaacauaacuaaaucguga

SEQ ID NO: 5631 - RNA, 4239 nt, Artificial Sequence
  Cas9 variant
augaugaccaaaaacauacuaggacucgauuuaggcacaaacagcauuggcugggcauuaauuaaacaaaacgcagaagaaagaaaaggcucgauccuagguaugggaacaagaguucucccaaugucacaagacgccuuaggugacuuuggaaaaggaaauaguguaucucaaacugcagccagaacaggauaccgaggaguaagacgucuuagagaacgauuccuccuucggagagaacgacuucacagaguauugaacauucuaggauuucuaccugauuauuacgccgcccaaauugacuuugacaaacgauuugguaaauucaaagcagaaacagaaccaaaauuacccuauaacaaugaaggcuucauauuuaaaaauuccuucgaagaaauguuaucagauuuuaaaauaagccaacccgaauuacuaagcgaaaauaagaaaauuccauacgauuggacaauauauuaccuaaggaagaaagcuguaucacaaagaaucgaaaaagaagaacucguuuggauccucuuaaacuuuaaucagaaaagaggauacuaccaauuacguggagaagacuuugacgaagaaaaagauaaaacuuuuguaacccugaaugucgauaaagucaucgacucaggagaaaaaguaaaaggaaucguauuauuugauguguacuucacaaauggcuggaaauaugaaaaacaaaucaccaaaccagaagacugguuagguagaucgaaagaauuuauaauaacugaaaguuuacucaaaaauggcgaaguaaaaagaacauucaaagcaguagauucugaaaaagauuggauagcaaucaaagcaaaaacagaacaagaaauagaaauugcacacaaaacagugggcagcuacaucuacgacgccauacuccaaaacccaaaacagaaaaucaaaggcaaacuaauuagaacaauugaacgaaaauuuuacaaagaagaacuaagaaaaauucucgaaaaacaaaaagaauuucaucccgaacuacaaaacgaagaucuauauucagauugcguuagggaacuuuacagaaacaaugaugcacaccaacugagcuuagccaagaaagauuuuauacaucuguuuguagaagacaucauauuuuaccaacgaccucuaaaaagucagaaaaguaguguuucaaacuguacccucgaaugucgaaaauacaaggauaaaaacggagaagaaagaauacaauuucuaaaggugauaccgaaauccaacccauauuaccaagaguucagaauauggcaauggauguccaacuuaaaaauuuacagaagagacgacgacguaaauauaacaucagaguaccuaaaaacuaccgaagacuaucaagacuuauuuguuuuccucaacacccggaaagaaguagaucaaaaagcgugucuaaagcacuucaaauuaaacgagaaaacacaccguuggaacuacguggaagauaaacguuaucccugcaacgaaacaggaacuaugauucuagaaagguucaagaaaguaggagacagcgcugacaacauauucacccgcgaaauggaacagcaaauguggcacaucauauauaguguuaacgauaagacagaauacgaaaaagcucuuaaaaguuuugcaaagaaaaaugacuuagauaacguuagcuuuuucgaagccuucagaaaauuucccccauuugacucugaauaugguucguucucagaaaaagcaauaaagaaacuacuuccacuaauaagaacagguaaauacuggaacugggaagcaguagaugaaaagacuaagaaacgaauacagaaaaugauaaccggagaaugggaugaagacauaaaagacaacauaagagagaaaacuuuaucgcuccaaaaagaaagugauuuccaaggcuuaccacuuugguuagcucaauaugcgguauauggacgacacagcgaagcaucgguagccgguaaauggaacaguguaaaugacauggaagaauaucuuaaagaauuuaaacaacacucacuacgaaacccuaucguugaacaaguuauaacagaaacaauaaggguagucaaagacaucuggauaaaauauggcaacggagcagcagacuucuuuaaugaaauacacauagaacuagguagagaaaugaaacuccccgcaaaagaacgaucaaaaaugacacaaaagauaucugaaaaugaaaauacuaaucuucgaauaaaggcuuuauugguugaaaugaugaacgacucagaaguccauaacguaagaccuuacucaccaaugcaacaagaaauccuaaaaauauacgaagauggagcacuaaauucagagauaaguguggaugacgacauacuaaaaauaaguaaaacugcacagcccagcccaagugaucuaaagaaguauaaacuguggcuggaacaaaaauauagaucacccuauacuggagacaucauuccguuaaacaaauuauuuaccacagaauacgaaauagaacauauaauaccacaaaguagauacuucgacgacaguuucagcaauaaaguaauaugugaauccucuguaaacagacuaaaggacaacuauauuggauuaggauucauaaaacaauuucauggauauaaaaucagcgauaaaacaaaaguauuugaaguagaagaauacgaagauuuugucaagaaaaacuacgcaaguaauugguccaaacgaucaaaacuacuacuugaagaaauucccgaagaaaugaucgaaagacaauugaaugauaccagauauaucagcaaauacauaucaggaauacuaaguaauauuguaaggaagaaagaaaaugacgacggcguuaacucuaaggauauaaucccaggaaacggcaaaauaacaagccaauuaaaacaagauugggguuuaaacgauguauggaacgaucuagucuuacccagguuugaaagaaugaacgagcuuacaaaaaguaacgauuuuacaguauggaacgaaaaauaccaaaaauuccuaccuacaguuccaguagaguucucuaaaggauucuccaagaaaagaauagaucaccgccaccacgcacucgaugcccuagucauagcaugcgccacuagagaucacguaaacuuacugaacaaccaaagcgcacgaucugagaugaaacgcuaugaucucaaaagaaaacuaaugaaauuugagaagaaagccuaccaacauagccaaacuggcgaaagaauaguuaaagauguaccaguagaauuuuuaaaaccaugggacaacuuuaucguagaagcaaaagaaaacuuggaucgcauaauaguaucuuucaaacagaacuuaagggugaucaauaaagcuacaaaccacuaugaaaaauggauugagaaaaacaacguaaaaguaaaggcccuaguggaacagcaaggauuaaacugggcuauaagaaagccccuccauaaggacacugucagcggaaaaguugaccuacccggcaccaaaguuccgaaaggaaaaauccuaacagcgacacgaaaauccauugauaccaguuucgauaugaagacaauaaauucaauaacagacacaggaauacagaaaauccuaaagaacuauuuagaauauaaagguuccuacgaagaugcguucaguccugaagguauagaagacaugaauaaaaacaucgaaaaauucaacgauggaaaacagcaucaaccuauaaucaaaguaagaauauucgaauuagguaguaaauucccucucggacaaauuggaaacaagaaacauaaauaugucgaaacagcuaagggcaccaacuuauucuuugcaauauacgaagacgauaaggguaaacgcacauaugaaacaauacccuuaaacgaaguaaucgagcgacaaaagcaaggccuggcgccuguaacauucaaaagcaaaaacgacuucuauuuaucaccaaaugaccucguauauguagccgcagaaggggaaucaguagacaaccuagacuuccaaagugacucucaagaauacauaaacaacguauauaaaguagucagcuucuccggcucacaaauauucuuuguaaaacaaaaugucgccgucagcauuguuaauaaagccgaguucuccacacugaauaagauggagagagcaauagauggaagaaugauaaaagaaugcuguguaaaacuaaagauugauagaauuggcaauaugaccaaaagcuga

SEQ ID NO: 5632 - RNA, 4245 nt, Artificial Sequence
  Cas9 variant
augaaaaaaauacuuggacuggauuuaggaacaaacucaaucggaugggcguucgucgaggaagccgaaaaugaaucagaaaagucgagcauaauuaaauuaggcguaagaguuaacccccuuacaguagaugaacaacaaaacuuugaaaaaggcaaaagcaucacaacuaacgcugaucguacuuuaaaacgaaguaugagacgaaacuuacaaagguauaaacaaagacgagaaaaucucauagauauccuaaugaaaaacgguuucacaagugacgacacaauauuaagcgaaaauggaaacagaacaacauucgaaaccuacagacuacgcucaaaagcaguagcugaaaaaauaucuuugcaagaguucgcaagaguucuccuaaugauuaauaaaaaaagaggcuacaagucaucacguaaagcuaaaggaacugaagacggcgaauuaaucgacggcauggaaguagcaaaaaaacuguacaauuacaaucugacgcccggccaacucugccuccaguuacuaaacgaaggaaagaaacauuuaccagauuucuacagaucugaucuucaagccgaauucgaccgaauauucgauauccaaaugacuuuuuauacugaauaucuuacauuagaauuaaaagaagaacuaagaggaaaaaagcgugacgcaguaugggcaauaugcgcaaaaauuuucaaagaaaaagguuucgaacuaauuggaacaaaacgacaaggcagcaccgccgaacaaaaacacgaaaacuauucauggcgggcuaagggacuaagugaaaaacuagaacucgaacaacuaguuguaguauugcagcaaaucaacauacaacuuaacaguucaaguggauacuuaggagcaauaucugaucgaucaaaagaauuauuuuuuaacaaacaaacugucggacaauaucaaauggcaguacuugacaaaaacccaaaugcaggccuaagaaauaugguauuuuauagacaagauuaucuagacgaauuuaacgcaauaugggaaaaacaagcucuauuucauccaauacuuacugauacacuaaaagacgaaauccgcgaugucaucauuuuuuaccaacgacgucuuaaaagucaaaaagguuuaauaucauuuugcgagcuugagucaagaaagauagaaguggaaauagcgggccaaaauaagaccaaaaugguaggaucgcgaguaauaccacgaagcagcccacucuuucaagaguuuaaaaucuggcaaucucucaacaauauagagguauuuggcaaaggaaaaaaauccaagaaacaaaaagaacaaacacuauucgaucaaaccgaagacccccuugaauuuggaggaagacgagaauuauacgaagaagaaaaagaacuacuagcauuagaauuguccauaaaaaaagaacugaaaaaagcugacauacuuaaacuauuauucgacaaccccaaagaauuagaccuaaacuucaacgccguccaagguaaccugacacaagcuaccuuguuuaacguauacaaaaaaauaauagaauuaucaggacaugaaauagacguagagaaagauucagcaucaaaaauauuaaaaucaauagaagagauauucaaagcauugaacuauaauaccgaaauacugcacuucgacucggaaaaaagccaagaccaacaagcuauguacauguuauggcaucuuuuauacucguuugagggcgacaacucaaacacuggcaacgaaaaucuaauaaauaaaauuagcaaauuauacgguuuugaaaaagaauacgccaaaauucuugcaaaugucucauuucaggaugauuaugguagucuaagugcaaaagcaauaagcaaaauccuaccuuacuugaaagaaggccauaaaagugacauagccugcgaucuagccgguuacaagcauagcgcauccaguuuaacaagagaagaauuagaaaauaaaacuuauaaagacagguuagaaaucuuaccaaaaaauacacuaaggaauccggucgucgaaaaaauacuaaaucaaaugauaaacguaaucaaccucauaauagauagucgagaauugaaaaaaagugcaaaggagagagaagaauuaaccaagucaauaucagaaacuacaaaacuacaucaacaauacaaagacauauuagccaaagcgccauucaacuuaaccaauacauccagaaacgacauaauccgauacaaacuauacgaggaacucaaagacaauggauauaaaacacucuauucaaauaaauacauaucacccgcugcccucuucucuggagauuucgauauagaacauauaauaccacagaguagacuauuugaugacuccuucuccaacaaaaccuuagaauuacguucaauaaacauagaaaaaggaaauaaaacagcauacgacuucauaaaaggaaaauauggcgaaacuggugaagacaacuguuuggauaaauacuuaaaucgaaucgagacucuauacaagaacggaaucuuaaaaaaaucaaaguauaauaaauuaaaaaugcaagacaaagauauaccggacggcuucauugaaagagacauacgggacacacaauauaucgcaaaauaugcaaagacccuacuaggugaccuaguuaaauucguaguaucaacaagcggauccguaacggaacgauuacgagaagauuggcaguuaguugauguaaugaaagaguuaaacugggaaaaauauaugcaauuaggucucacugaagaauuuacaaaugaagaaggucaucgcauucgcaaaauaaaagacuggacaaaaagaaaugaccaccggcaccacgcgauggaugcgcuaacagucgcauucacaaagaggcaguucauacaauaccucaacaacuuaaacgcccgacgaauaagcgacgaacaaggaauuucuaauagcgaaaaggacgaaaggaauaaugucucaauaaccacaaaugacaugaaauuaaauacucgcgacguacuagguauagaaaaaaaagaauuauacagagacaaucgaggcaaacucagauuuaaagcaccaaugccgcucuuagaauuucgcgaagaagcaaaaagacacuuagaaaauacauugauuucaaucaaagccaaaaacaaaguaacaacuauaaauauaaacacgcugaaaaaggcagguggcguguacaaaaaaacacagcucacgcccagaggccaauugcauaaugaaacaauauacggaagccaaaaacaauacauaguaaaagaggaaaccauuaaugcaaaauucgacguugaaaaaaucgccacaguaacuaaucccguauaucgagaagcacuauuaaaaagauuagaacaaaauaacaacgacccaaaaaaagcauucacgggaagcaaugcucuaacuaaaaaacccaugugguuugacgaacaacaaacagaaaaaguaccagaaaaaguaaaaaccguaucauucgaaacgauauauacaauaagaaaagaaaucagcccugaucuaaaaauagaaaaagucguagacgaaaaaguuagacaaauccugaacaaucgucuuaacgaauacaacgggaaugcuaaacaggcuuuuagcaauuuagacgaaaauccaauauggcucaacaaggaaaaaggaaucacgauaaaaagggugaccauuacuggaaucaacaacgcccaagccuuacaugagaaacuugauaaagauggaaaaccaauuuuagauggggaaggcaaaaaacaaccaguagauuuuguaaauaccggaaauaaucaccauguagcaguauauugcgacgccgacggaaaccuacaagaaaacgugauauccuuuuaugaggcaguuacccgaagaaaccuagggcuacccaucauagauaaagacuacaaaaaagaugacgguuggcaauuuuuauucucaaugaaacaaaaugaauacuucguguuuccuaaugagucuacuggauuuaaccccaacgaaguggauuuacuaaacccugacaacuauagccucauaucaccuaaccucuuccgaguccaaaaauuuacuauaaaagauuacuucuucagacaucacuuagaaacaaaugucgaaucgaacaguacauuaaaaggaaucaccugguuaagaugcggacuuaacaacauagacaauauaauaaaaguacgcauaaaucauauuggacagaucauacacguaggagaauacuga

SEQ ID NO: 5633 - RNA, 4248 nt, Artificial Sequence
  Cas9 variant
auggccaaauuuaacaaaccauauucuaucggucucgacaucggcguaagcucggucggauacgcugucauaacugaagacuacagagucccagcauuccgcuucaagguacuagguaacacagaaaaagagaaaauuaagaaaaacuuaaucggcucaacaaccuuuguaccagcucaaucggcacaaguaacacguguauucagaguaaacagacgcagaauagaucgucgaaaccaucgaauagcauaccuacgcgacauauuccaaaaagaaauugaaaaaguugacaaaaacuuuuacagaagauuagacgagucauuuagaguccuaggcgauaaauccgaagacuuacaaauaaaacaacccuucuuuggugacaaagaauuagaaaccgcauaccauaagaaauauccuacaauauaccaucuccguaaacacuuagcggaugcagacaaaaauaguccaguagcagacauacgugaaguauacauggccuuaucacacauucugaaauacagaggacacuuccuuacacuagacaagauaaauccaaauaauaucaacaugcaaaauagcuggaucaauuucaucgaauccugccaggaaguauucgauuuagaagucagcgaagaaucuaaaacaauugcagcgauuuucaaaaguucggaaaaccgacaagaaaaagucaagcaaauuuuaucguauuuucaacaagaacuacuuaaaaaggacaaaaguauauucaaacaacuucuacaauuacuuuuuggucucaaaaccaaauuuaaagacugcuucgaacuagaagaagaaccagaucuaaacuucuccaaagaaaacuaugaugaaaaccuugaaaacuuacuaggcacucuagaagaagauuuuucagauguguuugcuaaacuaaaaauacuuagagacacaauccuacuauccgacaugcuuacuuauacaggagcuacacacgccagauuuucugccacaaugguggaacgcuacgaagaacaucgcaaagaccuacaacgauucaagagcuucguaaaacaaaaccuaucagaacaagacuaccucgacaucuucggcaggaagacacccaacggguucgacguagacaaagaaacaaaaggauacguaggauauauuucaaauaaaaugguccuaacaaacaaacagaaaacaauacaacaaaacuucuaugacuauaucucaggaaaaauuaccggaauagaaggagcagaauauuucuugaauaaaauaucagauggcacuuuccuccguaaacucagaacuacagacaacggugccauacccaaccaaauacacgccuacgaacuugagaaaaucauugaaagacaagguagagacuaucccuuccuccuggaaaacaaagauaaauuguuaucuauacuaaccuuuaaaauacccuacuauguaggaccucuagcuaaagggaacaauucaagauuugccuggauuaaacgagccacuucacaagacauacuagacgauaacgacgaagauacucguaaugguaaaauacgacccuggaacuaccacaagcucauaaacauggauaaaacacgagacgccuucauuacuaaccuaauagguaacgauaucauauuacuuaacgaaaaaguacuccccaagcgaucucucauauacgaagaagucauguuacaaaacgaacuuacccgaguaaaauauaaagacaaauacggaaaaacacauuucuuugauuccgaacuucgacaggaaauuauaaauaacuuauuuaaaacaaacucuaaaagagucucaagugcaaugcuucugaacuacuuagaaaauuacacuaaccuccaagcaguagaaaucguaagcggaauagaaaaagguaagagcuuaaacaguacguugaaaaccuauaaugaucuuaaaacaaucuuuucagaagaacuccuagauagugagauuuaccaaaaagaacuugaagaaauaguaaagguaauuacaguuuuugaugauaagaaguccaucaaaaauuaucuaaccaaauauuuugggcgauuagaguuuuuaaacgaagaacgaauuaaccaacuauccaaacuccguuauacuggauggggacgcuauucagcaaaacugcugcuagacaucagagaugaagauacuggauuuaauuuaaugcaauuccuuagaaacgaugacgaaaauaggaacuuaagucaacuaauaucugacagcacacuauccuucgauagcgcuauaaaaucaauccaaucaaaaucuaccgucgaagacgacguauuugacgaaauuaagaaauuagcaggcucaccggcaauuaaaagaggcauucuaaauucgauaaaaauuguagaugaacuuguccaaauuaucggauacccaccccaaaauauuguaaucgaaauggcacgugaaaacaugaccacagaagaaggacagaagaaagcuaaaacucgcaaaaccaaacuagaaucagccuuaaagaauauagaaaacuccguuuuagagaacggaaaagugccacauucagaugaacaacuacaaucagaaaaauuauaccuuuauuaccuacagaaugguaaagauauguauuccuuagacaagacagggucaccaacaccccucuaucgcgaucguuuggaccaauaugaaguagaccacauaauaccuuauucauucuuaccuaucgacucuauagacaauaaaguacuaacacacagagaaaauaaucagcgaaaacugaauaauaucccugauaaagaaacagucgcaaauaugaaaccauucugggaaaagcuauauaaugcaaaacuaauaucacaaacaaaauaucaaagacucacgacaucugaacgaacucccgacggcguacuuacagaguccaugaaagcaggauuuauagaaagacaauuagucgaaacaagacaaauaauaaagcauguagcccgaauacuagacaacagauuucuugacacaaaaaucauuacccucaaaucacagcugauaacaaacuucagaaacacuuuccauauugcaaagauaagagagcuaaaugacuaccaccacgcccacgacgcguaccuagcaguagucauaggucagacauuauuaaaagccuaccccaaauuagcaccagaacuuauauacggucaucaugcacauuuuaauagacacgaggaaaacaaagcaaccaucagaaaacauuuauauagcaacauaaugcgcuuuuucaauaaccccaauaguaaaguuuccaaggauaucuggaauugcaauagagaccuaccaauaauaaaagauauuauauacaacucacaagucaacuuugucaaacguaccaugaucaagaaaggcgccuucuacaaacaaaacaucaucccaaacgacucaucugucacuguugauaagagauucccaaucaagaauaaaaaguaccucgauccaaaacuauacgguggcuauuacgaaagaaauuccgcacuaucagucuucauuauuggccaaucauuuaacaagaauaauaaacuaaaaguaguuaaagaguucuacgauauaaacauaauagauuauccucuauucaacacagacccuaugucauuuuucaacgacgacuccgaaaacggcuuucuaacuaaaaauaaccuucaaaguguacaagcauuuuauaaaaucccaaaauacucacuaauucagaaaaacgauggaacacgcaugcuuuucgaaucgacaacaaauuuucauaaagcaacacaauucaaacuaacugaagcucaaaacgaacucuuuuuccauaugaaacgcuuacuuacaaaaacagacuuuauggauuuaaaaucugaagaaucuauuaaagaaucccaagauuucauaaugaaucauaaaaacgaguucgauaacauaguuaauggacuauuuggcuacgccgaaagacaauuaggauccaagagcuuauucacacaagcccacgaagcauacaaacuccgaaaauacccaguguuuucgcuuaacgaagaaacaauacguuauuauuaugacaauuucuugcgacucuuuucacuaaccaaaucagguacgaguaguggauacguaguaggauuauucgaagcaccaaaacuaagaaauguaguauaccgagcaacuaaggaugagucaaaugcaaccuuaauucaucaaucaaucaccgguuuauacgagacuagaauagaccucucaaaacuuggcgaagauuga

SEQ ID NO: 5634 - RNA, 4248 nt, Artificial Sequence
  Cas9 variant
augaacuuaaggaacgucgcaaaggaaggaaucaauuauaacaucggguuagaucucggcacuggaagcguagguugggcagugacagaugaacaaggagaacuauuuaguuucaaaggcaaaaccacuuggggaucaagaauauuuccaacagcggaaacagcagccgauacaagauuaaaaagaggccaaaggagaagauacgcaagaagaagauggagguuagauuuguuacagagcuuguucgaagaagaaauaaaaaaaguagacccagaauuuuuuacuaggcuaagacaaagccaucuccuaaaagaagauaaaacguacgcagcgauauuaaguagcaaaggagcaacgaggccauuauuuccggaaggagaagcagagguugaauauuacaaaaaauacccaaccauauaucacuuaagaaaagcccuaauggaaucuaauaaccaagaagauauaagacuaauauaccuagcauuucauaauauaguaaaagcaagggguaacuuuuugcaccaggauacaccugggcuaacagcaagcaacgcaaauaugggagaugcugucgaaaagcuauguagugcauuagaagacugguguaguagucagaacauagaaugugccaucagaaagaaccaaaaaaguauccaagauuuaauggagggcaaaacaauagaaccauccgaaaguaaugcuuuaaaagagacauuugaugcaucacgaagcaguagaaaagacaaagcaucaguccuggcuggauggauagcaauucaaccuggagaacaauuugaaccaaaacaagcaaaagacgcaucuaaagaaauagcaaaugcagucuuuggauugucagccaacaugaaaaaaguauucguagaacuagaagaagaucaaaaaauauauuuaaauaaugacgaacaagucgaggccuuuuacacggugugcccggaugaagguguggcacuuuuugaggcuuugcaaagcauguacagugccuauguacugauggguauccuaaaaggagcugauggcggaucaauaucuucguguaaaguagcagcuuaugaacaguauaaggaagaucucaaauuacucaagacgcuagucagagaguuugcaccaaagaaauaugacgaauuuuuccgcggcgauauauucgaugcuaaaaaaggauuccguacaagaaacuaugauccagcgacugcaaaaggguauacuaaauacaacagugugagaggagcaaguuaugaugcauuuaaaaaagaaguagagaaauuauuugagggaacagcugcagaagaagauguaagauauacagauaugaugcaaagauuugacgaagggacauucuuaaggcgucuaaaaacaucagauaacggaucaauaccauaccaauuacauuuagaagaaaugguagcaauuauagaaaaucaaaagacauuuuacccauucuuggaggaaaauaaagaaaaauuugagaguuuaguaaccuuucgaauacccuauuauguaggaccacuaacacaaaaaaaugcacgucccgacaaccacgguaacgcucgauuugcauggucgcaacgaaaagaaggacaagagaacgcaagagucuauccuuggaauugggaagaaguaauagauagaaaacagagcgcagccaaauucauggagcgccucacggguaccugcacauacauacuggaagaaccaguucucccuagauacagcuuacucuaugaagaauauugcuuauugaacgaacucaacggugcaagauggagggacaugggaggcgacuggcacagauuugacuacgaaacccgaauggacauaauagaagaccuauucaaaaaaaaaaaaggaaccguuaaguacgcuaccguggcagacugguuagucagggaaaaacauagaucaugcgcugaaguuaaaggcggacaaggggaaacgggcuuugaaucaaaauugaguaguuacguauuuuuuaaagguguauuacauguagacgagaucgaugaagcagacauuccaaugauagaagaacugauaugguggaacacauuauucgaagauaggaguauacucaaagaaagcauugaagacaaauauggggauagguuaaaugaugaacaaauaaaagcaauuuguaaaaaaagauuuacaggcugggguagguugaguaaaaaauuauuaugugguauaaaagcacaaacagauaacggucccuguucaauaauggauguauugagagaaggaaaccccaacaaugaugcacgaagcgcaacuauggucuuuauggaaauaauaagggaugauaaauuugguuuuaccaaacuaaucgaggaagagaacaagaaaagaaucaguagcguagacgauuucgaugucaaugaccucccaggcuccccagccguaaggagaacaguuaaucaagcaaaaagaauaguugacgaaauaguaggaauugcaggcugugcuccucaaaauauauucauugaaguuacaagagacgaagauggacgaaacaaaggucgacgaacuaaaagacgcuaugacgcuauacaagaagcuguaaaggucuuaaagaaggaacaaaaagaguauuuugaugcaaaugucgcagaccucuuaaaaaacacagcuccugcagcccuagaugacgagcgacuagcccuauauuuuaugcaaaacggaaaauguauguacuguggaaaagacuuggacauuaaucaacuagacaaauaucaagucgaucauauucuaccucaaucauauguuaaagaugacucauuugaaaacaaagcauuaguucauagcgaugacaaucagaggaaaucaaacaguaugcuauuggaugauagcauaauaagaaaaaugaagccauauugggaagcauugagaagugccggauuaaucggagaaaaaaaauucaaaaaucugacuagagugaggguaagcgacaaagaauuaggaggauucaucgcacgucaaaugguagaaacaagccaaucuaugaaacuaacuagucugcugcuugaacaagcauauccagaaacucaaguccgaccagugaaagcaggauuuucuucagaccuuaggagaaggcugaaauuaguaaaaugucgagaaauaaacgauuaccaucaugcucaugaugcauacuuggcaugugaaguaggacaauucaucgcgcucaggcauaacaaacucuaugagaacccuauagguuacucacaugcaguuaaagauuuuauagcaaaacgugcaaaauacgcaucagaacacggaaaaccaauggauacauauggaaugccugguucauccucauucgucauuucaaguuucaugaccuccggauucgaugaagaaacaggagaaauuuucaaagaugcaugggacgcaucucuagcagccguucgcauacaucaagcacuuaauagaaaagauugcuacauaucgcgcaugccagaagaaacaagcggcgccuuuugggaugcuacaauauauagcccaaaacaaaccaaaaaaaaacuaucauuaccgcucaaaaaaggacuagacccucaaaaauauggaucuuauaguagagaacaauuugccuacuuuuuugucuacgaagcaaaaaaaauuaagaaaaaagaggaaacgaaagaauacguuuucgccucagucccaguucaaguagccgcauuagucgcagccgacccuaacgcacuaaucgaauucgcaaaagccgaugcagaagaaagaggauuaaaauuugcuaaaauuguaagagaaaaaguuuauaaauaccaacuaauagaagugaaugacgaaagauuuuucguaacaggauuaagaacaguaagaaacggacuccaaauagccuuuagugaacaagacagaaauauuguaagcggaauagucgaaggaaauucaaguaacaauaaucuacuggacauauacgauaaaauaacaaauagauaugcacuauaugcuagccgcuucgguaaauugcuaaacuuaucuggcuacagagagaauuuuauccaggccuccuuagaggaucaagaaagaguugugcuugccuuaauaucauuauucaaugcaagaacaaauaugauagacuuaucagcuaucggaaguaguaaaacugugggaaacaugucaaugacauuugcaaaagaaauggcuauggcggacaaccgauuugcauucauagaccaaagcguaacggggauguuagaaagaaaaacauauuuguga

SEQ ID NO: 5635 - RNA, 4251 nt, Artificial Sequence
  Cas9 variant
augggaucacguauaauaccuaugucgcaagauauuuuaggagaauuuggaaaaggaaauaguguuagccaaaccucagaaagaacagccuacagaucgacgcguagacucagagaaagauuuuuauuaagacgugaacgacugcaucgaguuuuaaacauauuagauuucuuaccaacacauuaugcaucccaaauagacuucaagaaacgacuagguaaauucaaagaaaacaaagaaccaaaaauagcauacgacaacaaaucauuucuguuucuagauagcuucaacgaaaugcucaaagacuucgaacaagaacaaccaaauaugcuaauaaaugaaaaaggagaaaagaaauuaauaccauaugacuggacacuauauuaucuaagaaagaaagcucuacgggagaaaauaucuaaagaagaauuaagcuggaucauacuaaauuucaaucaaaaacgagguuauuaucaacucagaggcgaagaugaagaagaaaaucccucuaaacucguagaauuucauucucucacuguagucgacguggugcccgacgaaccuauaaaaggaaaauuagaaacuugguauuccauaauacuagauaaugguuggguuuacaggagaucuucaaaaacagaauuauacgacuggaaagacaaaauuaaagaguucauuguaacaacagaucuuaauuaugacggaacgguaaaaaccgacaaagaagguaauguuaaacgaucuuucagagcacccucagaaacagauuggacccucaucaaaaagaaaacugaauacgagauagaacaaucuagcaaaacaauaggagaauacauauacaacacacuacuaaaauauccggaacagaaaauaagaggcaaacuaauccgcaccaucgaacgaaaauacuacaaagaagaacuaaaacaaaucuugcucaaacaaacugaauuucauaacgaauuaaaagacgauucccucuauuaugacugucuacgcgaacuauauagaaacaacgaaagccaccaauuauuuuuagaaaagaaaaauuucgcgcaauuguucaucgaagacaucaucuuuuaucaacgaccccucagaagccaaaaaucccugauaucaaacuguccauuagaauuuuauaaauuuaaagacucuguaggcaaugaaaaaguccaacaccugaaagcuauaccuaaaagcaacccuuucuaccaagaguuccgcauauggcaauggauaucaaacuuaucaauauacuccaaacuagaugauucaaauuucacaucgcacuuuuucgauaguacagaugacugggaauccuuauucgaaaugcugaauggaagaaaagaaauugaacaaaaacaauuacuaaaguuccuucuagagaaaaagggauuuaaaggaaaaucauuaaguagugaaauagaaaaauauagauggaauuauguugaagauaagaaauaucccugcaacgaaacaagaucacuaauacaaucccggcuagauaaaguagcgaaccuaccagagagcuucuuaacacgacauguugaacaagaacuauggcauuuaaucuauucaguaaccgacaaaauugaauuugaaaaagcccuagacacauuuaguaagaaauauaaaauagauacgccaacauuuguugacgcguucaagaaaugcccacccuucaaaucagaauacggaucauucagcgaaaaagccaucaagaaauuguuaccuuuaaugagaacaggaaaauauugggaucucgacaacauagauaaagcuacgaaacaaaggauugagaaaaucauaucaggcgaauacgacaaagacauacgagauagaguaagagaaaaagccauuaaucuacucucagaaaccgauuuuaacagacuacaauuaugguuagcucaauacauaguuuacgacaggcacucagaagcuacaucauuagacaaaugggaaaccauagaugauauaguaacauaccuacauaguuucaaacaacacagcuuaagaaacccgauaguagaacaaguaauaacagaaacaaucagaguuguaaaagacauauggagcaauuacggcaacggaagcaaagauuauuucaacgaaauacacgucgaacuaggaagagaaaugaaacuaccagcggaagaacguaaaagaauacaagagaaaaauucacagaaugaagauacaaaccugagaauaaaagcacuguugagcgaaaugcaaaacgaccccaacguagaaaacguacggccguauucacccgugcaacaagaaauacucaaaauauaugaagaggguguucuaaauucaaacauagagauagcagaugacaucuuaaaaauuagcaagacagcucaaccgucuuccucggaucuaaaacguuacaaauuaugguuagaacaaaaguaccaaucacccuauacaggagaaaucauuccauuaaacaaacucuuuacaccagaauaugaaauagaacacaucauuccucaauccagauacuuugacgacucauauaacaauaaggugauaugcgaaagugcagucaacaaauugaaagacaacagcuuaggauaugaauuuauaaaaggauauaauggccaaauuguugaaugcggauuuggcaagaaaguaaaaaucuucaguauugacgaauacgaagacuucguacagaaaaacuaugcgaauaacagaucaaaggcuucaagauuaaugauggcagacauaccugaaaagaugauugaaagacaauugaacgacacaagauauauaucuaaauacauaagcaauauacugucgaauauuguaagaucagaaucgaaugacgacggaguaaauuccaaaaacuuaaucuccguuaaugggaaaaucacaacuguucuaaagaaagauuggggaaugaaugacauuuggaaugacuugauucugccuagauuuauccgaaugaaccaaauaacagacagcgauucauucacaacauggaaugaacgauuucaaaaauucauacccacaguuccgauagaauuaaguaaaaacuucagcgcaaaaagaauugaccauaggcaucacgcaauggaugcauuaguaauagcaugugcaacacgagaucaugugaaucuucucaauaaccuauaugcuaagagcucagcuagauaugaccuaaaccguaaacuaagaauauucgagaaaacaaccuauaaagacaucaaaacaggccaaauaaucgaacgcgaaauuccuaaagccuuuuuaaagccguggcaaaauuuuacaaccgacgccaaagacgcaauugaaucaauaauuguuaguuacaaacagaguuuaagaguaauaaacaaaucaacuaacuacuaucaaaaaugggucgaaaaagacggaauaguaaagaaagagaaaauaaaacaagaaggaaagaacugggcuauaaggaaaccacuccauaaagacacaguaucagggcuaguacaauuaucuuggguaaaaguaccaaaaggaaaaguaaugacagcaacaagaaaaucacuggacaguucuuuugauuuaaaaacaauagccacaaucacagacaccggaauacagaaaauacuaaucaaauaccuugaauccaaaggcaacaauccagaaucagcuuuuucucccgaaggcaucgaagacuucaauaacaauauacauuuauauaacgacggcaagaaacaccgaccuauaacaaaaguaaggcuauacgaaaucgguuccaaauucccauugggugaaaaagggaacaaaaacgcaaaauauguagaggcggcaaaaggcacaaauuuauucuucgcgguguacgccaacaacaaaggagaacgaaguuucgaaacaauaccccuuaaccuaguuauagaccgucucaaacuaggccuaagcgcuguaccugaaacaaacgagaaaggagauaacuuacuauuccaccuaagccccaacgaucucgucuacguaccuucagaagacgaaauggaaaaccuaaaacuaauaaaucuagaacauaucucaaaagaucaacuaaauagaauauauaaaauggugucaucaaccagcaauagaugcuucuuuauuaaaagcgaaauagcucucucgauaguaaacaaaauagaauacucaccgcucaauaaaauggagaaaagcauagaaggaaucaugaucaaagauguuugucuaaaacuacaaguuaauaggauaggaaaccuggaacgauacuuuucuuga

SEQ ID NO: 5636 - RNA, 4257 nt, Artificial Sequence
  Cas9 variant
augaaaguaaaaaacauauugggauuagacauagguguaacaucaauaggauucgcacaugucacagaaaacgaaaaagauaacaaaagccacaucaagcagcucggaguacguauaaacccccuaacagucgaugaacaaaccaauuuugaaaaaggcagaccggcaucaguaaacgcagauagaacauuaaaaagaggagcaagaaaaauguuaucaagauacaaggacagaagaaaaaaccuuauagaaauccucucaaaaaccggauucauaaauagcgaaucaauucuagccgaagacgguaaaaacacaacccacaguacaugggcauuacgagcuaaagcaucaagggaaagaauagaaaaagaugaauuagguagaguccuacuagcgauaaauaaaaaaagagguuauaaaagcagcaggaaagcgaaaaacgaagacgaaggccaagccauagauggcauggcuauagcaaaaagauuauacgaagaaaacuuaacaccaggacaacuaguauaccaguuacuacgugaaggcaaaaaauauauaccggacuuuuauagaagugaucuccaagacgaauuagauaaaguuuggaacuuucaaaaacaauuucaccaagaaauauuaacagauacauuuuacaaagauauacaagguaaaggacaaagagcuacuucagccucauuuuacgggguuuaugguuucaauacugccgaaaacaaaggcucccgcgaagaaaaacgacuacaagcauacgcauggcgaucagacgcccuaacaaaacaacuaacuagggaggaaguagcauucgucauaacugaaauuaauaauaacuuaaacaauaguagcgguuauuuaggggcaauuagugaccgaucaaaagaauuguuuuuuaacaaaaaaacaguaggccaauauuuauaugagcaauuacaacaaaauccucacacaagacugaaaaaccaaguauuuuaccgacaagauuaccuagacgaauucgaaacaauauggaccauucaaucaagauauuacccagaauuaacagacgauuuaaagagagaaauacgugacguuguaaucuuuuaccaaagaaaacuaaaaucacaaaagggccugguuuccuuuugcgaauuagaaucaaaagaaauuaugauagaaaaaaacggaaaagcagcaguaaaaaaaauaggaucgaaggucgcgccgaaaagcagcccguuauuccaggaauucaaaauauggcaaguauugcacaacguagacauaaaaaauaaaaaagacaaaaccaaacgaccacuagaugauucggagaaggaauacuuguucaacgaacuaaauauaaaaggaaaucuaaaagcugcuaaaguaauccaacuauuaacuuugaauaaaaacgaaacagagcuaaauuauacacaauuggaggguaacaggacgcaaaaagcuuuauacgaagcauaccuaaaaauauuagauacagaagguuaugaugucaauaaccuacuaggaaucaaaaguaacaaagacgaaguauuuuuagaugauuuggacguaaacgcacucgaaaucaaaacaaugauaaaacaaauauuuaacgccuuaaauauaaauacagguauccuagacuucgaugcagaacucgacgggaaagcauucgagcagcaagcaucuuaucaccuauggcaccuucucuauucauaugaagaagauggaagcaaaucaggcaaugaacacuuguauaaacuacuggaaaacaaguucggauuuaaacccgaacaugcaagaauauuggccggaauaaccuuaucagaugauuaugguaaucuauccgcaaaagccaugcgaaaaauauacccccagauaaaggaaaacaauuucucaacagcaugugaacuagucggguaccgucacagcaaaaacucucucacaaaagaagaaaaucaagaaaggcccuuaaagaacaaacuagaauuauugaagaaaaacucacugagacagcccguaguagagaaaauccucaaccaaaugauuaaccuagucaaugaauugauagauaaaaauagugaaaaagaugaacaaggaucaauaauagaauauuucagauuugacgaaauuagaaucgaacuugcacgagaacuuaaaaaaaacacagaugaaaggagagauuuagaugcggcuauucgagaaggaaaccuaaggaaugaaaaaauauacaaacuccuccaagcacaguuuggcauuaaaaacccaacuagaaaugacaucauaagauaucgacucuacgaagaauuaaaaaacaacgguuacaaagaucuauauacaaacaguuacauaccucaagaaaaacuguuuggcaaagaaauagacauugaucauauaauuccccagagcaaacuuuucgaugauagcuucucaaacaagacacugacuuacaacacuacaaacaaagacaaaggaaaucaaaccggauucgacuauauagagucaaaauauggaaucgacggaaucgaagcuuauaccgcacgaauagaaaaucuuuuugagaguggaaaaaaaaauaaagaagaaggaguaagcaaagcuaaauaucaaaaacuacucaaaaaagagucggaaauuggcgacggcuucaucgaaagagaucugagggaaucacaauauauagcuaagaaagccaaagaacuauuauuacaaauaacgaggucuguagucgcgacuaguggaaguauuacggcaagauuacgagaagacugggacuuaguaaacguaaugaaagaacuaaaucuaccaaaguaccgagcacucggacuuacugaaauggaagaacguaaauacgggcaaaaaguagaaguuauuaaagauuggacaaaaagagaugaccaucgacaucaugcaauggaugcgcuaaccauugccuucacaaaacauaaccauauacaauaccuaaaucaccuuaaugcgcgaaaagaugaacaacacaaagaacacaaaauuauaaaugcuaucgaaaacaaggaaaccauauuaaucacagauaagucaggaaaccgaaagcgaguauuuaaagcaccaaugccuaauuuuagacaaacagcgaaacaauauuuagaagagguccuaauaucucauaaagcuaaaaacaaaguuguaacgaaaaauaaaaacaaaauccuugguaaagaaaaaauccaagaaacacuuacaccucgagggcagcuacaugaucagacuauauacggauuuaacugguggagcagaauuacccuuucaaagaaaguaucacguaacgaaauagaaaaaauaaucgacaacaauacgaaauuuuuuuuacaagaauuuauacaguuaaaaggcaguauagcuaaagcguucuccgaugcugaacucaacaagcuuauguacaaaggaaaaauacucaaagaaaucgaagucgcaauuccauguuauacacaacguauugacauaucaaaaguuuuuaccgacucacaaaaaaguaauuccgcaaaagaaaaaaacaucaagaacauacuagaucuaaaaguuagaaauauacuccaaaacagacuaucagaauucaaaggagacuuuaagaaagcauuuuccgaccucgauaaaaauccuaucugguuuaacaaagaaaaaggaaucuccauaaaacguguaauaaucuccggaguaaaaaacguagaacccuuacacuauaaaaaagaccaccucggcaacgacauacuagacgguaaagaaaacagaauaccaguugauuucauaagcacaggaaacaaccaccacguagcaauauaccaagaugaaaaagguaaucuacaggagaaagucgucagucuuuuugacgcagucaagcuugugaacgcagaugaaccaguaauagacaaaacauacaaccaggggcuagguuggcaguucuuauucacgaugaaacagaacgaaauguuuguauuuccaaacgauaacacagguuuugauccaaaagagauugaucuauuagauccaaguaauaaaaaauuaauaucaccgaauuuauuuagaguucaaagcauuuccauaguacaauacgguaauaauauaguucgggacuuuaaguuucgaaaccacuuggaaucuguacugaacgacgauaaaguuuuacacggaauaacauuccaacagauaaaaaguuuagggccacuacugaauauagucaaaguucgaauaaaccacuuaggugacauaguaagcgucggagaauacuga

SEQ ID NO: 5637 - RNA, 4260 nt, Artificial Sequence
  Cas9 variant
auggcuaaaccacaaaacuauacaauagguuuagauauagguacaaacucgguaggauggacgguaacugacgaccaaaacaacauauuaagaaucaaauccaagaaagcaauaggcgcuagacuauuugaagaaggaaaaguagccgcagaaagaaggaguuuucguacaacuagaagacgguuaucaagaagaaaauggaggauaaaauuacuagaagaacuauuugacgaggaaauaucaaaaguagauccuaacuuuuucgcaagaucucacgaaucguggauuagucccaaagauaaaagagaaagguauucagccauaguguuuccaacaccagaagaagauaagaaauuccauaaugaauauccaacaauauaccacuuaagagacagacucaugaaagacgaucaaaaacacgauauacgcgaaauauacguagcaauacaccauauaaugaaauacagaggaaauuuccuacacgaugaaaguauagaaacauacaggaguggaaugucaucauuaggaggaggagacgaacguacuauacucaauacgaaaauacuggaugaccuaaaugacgcguuugcagacaaucuggcaacacaaggaaucagcguuaauagcgccagcgcagaccaaaucaacgagauaguuacaaguggacauuugaacguugacucucaaaaagcaauagcaaaacuacuauuacccacuacacugucaucagaugacaagaaacaagacaagaaaaucaagaaacuagcaacagacgcagccaaaaauguagcaucagcauggcugggcuacaaagccaacuuugcagcaauacuaaauauacaagaaguugauaaagauaaaaagaaaauauacaguuuugcacuacaaggugcugacgaagaagacaaaguugaaacucucgaaagcguucugucacaagaccaaaucgaaauaguagaccgaauaauuagaaucagacaugcaauaguacuaggcgaaaucauuccuguagguaugacccugagcgaggcaaugauagaaaaauacgaucaacacgcuaaagaccugaaaaauuuaaaaacaguaauaagaaaucuuaaagauagaaagaaugccguaaaacuacaggcaauuuaugauuuguaugucaacaaucgacaugcggauacagcaaaagcaaugaaauuagccggggugaagaaaagaacggaauuauuagaaccagaagaguucaacaaaucuauugaaaaacuucuggacgacucaccuguaagugccgaaauuaagaaacgaauagccgaaaaagauuuucucccacuccaaaggucuaauagcaauggagucaucccaaaccaacuccaccaaauugaauuagaugaaaucauaaagaaacaaucaaaauauuauccauuuuugggugaaacaaaugaacaugcauccgcugacguagcaagaaaagcuccaacaaaacuagaucaacuacuaacauuucgagucccauacuaugucggaccauuaaucacgaaagaggaacaagaagaacaagauggccacucuuuugcauggaugauucguaaaaaccccaaagaucaugagaaaaucacaccauggaacuuugacgaaaaaguagaucgaauggcauccgcuacacaauucauuaaacgcaugaccacuaaagacacauaccuacuaggugaagacguauuacccaguucaagucuaaaauaucaacuuuucaccguuuugaacgaacucaauaacuuaagaauaaaccacaagaaauugacuagagaagaaaaagagcaaguuauagaagaccuguuuaagaaauauaaaacaguaaaagcugacaaauuuaaaaacuacuggcagaaaggucaugcaggguuggauguaaaaauacaagguauggcggacccagaaaaauuuaacucgaccaugaguaccuacaucgaucuacagaaaauuuucggcgaucaauuagaugacgcccaacgacagaaugacuucgagaaaauaauagaauacaguacaauuuuugaagaucgaaaaauacuaggggaaaaauuaagagccgacuuuguaugguuaagugaagaucaaauaaaaagauuaugcagacugaggcuccaaggcuggggaagauuaagccuaaaauuauuaacacgacuaacagaugcagacggccagaauguauuggaaagacuuuugaacucgaaugauaauuucaugcaaauaguuaaagacccgguaauaaaagcuaaaauagaacagaaaaaucaaaaauuauugagagccgacugguccgaaaaugcaacagaaucuauauuagacgaagccuauacauccccucaaaauaagaaagccauuagacaaguaaugcgcgucguucaugauaucguuaaagcaugugaugguaaucuucccgcuaaauuugcaauagaguucgcaagaagucaagacgaugaccccaaaagaacaguagcaagagcagacaggcuacagaaaauauacgcccaaauaucagacgaaguuguaagccaaggaguaaaagaccaacuuaguggaaugaaaaguuuaaaagaccguuauuaucuauauuucaugcaagguggaagggaugcauauacggguaaaccuuuaaacauagaucgacuaagcgacuacgacauagaucacauaaugccacagagcuucauaaaagaugauucauuggacaauagaguauuaguaacacgagcaguuaauaaccagaaaagugauaauguaccaguacuguuauauggaaaccaccucguugcagaccuaggaauuacaauaagagaaaugugggacagauggcagaaaagcggaaugauaaguaaaagaaaacuagcaaaccugcucaccgauccagccacauuaagugaauaucgagcggaaggguuuauuaaccgacaauugguagaaacaucacaaguuauuaaguuaacagcuaccauuuuacaaucugaauuuccagauucaaaaaucauagaagucccggccaaauacaauaguaucuuaaggaaacaauucgaucuguacaaaucaagagaaguaaaugauuaccaccaugcuauugacgcguaccuaucaacaauaguggggaauuaucuauaccaagucuaucccaacuuaagaaggcuauuuguuuacggugaauuuaagaaauuuucucauggggaggaagaaagcucacaucaagcaguaagaagagugaaaucaaugaacuucuuagacgauuuacuaaggggaaaacacggggaugauauauauuguagagucaccggggaagucauuuucucaagaaaagauaucauuucaaaacugaaacaagcauauuccuuuaaacaaauguuaguaacacaagaaguauucacaaagaaaagugccuuauuugaucaaaccguuuauccaucuccggcaagagauucaaaaacacguagcggguuaauacccagaaaacaaggcauggacacagaaauauacggugguuacucagggaacaaagacgcuuauuucguauuagcacaaguaguaaaaaguaaaggccacacuuuacaaguaguagguguacccauccgugcacucagagcgcuagcaaacuguaguaacuauucagaacaacuccuaaaaauaguaaaagcacaaguacuuuuuaacaagaaaacugguaaagcuaagaaaggaaucucugacguacgaauacuacucgacaaaauccccuacagacaaccaguauuagacggcucagcauucuauauguuaggcagcaguacuuacaaauacaauuuaaaacaaauuagccuaucacaacaaucuaugaaauacaucuuggauuauauugacgauccaaauuucaauaaacaugaaaugacuaaaauagaccaacaaaaugaaaaagaaugccuguuauccguauaugacgaaauuuuggacaaaauggauaaauaccuuucacuauacgacauaaacggauucagaaagaaacuucaugucggaagagacaaauuuauaaaauuagaagucgaaaaacaagcugaggccaucaaaaauguauuaagaggcuuucaugcaaauucugauaugacuaaauuaagugacuuaggauuaaguacaucuuuagguuuuaugcaagcgagugacgggauaaaauuaagcgacaacgcgguuuucauauaccaaucuccgacugguuuauuugaacgcaggguuaaaguaucugauuuauuaaaauga

SEQ ID NO: 5638 - RNA, 4260 nt, Artificial Sequence
  Cas9 variant
augaugaucaaaaacauauuaggucuagacuuagggacaaacucaauaggaugggcccucauuaaacaaaauuucgaaaacaaguacggagaaauauuaggaauggggucgagaauaauucccaugucucaagauguucucggggaauuuggaaaaggaaacagcgugagucaaacagcagcacgaacgggauauagaggaguccgucgcuuaagagaaagauuccuacuaagaagagaaagacuccaucgaguauuaaacguacuaaacuuuuuaccagagcacuaugcaucacaaauagacuuugagaaaagauucggaaaguuuaaauacgagacugaaccgaaacuagcuuacaacaaugacggauuuuucuuuaagaacucauuugacgaaaugcuaggagauuuuaaagaucaucaauuucaucuucuagaaaauggaagaaaagucccauaugauuggacaauauacuauuuaagaaagaaagcucuaagucagaaaaucgaaaaggaggaacuagcguggauacuucuaaacuucaaccagaaaaggggguauuaucaacuacgaggugaagacuuugaggaagagaaggaucgaguguucgucagacuaaaagucgaucgaguuguggacuccggugaaaauauaaaaggcaagauauuguaugacguauacuuugaaaacgguuggaaauaugaaaaacaaauaguuaaaaccgaggacuggauuggaaggacaaaagaauuuauaguaacagaaagcauuuuaaagaauggggauacaaaacgaaccuucaaagcuguggacucggaaaaggacuggauugcaauuaaaacaaagaccgaacaagaaauagauaagucacacaagacuguaggagcuuauauuuacgaagcucuuuuacaaaaccccaaacagaaaauaaaaggcaagcuagucaggacuauagaaagaaaauucuaucgagaggaacuaaagaaaauuuuagaacgacaaaaagaguuccacccagaacuccaaagugacgaccucuauaacgauugcauaagggaacuauauagaaacaaugaagcacaccaaauaacccucaguaagaaagacuucguccaccuacuacuaaaugaucuaaucuucuaucaaagaccauuaagaagccaaaaaucaucaguaagcaauuguacccuagaguucaggaaauacaaagacgaaaacggaguagaacacgcccaauauuuaaagacuauccccaaaaguaaccccuauuaucaagaauuuagagucuggcaauggauguuuaaccuaaacauauaccgaaaagaugacgauaccaacguaacaaaggaauuuuuaucauccacggaagauuacgaaacauuauucgaauuucugaacaauaggaaggaaguagaucaaaaagcauuauugagacauuucaaacuaaaugaaaagacgcaccgauggaacuacguagaagauaagaaauacccaugcaacgaaacaaaaacaaugauuucgacaagauuagaaaagguugaaaauuauccuuccgacuuucucacaagagaaauggaacaaaauauauggcacauaauauacucagucaaugacaaaauagaauacgaaaaagcacuaaaaucuuuugcacacaaaaauaauuuagacgaaaauucauucuuugaagcguuuaagaaauucccaccauucaaaagugaauaugguagcuuuucagaaaaggcaauaaagaaauuauuaccguuacuuagacuuggaaaauauuggaauugggaaucaauagacagaaaaucacaaggcagaauagagaaaaucauaacaggagaauuugacggaaacauuaaagauaaaguaagagaaaaagcaauacauuuaacagcagaaaacgacuuccaaggacuacaacuguggcuugcccaauauaucguauacgguagacauuccgaagcuagcaugauugguaaguggaacucagccgaugaccuagaagaauuucuaaaaggauucaaacaacauucauuaagaaacccaauuguagaacaaguuaucaccgaaacacugagaguaguuaaagacauauggcuaaaauauggaaacggcgcuaaagauuucuuuucugaaauacacauagaauuaggaagagaaaugaaacaaacuaaagacgaacgaguagacgcaaccaaaaggauaaccgaaaaugaaaacacaaaccuaagaaucaaagcucuccucgccgaaaugaugaacgacaauucugucgaaaauauaagaccauauagcccaaugcaacaagaaauacuaaagauuuacgaagacggaauccucaaguccgauauugaaauagacgacgacauacucaaaauaaguaaaaccgcacaaccuagcaguucagauuuaaagcgguacaaacuaugguuggaacaacguuauaaaucucccuacaccggccaaauaauacccuuaaauaaauuauuuacauccgaauaugaaauagaacacauaaucccacaaucaagauacuucgacgacucuuuuaguaauaaaauuauaugcgaaagugcaguaaauaaacugaaagacaauuacauaggacuagguuucaucaaacaauucggagggaugauuguugaaugcggcuuugguaaauccgucgagauauucaaagcggaagaauacgaagauuuugucaagaaacacuacgccaacaauaggucaaaaagaaauaaacuuuuauuagaagaaauaccagagaaaaugauagauagacaacuaaaugacacaagacacauaagcaaauacauaucggggguacucagcaauauaguccgacaagaagacgguacggaugaagguguuaauucuaaaaacauuguaccggguaauggaaaaauaacaacccaauugaaacaagacugggguuuaaaugauguauggaaugaacuaauauuaccaagauuugaacgcaugaaucaacuaacaaacucaaccgauuucacaagcuggaacaaaaaucaucaaaaauuuuuaccuacugugccgauagaguucagcaaggguuuuucaaagaaaagaauagaccauaggcaucaugcaauggacgcucuaguaauagcaugugcaacuaaagaucauauuaacuuauuaaacaaucaaucagcaaaaucugauacaaaaagauacgaucuaaaacgcaaacucaugaaauuugaacgaguaguuuacagccauucuaaaacaggagagaaaaucgaaaaagaaguaccaaaacaauuccucaagccaugggauaacuucacaguagacgccaaaaauaagauggaaacaauaauaguuagcuucaaacaaaaucuuagaguaauaaacaaagcaacgaaucauuacgaaaaauggauagaaaaagauggcauaaaaagaaaagaacuaauaaaacaagaaggcacaaauugggcaauucgaaaaccaaugcauaaagaaacaguauccggaaaaguagaccuaccaggaauuaaaauuccaaaaggaaaaauacuaaccgcuacaagaaaaagccuagacacgagcuucgauuugaaaacaauaaacaguauuacagacacugguauucagaaaauuuuaaagaacuaccuagaauuuaaaggaagcagcgaacuagcauuuucgccagaaggaauugaagauaugaacaaaaacauagaaaaauucaacgacggaaaaccacaccaaagcauuaacaaggugcguauauucgaauuaggcagcaaauucaguguaggucaaacugggaacaagaaagacaaauacguagaagcagcaaaaggaacaaaccuguucuuugcagucuacgaagacaaaaacggcaaaagauccuacgaaacgaucccacucaaugaaguaauagagagacaaaaacaaggccucgacagcguuucauuuaaaaauaaagaggauuuccucuugugcccaaaugaucuaguuuacguccccagugaagacgaacuagaaaauauauacaauauugacuucaaaaaucuaacaacagagaagacagggaacauauacaaagucgucucauucucuggaaaccaaauauucuuuauuagacaagauauagcgauaaguauaguaaauaaagcggaguucuccacacuaaauaaaauggagagggcaauagacgguagcaugauaaaagaaaacuguauaaaacucaaaauagacagauuagguaauauagccaaaauauga

SEQ ID NO: 5639 - RNA, 4263 nt, Artificial Sequence
  Cas9 variant
auggcaaaaccaaaggauuacaccauaggacuagacauaggaacgaacucagucggauggguaguuacagaugaucaaaauaauauucuacgaauaaaagggaagaaagcaaucggugcacgauuguucacagagggaaaagucgcugccgaaagacgcagcuuuagaacaaccagacgucggcugaguagacgaagauggagaauaaaaaugcuagaagaacuauucgacgaagaaauagcaaaaguugauccauccuucuuugcaagacuccacgaaucuuggauaucaccaaaagauaagagaaaaagauauagugcgauaguauuuccaucgccugaagaagauaagaaauuccacgaaagcuacccuacaauauaucauuuacgagauaaacuaaugaaagaugaucagaaacaugauauaagagaaauauacauugcaguacaccaaaugauaaaagccagagguaauuuccuucacgaugaaaguguagagacauacagaucuggaauguccagucuuggcggaagaagcgaaaggacaauauuaucaguccagacauuagaggaacuuaacgauuuauuugccgagaacgaaggcacugaagaagucgaacuaaauguugcuucagcagaacagauuaaugauauauuaacaggaggacaccugaaugccgauucacaaaaggaaauaucaaaccuccuauuaccaucaucauucccuucauuugaugacaaagccaaagaaaaacaaguaaagaaauugaucaauaacguagcuacaaauaucucaaaagcguggcuuggauauaaagcagacuuuagcacaauucuaaacuuagcaaaagucgacaaagaccagaaaaagauauucgcauuugcacugcaaggcgaggaugaagaagacaaagugcaagaacucgaaucgcuauuagagcaaagucaaacagacauaguagacagauuaauagaaauacgucacgcaauaguucuaucagaaauagugccaguaggaaugacauuaagugaagcaaugauugacaaauacgaucaacacaaagaggaccuuaucaccuuaaaagcaguaauacgaaauacuaaagacaagaagaaagcugccaaacuccaagcuauauaugacuuauacgugaaaaaucgacacgcagaccuagccaaagcaaugaaacuaaccgggaucaagaaaagaucugaacuuuuagauccagaggaacucaagaaagggauaaguucgcugcuagaugauagccccgaagcaguagaaauaaaacaaaggcuugaagaaaagacauuuuuaccauuacaacgaucaaauaacaauggcguaauccccaaccaauugcaccaaguagaauuagaugaaauaaucaagaaacaaucuaaauacuauccguuccuugcagagaaaaacccagacgaaucugaagaggcacaaaagaaagccccaacuaaacuagaugcgcugcugacauuccgcguaccguacuacguagggccaaugauaacuaaagaagaacaagaggcucagaacggucauucuuucgcauggaugguaagaagagacccacaggaucacgaagccaucacuccauggaacuucgaaaagaaaguagacaaaauggccucagcuacccaauuuauaaaaagaaugacaacuaaagauacauaccuacucggagaagacguauugccugcaucgagucuaaaauaccaguuauucacgguauuaaaugagcucaauaaucuucgagucaacggaaagaaacugacaucugaugaaaaagagcaaguuauagaaggcuuguucaagaaacagaaaacagucaaagccgacaaauucguaaaauacuggcaggccaaacacauaggagcagauaucaaaguaaaaggccucucagauccaaguaaauuuaacagcacaauguccaccuacauugacuuuaagaaaauuuucggagaccaauuaaacgacgucaacagacaaaaugauuucgagaaaauuauagaauauucaacaauuuuugaagauagaaaaauucuugaagauaaauuaagagccgauuucgcauggcucucugaagaacagauaaaacaacucugucgauuacgcuuacaaggauggggaagauuaagugauaaauuacuuacgagacucacagacgcagacggucaaaauguauuagaaagacucuggaauagcaacgauaacuucguacaaauaguaucagauccuaauauaaaagcaaaaauugaacaagaaaaccaaaaauuauuaagagacucacaaagcgacaaugcugucgaauccauccuagacgacgcauacacgucaccacaaaauaagaaagcaauuagacaagucaugcgugucguacacgauauaguaaaagccugcgacggcaacguuccagcuaaauucgcaaucgaauuugcuagaucgcaagaagaugacccaaaaagaacgacagcacgaguaaaucaaaugcagaaaauuuacgaucaaauuucggaugaaguaguaucacaaggaguuaaagagcaauuaagcggaaugaaaagccucaaagauagauauuaucuauauuucaugcaaggaggacgugaugcuuauaccggagcaaaacucaacauagauagauuaucagauuacgacguugaucauaucaugccgcaaucguuuguaaaggaugauucuuuagauaaucguguacugguagcaagggccguaaacaaccaaaaaucagauaaagucccggcgcuauuauucggaaacaagguaguugcggacuuaggcauaaccguucgcgaaaugugggacaaauggcaaaaauuagguaugaucagcaaaagaaaacugucaaaccuacuaaccgacccggacgcuuuaaccgaauauagagcacaaggcuucaucaggcggcaauuaguagaaacuucucaagucauaaaacuuacagcaacaauacuacaaagugaauuucccgacuccaaaauaauagaaguucccgccaaauacaauucaauaguacgcaaacaauuugaucuauacaaaagcagagaagugaaugauuuucaccacgcuauagacgcauaccuauccacaauugucgguaacuaccuauaucaagucuauccaaacuuaagaagaauguuuguuuacggagaguucaagaaauuuucaagcaaugcugaagaaagcgcucaugacguugccagacgcguaaaaucuaugaacuuccuagaugacuuauuacgagguacccacggugacaauauauacugcagaucaacaggagaaauagucuuuaauagaaaugacauaauaagcaaauugaaacaagcguauucguucaaacaaaugcucguaacgcaagaaguuuucacuagaaaaucagcucuguuugaucaaacaguauauccuucaccugaacgagacaguaagaaacgcaguggcuuaauuccccguaagaaagggauggaucccgaaauauacggaggguacgcacacaaucaagauagcuacuucguccuagcaaaaauagaaaaaguaaaaggcuacacauugcaaauaguaggaguacccaucagaucuuuggaaauaaucaauaaagcggaagacuuuucuacagcucuguuagauauaauaaaaaguaaaguuauguacaacgagaaaacaggacaaccaaaaagaggaauaaagaacguagaaauccuuguaaacaagcucccauacaggcaaccaauauuagaaaaagauguaucauauaugcucgguucaagugcuuauaaauacaacaugaaacaaauaacacuaaguagacaaucuaugaaauacauccuagacuacaucgaugauccaaauuucacaaaacaugaaaugacaaugauagaugaacaaaacgaacgugaaugcuuacuaucuguauacgacgaaauucuagaaaaaguagacaaauauuuaccccuuuucgauggaaacaaauuucgagaaaaacuccacucagcccgaaaagaauuuguuucccuaucaguagaugacgaagcuagugcuauagaaaagauacuucgcggucuacacgcaaauucagaaaugcccagcuuggaaaauuuaaaaauaaaaccugcacuaggauucuuccaaaugaaaaacggaauaacacugaguaaugaugccguauuauuauaccaaucacccacagggcuauucgaaagacgcgugaaaguuagugaucuauuaaaauga

SEQ ID NO: 5640 - RNA, 4263 nt, Artificial Sequence
  Cas9 variant
auggcaaaaccaaaagauuacacgaucggacucgauauagguaccaauucaguaggaugggucgucacugacgaucaaaauaauauauugagaauaaaagggaagaaagcaauuggagcuagauuauuuacggaaggcaaaguagcagcgaaaagaagauccuuucgaacaacucgaagaagacuaucacgaagaagauggaggauuaaacuacuagaagaacuauuugacgaagaaaucgcuaaaguggaccccagcuucuuugccagauuacacgaaucuuggauuucaccaaaagauaagagaaaaagauacucagcgaucguauuuccaagcccugaagaagauaaaaaguuucacgaaaguuauccaacaauuuaccauuuaagagacaaauuaaugaaagacgaucaaaaacaugacauucgcgaaauauacauugcaguccaccaaaugauaaaggcaaggggaaauuuccuacaugaugaaagcguagaaacuuaccguucuggaaugaguuccuuagguggacgaagcgaacgaaccauucuguccguucaaacuuuagaagaauuaaaugaccuuuuugcggaaaacgaaggaacugaagaagucgaacucaacguagccagugcugaacagauaaacgauauacuaacaggaggucauuugaacgcggauucacagaaagaaauaaguaaccuucucuugccaagcuccuuccccucauucgacgacaaagcgaaagaaaaacaaguaaagaaauuaaucaacaacgucgcgacaaauauauccaaagcauggcucggauauaaagccgauuuuucuacgaucuuaaaucucgcaaaaguugauaaagaccaaaagaaaaucuucgcguucgcucuacaaggggaagacgaagaagacaaaguacaagaacuagaaucacuuuuagaacaaucccaaacagacauaguugaucgacugauagaaauaaggcacgccauaguuuuaucugaaauuguucccguugguaugaccuuaucagaagcuaugauagacaaauacgaccaacacaaagaagaccuaauaacauuaaaagcaguaauuagaaauacuaaagacaagaagaaagcagcaaaacuacaagccaucuacgaccuauaugugaaaaaccggcaugcagacuuggcaaaagcgaugaaacugacaggaauaaagaaaagaagcgaauuacuggacccugaagaacugaagaaaggcauaucuucacuacuugacgauagcccugaagcaguugagauaaaacaacgaaucgaagagaaaacauuucuuccacuacagagaagcaacaauaaugguguaauuccaaaucaauuacaccagguagaacuagaugagauaauuaagaaacagucuaaauauuauccauuccucgcagagaaaaauccagacgaaagugaagaagcacagaagaaagccccaaccaaacuagaugcacuacuuacuuucagaguccccuauuaugucggaccgaugauaacuaaagaagaacaagaagcucaaaauggccauucuuuugcauggaugguaagacgcgacccucaagaccacgaagcuaucacaccauggaauuucgaaaagaaaguugacaaaauggcaucagcuacacaguucauaaaaagaaugacuacaaaagauacauaucuauuaggagaagacguacugccagcgucauccuuaaaauaccaacuauucacagugcuuaacgaauuaaauaaucuaagagucaaugguaagaaauuaacaucagacgaaaaagagcagguuauagaaggucuauuuaagaaacagaaaacaguaaaagcugauaaauuuguaaaauacuggcaagcaaaacauauaggagcagacauaaaaguaaaaggauuaucugaucccuccaaauucaauucaacgaugucuacuuacauugacuucaagaaaauauucggcgaccaguuaaacgauguaaaccgacaaaaugacuucgagaaaaucauagaauacuccacaauauuugaagauagaaaaauauuagaagauaaacuaagaguagauuuugcguggcuaagugaggaacaaaucaaacaacucugcagacuuagacuacaagguuggggcagguuaucagacaaauuacuuacaagacuaaccgaugcagauggacaaaacguccuugaacgacucuggaacuccaacgauaacuucgugcaaauagucuccgacccaaauauaaaagcaaaaauagaacaagaaaaccaaaaacuacugagagacucacaaagcgauaacgcaguagagucuauauuagacgaugcauacacauccccacaaaacaagaaagcuauaaggcaaguuaugagaguugugcacgacauaguuaaagcaugcgacggcaauguuccagcaaaauuugcuaucgaguucgcuagaagccaagaagaugauccaaaacgaacaacagcaagaguaaaccagaugcagaaaauauacgaucagauaucagacgaaguagucucacaagggguaaaagaacaauuaagcggaaugaaaucucucaaagacagguacuaucuauacuucaugcaaggaggacgcgaugcuuauaccggcgccaaauuaaacauugacaggcuaucagauuaugacguggaucacaucaugccacaaaguuuuguuaaagaugauucucuagacaaccgaguccuaguagcacgagcaguaaacaaucaaaaaucagacaaaguaccagcacuccuguucggcaacaaaguaguagcugaucuaggaauaacgguaagagaaaugugggauaaauggcaaaaauuaggaaugauaaguaaacgaaaauugaguaaccuacuuacugauccugacgcauuaaccgaauauagggcgcaagguuuuauccguagacagcuagucgaaacaagucaagugauaaaacuuacagccaccauacuacaaucagaguuccccgacucaaaaauuauagaaguuccagcgaaauacaauaguauugucagaaaacaauucgacuuauauaaaucacgagaaguaaacgauuuucaccaugccauagaugcauaucuaagcacgauuguaggaaauuacuuauaccagguauacccaaaccuaagaagaauguuugucuacggagaguucaagaaauuuuccucuaaugcagaagaaucagcacaugacguugcaagaagaguaaaaaguaugaauuuccuggacgaucuauuaagggguacccacggcgacaacaucuacuguagaagcacaggagaaauaguuuuuaaucgaaacgacaucauauccaaauuaaaacaggcuuacaguuuuaaacaaauguuaguuacccaagaaguauuuaccaagaaaucagcauuguuuaaucaaacaguauaccccucaccuaaaagagacgguagcaaaaggagcggccuaaucccuagaaaaagaggcauggacccugaaauauacggaggguaugcacacaaccaggauucacauuucguauuagcaaaaauagaaaaaguaaaaggguauacgcuccaaauaguaggaguaccaauaagaucccuugaaauuauaaauaaagccgaagacuucucaacugcauuacuggacauaauaaaaucaaaagucauguacaacgagaaaaccggacaaccaaaaagaggaaucaaaaacguugaaaucuuaguaaauaaacuuccauaucgacaaccaauucuagaaaaagacguaucauacaugcucgguucaucagcauacaaauauaacauaaaacaaauaacacuaagcaggcaaaguaugaaauacauccuugacuacauugaugacccaaauuucacaaaacacgaaaugaccaugauugacgaacaaaacgaaagagaauguuuacugagcguauaugacgaaauacuugaaaagguagauaaauaccucccauuauucgaugguaauaaauucagagaaaaacuacauagcgcgcgaaaggaguucguaucacuaucgguugacgacgaagcaagcgcaauagagaaaauuuuaagaggacuccaugcaaauucagaaaugccgagcuuagaaaaccuuaaaauuaaaccagcauuaggauuuuuccaaaugaaaaacggaauaaccuuguccaaugaugcaguuuuacuauaucaaagcccaaccgguuuguucgaaagaagaguaaagguauccgauuuguuaaaauga

SEQ ID NO: 5641 - RNA, 4263 nt, Artificial Sequence
  Cas9 variant
auggcaaaauucaacaaaaacuacucaauaggacuagacauaggaguaaguucaguaggcuaugcaguuguuacagaugacuaucggguccccgcauuuaaauuuaaaguguuagguaauacugaaaaagagaaaaucaagaaaaaucuuaucggaagcaccacguucguacccgcacaaucugcacaaggcacaagaguuuuuaggguaaaccgccguaggaucgaucgaagaaaccaccgcauagccuaccucagagauaucuuccaaaaagaaauagaaaaaguugauaaaaacuuuuacagaagauuggaugaauccuuccgaguccucggcgacaaaagugaagaauuacaaauaaagcaaccauucuuuggugacaaagaauuagaaacugcauaucauaagaaauacccuaccauauaucaccuaagaaaacaucucgcugacgcagacaaaaauuccccuguugcagacauacgagaagucuacauggcuaucagccacauacuuaaauaucguggucacuuucugacauuagauagaaucaacccaaacaacauaaacaugcaaaauagcuggauagacuuuaucgaaucaugccaagaaguauuugaccucgaaaucuccgaugagaguaaaacuauaguugcgauauuuaaaagcagugacaacagacaggaaaaaguuaaaaagauacucagcuacuuucaacaagaauuacuaaagaaagauaaaucuauauucaaacaacucuuacaacuacucuuuggacucaaaacaaaauucaaagauuguuucgaauuagaagaagaaccagaccuaaacuucucaaaagagaacuacgacgaaaaucuugaaaauuuccuaggaucgcuagaagaagacuucagcgauguauuugcaaaauuaaagguacugagagauaccauccuauuaucaggcauguugaccuacacuggaacuacgagagcccgcuuuagugcuaccaugguugaacgauacgaagaacauagaaaagaucuacaacgauucaaguccuuugugaaacaaaaucuaucagaacaagacuaccuagacauauuuggaagaaaaacaccaaaugguuuugauguugacaaagaaacaaagggauacguuggguauaucaguaauaaaaugguucucacaaauccccaaaaacagaaaacuauacaacaaaauuuuuaugauuacaucaguggaaaaauaacaggaauugaaggggccgaauacuuuuuaaacaaaauaucggacggaaccuucuuacgaaaacuacguaccacugacaauggcgcaguccccaaccagauacacgcauaugaauuagagaaaauuauagaccgacaaggagaagacuauccauuuuuacuagaaaauaaagauaaauuauuaagcauucucacauucaaaauaccauauuauguaggaccauugagcaaaggaaacaacucgcgguucggauggaucaaaagaacaauaagucaagauauccuagacgauaacgacgaagauacacggaacggcaaaauaagaccauggaauuaucaaaagcucauuaauauggaugaaacccgugaugcauucauaaccaaucuaaucgguaacgauauaauccuacuuaacgaaaaaguacuaccaaaaagaucccucauauaugaagagguaauguuacaaaacgagcuaacgcgcguaaaauauaaagauaaauauggcaaaacucacuucuucgauagcgaauugcgucaggagauuaucaauaaccucuucaagacaaacaauaaaagaguuucaucugcuaugcugcucgauuacuuagaaaacuauacaaaccugcaagcuguugaaauaguuucugguauagaaaaagggaaaucacucaacagcacuuuaaaaacauauaacgauuuaaaaacaauauucucagaagaauuacuagacuccgagauauaccaaaaagaacucgaagaaauugucaaaguuauuacaguauuugacgacaagaaaucaaucaaaaacuaucuaauaaaauacuuuggacauuuagaauuucuuaacgaagaaagaaucaaucaacugucuaaauuacgcuauaccggguggggacgauacucagcuaaacuucuccucgauauuagagaugaagauacaggauucaaccuaaugcaauuuuuacgaaacgaugacgagaacagaaaucucagccaauuaauaucugauucaacgcugucguucgacucugcaauaaaaucuauccaaucaaaaucuacagucgaagaugauguauuugacgaaauaaagaaacuagccggaagccccgcaauaaaaagagguauacuuaauucgauaaaaauaguggaugaacuuguucagauaaucggcuacccgccccaaaacauaguaauagagauggcacgagaaaacaugaccacagaagaaggccagaaaaaggcgaaaacaagaaaaacaaaacuagagucggcuuugaaaaauaucgaaaacaguguacuagaaaacggaaagguaccacacucagaugaacaacuacaaagugaaaaacuuuaccuuuacuauuuacaaaacgggaaagauauguauagccuagacaaaacaggcucccccacacccuuauauagagaucaacuagaccaauaugaaguagaccauauuauaccauauucauuuuuacccaucgacucuauagauaacaaaguacuaacucauagagaaaauaaucaacgcaaacugaacaauauaccagacaaagaaacugucgcaaauaugaaaccauucugggaaaaacuauacaacgcaaaauuaauuucacaaaccaaauaucaaagacucacaacaucggagaggacaccagacggaguacuaacagaaucaaugaaagccgguuucaucgaacgacaauugguggagacccgacaaaucauaaaacacguagcgagaauauuagacaauagauucuuagauacaaaaauaaucgcacuaaaaucucaacucauaacuaauuuucgaaacaccuuccauauagccaaaauccgcgaauuaaaugauuaccaucacgcacacgacgcauauuuggcagucguuguaggccaaacauuauuaaaggcuuaccccaaacuugcuccggaauuaauauacggucaccaugcacacuucaaucgccaugaagaaaacaaagcuacaauucgaaaacaccuauacucaaacaucaugagguucuuuaacaaccccgauagcaaaguaucuaaagacaucugggauuguaauagagaccuaccaaucaucaaagaaguuauauauaauagucaaguaaacuuuguaaaacgaacuaugauaaagaaaggggcuuucuauaaccaaaaucccgucggcaaauucaauaaacaaauugcagccaauaacagauacccacuaaaaacaaaaguaucgagccuagauacgucaauauacggcggguaugggcccaugaauagugcucuaaguauaauaauaauagcagaaagguuuaaugaaaagaaaggaaaaauugaaacaguaaaagaguuccaugacauauuuauaauugacuacaagaaauucaauaauaacccuuuccaauucuuaaacgacaccagcgaaaacggauuccuaaagaaaaacaacaucaauagaguauuggcauuuuaugggguuccaaaauauucauuaaugcagaaaaacgauggaacacgaauguuauucgaaucuaaaucaaaccuccauaaagcuacccaauuuaaacuuacaaaaacccaaaacgaacucuucuuucacaugcgcagacuacucacaaaauccaaucucauggauuuaaaaucugaaucagccauuaaagaaucacaaaauuuuauacucaaacacaaagaagaguuugacaauauuucuaaucaacuuagcgcauucucacagaaaaugcuaggagacacaacaucucugagaaacuuaauaaaaggauacaaugaaagaaaaauaaaagaaauugauuccagcgaagaaguuauaaaauacuucuacgacaacuucauaaaaauguucagcuuuguuaaauccggugcaccaaaaggaauaaacgacuuuuucaauaauaaauauaccguggcaagaaugagaccgaaaccagacaagaaauuucuaaacgcuacccuuauacaccaaucuauaaccggccucuacgaaaccagaauugaucucucaaaacuaggugaagauuga

SEQ ID NO: 5642 - RNA, 4263 nt, Artificial Sequence
  Cas9 variant
auggcaaaauucaacaaaaauuacucaaucggauuagauauaggaguuuccagcguagguuaugcaguagucacugacgacuacagagucccagcauucaaauucaaaguacuuggaaauaccgaaaaagagaaaauaaagaaaaaccuuauagggagcacaacauuuguaccagcacaaucagcccaagguacaagaguguuucgcguaaaucgcagaagaauagaccggcguaaccaucgcauagcuuauuuaagagacauauuccaaaaagaaaucgaaaaagucgauaaaaacuuuuaccgaaggcucgacgaaucauucagaguacucggcgauaaauccgaagaauuacaaaucaaacaacccuucuucggagacaaagaacuugaaacggcauaucacaagaaauauccuaccauauaucacuuaagaaaacaccuugcagacgccgauaaaaacucaccaguagcagauauccgcgaggucuacauggccaucucccauauacuaaaauauagaggacacuuccucacacuugacagaaucaacccaaacaacauaaauaugcaaaauucauggauugacuuuauagagucaugucaagagguauuugaccuugaaauuucugacgaaucaaaaacuauagucgcgaucuuuaaaucaucagacaacagacaagagaaagucaagaaaauacuaucauacuuccaacaggagcuauuaaagaaagacaaauccauauuuaaacagcuacuacaauuguuauucggacucaaaacaaaauucaaagacuguuucgaauuagaagaagaaccggacuuaaauuucuccaaagaaaacuaugacgaaaaccuugaaaauuuccuaggcucacucgaagaagauuucagugacgucuucgccaaacuaaaaguauuaagagauacaauacuacuuucugguaugcuaaccuauacaggaacaacaagggccagauuuucagccacaaugguagaacgauacgaagaacacagaaaagaccuacaaagguuuaaaucuuucguaaaacaaaaccuuagugaacaggauuaccucgauaucuuuggccguaaaacucccaacgguuucgacgucgauaaagaaaccaaaggauauguaggcuacauuucaaacaaaaugguacuuacaaacccacaaaaacagaaaaccauacaacaaaauuuuuacgacuauauaaguggaaaaauuacagggaucgaaggugcagaguacuuucuuaacaaaaucagugauggaacauuucuacgcaaauuacgaacaaccgacaauggugcaguaccaaaucaaauacaugcauacgaauuagagaaaauaauugaccgacaaggcgaagauuaucccuuccuacucgaaaacaaggacaaacuacucaguauccuaacuuuuaaaauucccuacuacguagguccuuuaagcaaaggcaacaauagccgcuucggauggauaaaacgaacgauaagccaagauaucuuagaugauaaugacgaagacacaagaaauggcaagauucgaccauggaacuaccaaaaacuaaucaauauggacgaaacacgagaugcauuuauaacgaaccuaauuggaaacgauaucauccuacuuaacgaaaaaguauuaccuaaaagaagccuaaucuacgaagaagucaugcuacaaaacgaacuuacgagaguaaaauauaaagauaaauacggaaaaacacauuucuucgauucagaauuacgacaggaaauaaucaacaaucuauuuaaaaccaauaacaaacgugucucauccgcuaugcuacuagacuaucuggaaaauuauacgaacuuacaagcaguagaaaucguaaguggaauugagaaaggaaaauccuuaaacucaacuuuaaaaacauacaaugaccucaaaacaaucuuuucagaagaauuacuagacucggaaauauaccaaaaagaacucgaagaaaucguaaaaguaauaacaguauucgacgauaagaaaucaauuaaaaauuaucucaucaaauacuuuggacauuuggaguuccuaaacgaagaacgaauaaaccaacuguccaaacuaagauacaccggguggggcagauacucagcaaaacuuuuacuagauauaagagacgaggacacuggauucaauuuaaugcaauuucuaagaaacgacgacgaaaaccgaaacuuaucccaauuaauauccgacucaacacuaucauuugauuccgcaaucaagacuauacaauccaaaucuaccguagaagaugauguauucgacgaaauuaagaaacuugccgguuccccugcuauaaaaagagggauauuaaauagcauaaaaaucguagacgaacucguacaaauaauuggcuauccaccgcaaaacauagucauagagauggcuagagaaaauaugacuaccgaagaggggcagaaaaaggcaaaaacaagaaaaacuaaacuagagucagcauuaaagaauauugagaacucaguauuagaaaauggaaaagucccacacagcgacgaacaacuacaaucugaaaaacuauaucuuuauuaccuucaaaauggaaaagacauguacagucuagauaaaaccggaagcccaacaccacuauauagagaccaacuagaccaauacgaagucgaucauauaauccccuacagcuuccuaccuauagacuccauagacaacaaaguccuaacacauagagaaaacaaccaacgaaaacuaaacaacauacccgacaaagaaaccgucgcgaacaugaaaccauucugggaaaaacuuuacaaugcaaaauuaauuagccagacgaaauaccaaagacucacaacuucagaacgcacuccugacggaguauuaaccgagaguaugaaagcuggauucauagaacgccagcuaguagaaaccagacaaauaauaaaacacguagcacgcauucuugacaacagauuucucgacacaaaaauaauugcacucaaaagccaacuaaucaccaauuuuaggaacaccuuccauaucgcuaaaauuagagaacuaaaugacuaccaccaugcacaugaugcuuaucuagccguuguaguuggucaaacucuucuaaaagcauacccaaaacucgcacccgaacucauauacggccaucacgcacauuucaauagacaugaagaaaauaaagcaacgauaagaaaacaucuguacagcaacaucaugagauucuucaauaacccagauuccaaggucaguaaagacaucugggauugcaauagagaucuuccaaucauuaaagaagugaucuacaacucacaaguaaauuuuguaaaaagaaccaugaucaagaaaggagccuuuuauaaccaaaauccaguaggaaaauucaacaaacaaauagccgcaaauaauagauauccauuaaaaacaaaaguuuccagcuuagauacuucaauuuacggcggauacggccccaugaacuccgcccuuucuauuaucauuauagcagaaagauucaaugaaaagaaaggaaaaauagaaaccgucaaagaguuccaugacauuuuuauaauagacuauaagaaauucaauaacaacccuuuccaauuucucaaugauacaagugaaaacgguuucuuaaagaaaaacaacauaaaccgcguccuagcauucuauggcguaccuaaauauucuuuaaugcagaaaaaugacggaacccgcauguuauucgaaaguaaaucaaauuuacacaaagcgacucaauucaaacuaaccaaaacucaaaacgaacuauucuuucacaugagaagacuccuuacaaaaagcaaccucauggaccuaaaaagugaaucagcuauuaaagaaucccaaaauuuuauacuuaaacacaaagaagaguuugauaacaucucuaaccaacuauccgccuucucacagaaaaugcuaggagacaccaccagccuaagaaaccuaauaaaaggauacaacgaaagaaaaauuaaagaaauagauaguagcgaagaaguuauuaaauauuuuuaugacaauuuuauaaaaauguucucuuuuguaaaaucuggugcaccaaaagacauaaaugauuucuucaacaacaaauacacuguagcaagaaugagaccuaaacccgacaagaaauuucugaaugcuacauuaauucaucaaucgaucacaggucuuuaugaaacucguauagaccucuccaaacuaggagaagacuga

SEQ ID NO: 5643 - RNA, 4263 nt, Artificial Sequence
  Cas9 variant
auggccaaguucaauaagaauuauaguauaggacuugauauaggaguaagcucaguaggauacgcuguuguaacagaugauuacagaguccccgcauucaaauucaaaguucugggaaauaccgaaaaggagaaaauaaagaaaaauuuaaucggcagcacuacauuuguuccagcacaaucagcacaagguacaagaguuuuucgaguaaauagaaggagaaucgacaggagaaaccaucgaauagcuuauuuacgagauaucuuccaaaaagaaauagaaaaaguagauaaaaauuucuaccgaagacuggaugaauccuuucgcguauuaggagacaaaucagaagaauuacagaucaaacagccauuuuucggggacaaagaacuagaaacagcauaucacaagaaauacccaacuauauaccacuuaagaaaacaccuugcagacgccgacaaaaacucuccuguugcugauauucgagaaguauauauggcaauaucacacauuuuaaaauaucgaggucauuuccuuacauuagaccgcauaaacccaaauaacauaaacaugcaaaauucauggauugacuucauugaaagcugccaagaaguauuugaccuugaaaucagcgacgaaucaaaaacuauaguagcaauauuuaaaucguccgacaaucgacaagaaaagguaaagaaaauccuaucauacuuccaacaagaacugcuaaagaaagauaaaucaauuuucaaacaacuauuacaacuacuauucgggcugaaaaccaaauucaaagauugcuuugaacuagaagaagaaccagaccuaaacuucucaaaagagaacuaugaugaaaauuuagaaaacuuccuaggaucuuuagaagaggauuuuucagauguuuuugcuaaacuuaaaguauugcgagacacuaucuuacuuucaggaaugcucacguauaccggaacaacacgagcucgauuuuccgccacgauggucgaacgcuacgaagaacauagaaaagacuuacaaagauucaaaucauucgucaaacaaaaccuaagcgagcaagacuauuuagauauauucgguagaaaaacacccaauggcuucgacguggauaaagaaacaaaagguuacguaggcuacauauccaacaaaaugguacuuacuaacccccaaaaacagaaaacaauacaacaaaacuuuuacgacuauauauccgggaaaauaacaggaauagagggcgcugaauauuucuuaaacaaaauuucagacggcacauuccugcgcaaacugcgcaccacggacaauggagcugugccuaaucaaauacaugcauaugaacuagaaaagauaaucgaccggcaaggcgaggacuauccauuccugcuagaaaacaaagauaaacuacuaagcauacucacauucaaaauaccguauuacgugggaccacuaucuaaaggaaacaauuccagauucgguuggaucaaaagaacaauaucacaagauauacuggaugauaacgaugaagacaccagaaacgggaaaauacgaccuuggaauuaccaaaaacucauaaauauggacgaaaccagagacgccuuuauaacuaaucuaauugguaacgauauaauccuauuaaacgaaaaaguacucccaaaacgcuccuugauauacgaggaaguuaugcuucaaaacgagcuuacccgaguuaaauacaaagacaaauaugguaaaacccacuucuuugacucagaauuacgccaagaaauaaucaacaaccucuuuaaaacaaacaacaaaagaguaucauccgccauguuacucgauuacuuagaaaacuacaccaacuugcaagcaguugaaauuguuucaggcauagaaaaagguaaaucuuuaaacuccacguuaaaaacauauaacgauuuaaaaacaaucuuuucagaggaguuauuagacucagaaauauaucaaaaagaacuagaagaaauuguuaaaguaauaaccgucuuugacgacaagaaaaguaucaaaaauuaccuaauaaaauauuucggacacuuagaauuuuuaaacgaagaaagaauaaaccaacucucaaaacugagguacaccgggugggggcgauacagcgcuaaacuacuccuagacauacgcgacgaagauaccggauuuaaccugaugcaauuucugagaaacgaugacgaaaacagaaacuuaucucaacuuauaucagacucaacauugaguuuugacuccgcaaucaaaucaauccaaagcaaaucuacaguagaagaugauguauucgacgagauuaagaaacuagcuggaagcccugccauuaaaagaggaauacucaacucuauaaaaauuguggaugaacuuguccaaauaauaggcuacccgccacaaaauauaguaaucgaaauggcccgagaaaacaugacaacugaagaaggacaaaagaaagcaaaaacaaggaaaaccaaacuugaaucggcacucaaaaauauagaaaacagcguuuuagaaaauggcaaagucccacauuccgacgaacaacuacagagcgaaaaacucuauuuguacuauuuacaaaacggaaaagacauguauucauuagauaaaacagguucaccuacaccucucuacagagaucaguuagaucaauaugaaguagaucacauaauuccauauucauucuuaccaaucgacucuauagacaacaaaguccugacccauagagaaaacaaucaaagaaaacuaaacaacauaccagacaaagagaccguugcaaacaugaaaccauuuugggaaaaacucuauaaugcaaaacuuauaucacaaacaaaauaccaaaggcuaacaacaucagaaagaacacccgacggggugcuaacagaaaguaugaaagcaggcuucaucgaaagacaauuaguagaaaccagacaaauuauaaaacauguagcccgcauacuagacaauagauucuuagacacaaaaaucaucgcucugaagucacaauuaauaaccaacuuuagaaauacuuuccacauugccaaaauacgagaacucaaugauuaccaucacgcacacgaugcauaccuggcaguagucguuggucaaacacuuuuaaaagccuaucccaaacuagcuccagagcuaauuuacggacaccacgcacacuucaacagacacgaagaaaacaaagcgacaauaaggaagcaccuuuacucgaauauaaugcgauuuuucaacaacccagacaguaaaguuucaaaagacaucugggauugcaaccgugaccugccuauaauaaaagaaguaauauauaacucacagguuaacuucguaaaacgaacaaugaucaaaaagggcgcauucuacaaccaaaauccaguaggaaaauucaacaaacaaauagccgccaauaacagauacccauuaaaaacaaagguuucuucacucgacaccuccauauacgguggcuauggcccuaugaacucugcacucagcauaauaauaauagccgaacguuuuaaugaaaagaaaggaaaaauagaaacaguuaaagaguuccaugauauuuuuauaauagacuacaagaaauuuaacaauaaccccuuucaauuucuaaacgacacaucagaaaauggauucuuaaagaaaaauaacauaaacaggguauuagccuucuacggaguucccaaauacagcuugaugcagaaaaacgauggaacuaggauguuauuugaaaguaaaucaaaucuucacaaagcaacccaauucaaacucacuaaaacacaaaaugaauuauucuuucauaugagaagacuauuaacaaaaagcaaccuaauggauuuaaaaucugaaucagcaaucaaagaaucacaaaacuuuauacuaaaacauaaagaagaauuugacaacauaucaaaccaauuaucagcauuuucacagaaaaugcucggagacacaaccucacugagaaaccuuauaaaaggauacaacgaaagaaaaauaaaagaaauagacuccucagaagaaguaauuaaauacuucuacgacaacuucauaaaaauguucaguuuuguuaagucaggugcuccaaaagauauaaacgacuuuuucaauaacaaauacacgguagcucguaugcguccaaaaccagacaagaaguuuuuaaaugcaacacucauacaccaaucgauaacuggucucuacgaaaccagaauagaccugucgaaauuaggagaagacuga

SEQ ID NO: 5644 - RNA, 4263 nt, Artificial Sequence
  Cas9 variant
auggcaaaguuuaauaaaaacuauaguauaggucuagacauaggaguaagcaguguaggauacgcagucguaacagaagacuaccgaguaccagccuuuaaauucaaagucuuaggaaacacugaaaaagagaaaaucaagaaaaaucuaauagguuccacaacauucguccccgcacaaagugcacaaggaacaagaguauuccgaguaaacagacgccguaucgaccgcagaaaucaccgaauugcauaccuacgugauaucuuucagaaagaaauagagaaaauagauaaaaacuucuauagacgacuagaugagucauuuagaguucucggcgacaaguccgaagacauucaaaucaaacagcccuuuuucggaaauaaagaauuagaaacagccuaucacaagaaauacccuacaauauaccaccucagaaaacaccuagcagaugccgacaagaacuccccuguagcugacaucagagaaguauauaugguucuaucgcacaucuuaaaauauagaggccacuuccucacgcugggcaaaauagauccaaauaacauaaauaugcaaaacaguuggauagauuuuaucgaaaguugccaagaugcauucgacuuagaaaucucagacgaaagcaaaacaauagcagccaucuuuaaaagcagcgaaaaccgucaagaaaaagucaaacaaauacugaguuauuuccaacaagaacuauuaaagaaagauaaaucaauuuucaaacaauuacuacaauuauuauucggauugaaaacaaaauucaaagacuguuuugaguuagaagaagaacccgacuuaaauuuuaguaaagaaaacuaugacgaaaaucuugaaaaucugcucggcgcacucgaagaagauuucucagauguauucgccaaacuaaaaauacuacgggacaccauccugcucagcucuaugcuuacguauaccggugccacccaugcuagauuuucggcaaccaugguagaaagauaugaagaacaccguaaggaccuccaaagguucaaaucauucguaaaacaaaaucuuucagaacaagauuaccucgacauauucggaagaaaaacaccaaccggauucgacguagacaaagagaccaaggguuauguaggauauaucucuaacaaaaugguccuaacaaauccacaaaaacagaaaaccauacaacaaaauuuuuacgauuacaucuccggcaaaauaacuggaauugaaggagcagagugcuuucuaaacaaaauaucugacggaaccuuuuugagaaaacuucgaacuacugacaauggugcaauaccuaaucaaauacaugcauaugaauuggagaaaauuaucgaaagacaaggucgugauuauccauuccuacuagaaaauaaagauaaacuucucucaauccucacauucaaaaucccauacuacgucggcccacucgcuaaaggaaauaacagucgcuucgcauggauaaagagaaccacaucacaagauguacuugaugauaaugaugaagacacgcguaauggcaaaaucagacccuggaacuaccauaaacuuauuaacauggaugaaacccgagaugcguucauaauaaaccuaauaggaaacgacauaauucuucucaacgaaaagguucuaccaaaacgcagcuuaauauacgaagaaguaaugcuccaaaaugaacuaacaagaguaaaauacaaggacaaauacggcaaaauacauuucuuuaauagcgaacugagacaagagauaaucaacaacuuauucaaaacuaacucaaaacgagucucaagugcaaugcuacuaaguuaccucgaaaauuucaccaaccuacaagcaguugaaauaguuucgggaauagaaaaagggaagucgcuaaauucaacucuuaaaacuuauaacgauuuaaaaaccauauuuucagaagaauuauuagacucugaaauuuaucaaaaagaauuagaagagauaauaaaaguaauaacuguuuuugacgacaagaaaucuauuaaaaacuauuuaacaaaauacuucggacaucuagaguucuuaaacgaagagaaaauaaaccaacuaucaaaacuaagauacacuggguggggccguuauuccgguaaacuacuuuuaggaauaagagacgaagacacaggcuucaaccuaaugcaauuucuacgaaaugacgacgaaaacaggaaucuaacacaauuaaucagcgauacaacccugucauuugacucagcaauuaaagcaauccaauccaaaaguacuguggaagaugauguuuucgaagaaaucaaaaaccuagcagguagcccugcaauaaaaagagguauacucaauucaauuaaaauugucgacgagcuuguacagauuauaggcuacccuccccaaaauaucauaauugaaauggcuagagaaaacaugacuacagaagaaggccaaaagaaagcaaaaacaagaaaaucaaaacucgaaucagcacucaaaaacauagaagacucuguauuagagucaggaaaaguaccccauuccgaugagcaacuccaaagugaaaaacuuuaccuauacuaucuucaaaauggaaaagauauguacucucuagacaaaacaggaagcccaaccccucucuacagagaccaguuagaccaauaugaaguagaucacauuauuccauauucauuccucccaaucgacucaaucgauaauaaaguccuaacccaccgagagaauaaccaaagaaaacugaauaacauaccugauaaagaaacaguggccaacaugaaaccauuuugggaaaaacuauacaacgcaaaacugauaucacaaacaaaauaucaaagauuaacaacuucagagagaacacccgacgguguucucacggaaagcaugaaagcuggcuuuauagagagacaacucguugaaacccgucaaauaauaaaacauguagcacgaauuuuagacaacagauucuccgacaccaaaauuauuacauuaaagucacagcuaguaacaaacuuccgaaacacauuucauauagccaaaauaagagaauuaaaugacuaccaucacgcucacgacgcauaucuagcuguugucgugggacaaacucuauuaaaagcauaucccaagcuagcaccagaacuaauuuacggacaccacgcacauuucaauagacacgaagaaaacaaggcaacccuaagaaaacacuuauacucuaauauuaugcguuucuuuaacaacccagacagcaaaguaagcaaagacauaugggauuguaacagggaccuuccuauaguuaaagacguuauauauaacucccaaaucaacuuugugaagcgaacuaugauuaagaaaggagcauuuuauaaccaaaauccuguugggaaacuaaauaaacaaauagcagcuaacaaucgauaccccuuaaaaacaaaaguuagcagccucgacacaaguauuuacggugguuacggucccaugaacucagcacugucaaucauuauaaucgccgaaagauuuaaugaaaagaaaggaaaaauugaaacugucaaagaguuccacgacaucuuuauaauagauuaugaaaaauucaacaacaauccauuucaauucuuaaacaacguuucagaagaaggauuccuaaagaaaaacgacuuaaacagagucuuagccuucuaccgcaucuccaaauauagccuaaugcagaaaaucgacggcacaagaaugcuauucgaaaguaaaucuaaccuccauaaaguaacacaauuuaaacuaacaaagacccaaaacgaauuauuuuuccacaugaaacgcuuacuaaccaaauccaaucuaauggaccuaaaaucugaauccgccaucaaagaaucccaaaacuuuauacaaacccaucaaaacgaauuugauaacaucgcugauagacuuucaaauuacucacaaaagaugcuaggcgaaaccaaaucauuacaaacccuaauuaauggcuacaaugaacguccgauuaaacagauagauaacaaugaagaaacuauaagauauuacuacgacaacuuuauuaaaauguucucuuuuguaaaaucaggagcacccaaagacaucauaaauuucuuuaaugacaaauacacaguaccucgaaugagaccuaagccagacagaaaaaugcuagacgcuacacuaauacaccaaucaauaacaggucucuacgaaacgcgaauagacuuaagcaaacuuggugaagacuga

SEQ ID NO: 5645 - RNA, 4263 nt, Artificial Sequence
  Cas9 variant
augucacguaaaaauuacguagacgauuacgcaauuagcuuagacauaggaaacgcaucagucggauggucagcguucacacccaauuauagauuaguaagagccaaaggacaugaacuaauaggaguacguuuauuugauccagcagacacagcugaaaguagacggauggcgcguacaacucguagacgguauucgagaagacgauggagacuaaggcuccuagacgcucuauucgaucaagcucuuagcgaaauagacccauccuuccucgcacgaagaaaauauagcuggguacauccagaugacgaaaauaacgccgacuguugguacggaagcguauuauuugacucaaaugaacaagacaaacguuucuaugaaaaauauccaacaauauaccauuuacguaaagcauuaauggaagaugacucacaacaugauauacgagaaauuuaucuggcaauucaccacaugguuaaauaccgagguaauuuccuaguggaaggaacuuuagaaagcucuaaugcguuuaaagaagaugaauuauugaaacuccuaggccgaauaacaagauacgaaaugagcgaaggagagcaaaacagugauauagagcaagacgaugaaaacaagcuaguggcgccagcaaauggacaacuagccgaugcacuuugcgcuacaagggggucgagaaguaugagggucgacaaugcuuuagaggcuuuaagugcagugaacgauuugucaagagagcagagagcaaucgugaaagcaauuuucgcgggacuugaagguaauaaacuagaccuugcaaaaauauuugucaguaaagaauuuucaucagaaaauaagaaaauauuaggaauauauuuuaauaaaagugauuacgaagaaaaaugcguacaaauaguagauagugguuuauuagaugaugaagaaagagaauuuuuagauagaaugcagggacaauauaaugccauagcgcugaaacaauuacucggucggucgacaucuguaagugauuccaaaugugccucauaugacgcacaucgugcaaauuggaaucuaauaaaacugcaauuacgaacaaaagaaaaugaaaaagauauaaacgaaaacuauggaauuuuaguuggcuggaaaauagauagcggacaaaggaaaucuguaagaggagagagugcauacgaaaacaugcgaaagaaagcaaauguauuuuucaagaaaaugauugaaaccagcgauuugucagagacugauaaaaaccgacugauacacgacaucgaagaagauaaacuauucccaauacaacgagacagcgacaauggcgucauaccacaucagcuacaucaaaaugaauugaaacaaauaaucaagaaacaaggaaaauacuauccauuccuuuuagaugcauuugaaaaagauggaaaacagauuaacaaaauagaaggcuuguuaacauucagagugcccuauuuugucggaccgcuagugguaccagaagaucuacaaaaaucggacaauuccgagaaccacuggaugguuagaaagaagaaaggcgaaauaacuccauggaauuucgacgaaaugguugauaaagaugccucaggucgaaaauuuauagaacgauugguaggaacagacuccuaucuacuaggagaaccaacucuuccuaaaaauucauuacuuuaccaagaauaugaaguacuaaacgaacuaaacaacguaagacuaucaguaagaacagguaaucauuggaacgauaaaagaaggaugcgauuaggcagagaagagaaaacuuuauuaugucagagacuauuuaugaaaggucaaaccguaacuaaaagaaccgcagaaaaucuccuaagaaaagaauacggaagaacuuacgaacucucagggcugagcgaugaaaguaaauuuacgagcucauuaucaacauacggaaaaauguguaggauauuuggagaaaaauacgugaaugaacauagagauuuaauggagaaaaucguugaauuacaaacaguauucgaagauaaagaaacauuauugcaccaacuaaggcaauuagaaggaauaucugaagcugacugugcacuuuuagugaauacacauuauaccggauggggucgacuaucaagaaaacuacuaacaacaaaagccggggaauguaaaauaagugacgacuuugccccacgaaaacacucaauaauagaaauaaugcgagcugaagacaggaaccugauggaaaucauaacggauaaacaauuggguuuuagcgauuggauugaacaggaaaauuuaggagccgaaaauggaagcucauuaauggaaguaguagacgacuuacgaguaucaccaaaaguuaaaagaggaauaauacaaucuauucggcuuauugacgacauuucaaaagcuguuggaaaacgaccaagucgaauauucuuagaacuagcagaugauauacagccaucaggcagaacaauuagccgaaaauccagacuccaagacuuauauagaaacgcaaaccuaggaaaagaauuuaaagggauagccgaugaacucaaugcaugcagugauaaagaccuacaggaugacagauuguuccuauauuacacacaauugggaaaagacauguauacaggcgaggaacucgauuuagaucgacucuccagugcguaugacaucgaucacauuauuccacaagcugugacucaaaacgauaguauagacaaccguguauuaguggcgagagcagaaaaugcacgaaaaacugacucuuucacauacaugccacagauagcagaccguaugcgcaauuuuuggcaaauacuacuagauaacggucucauaucaagaguaaaauuugaaagacuaacucgccaaaaugaauuuuccgaaagagaaaaagaaagauucguacaacgcagcuuaguugaaacuagacaaauaaugaaaaacguugcgacucugaugagacagcgguaugguaacagugcagcuguaaucgggcuuaaugcagaauuaacuaaagaaaugcauagauaucuaggauucagucacaaaaauagagauaucaaugauuaucaccaugcacaagaugcucugugcguagggauagccggacaguucgcagcaaaucgaggauuuuucgccgauggagaaguaagcgauggcgcucaaaacagcuauaaucaauaccuacgcgacuaucuuaggggcuauagagagaaauugucagccgaagaucgcaaacaaggacgagcguucggauuuauuguaggaucaaugaggucgcaagaugaacagaaaaggguaaauccuagaacaggugaaguuguauggagugaggaagacaaagauuaccuucgaaaaguaaugaacuaccgaaaaauguuagugacccaaaaaguaggagacgacuuuggagcuuuauaugaugagacaagauaugcugcuaccgauccaaaagggaucaaagggauacccuucgauggagccaaacaagacacaagucuauauggagguuucagcucugcaaaaccagcauaugcgguucuaauagaaagcaaaggaaaaacuagacucguuaauguaacgaugcaagaauacaguuugcuaggugauagaccaagugaugacgaguuaagaaaaguacuagcuaaaaagaaaucagaauacgcaaaagcaaauaucuuacuaagacauguuccuaaaaugcaauugauacgauauggaggaggauuaaugguaauaaaaagcgcgggggaguuaaacaacgcccaacaauuauggcuaccauaugaagaauacugcuauuucgaugauuuaucacaaggaaaaggaucucuugaaaaagaugauuugaagaaacuucucgauucgauacuuggaucggugcaaugucuauaucccuggcacagauuuaccgaagaggaacuagcugauuugcauguagcguuugauaaacuaccggaagaugaaaagaaaaauguuaucacuggaauuguaagcgcguuacaugcagaugcaaaaaccgcaaacuuaaguaucgucggaaugacugguucauggcgcaggaugaauaauaaaucaggauacacauuuuccgaugaagaugaauuuauauuucaaucacccucuggguuauucgagaaaagggugacgguuggggaauuaaaaagaaaagcaaagaaagaaguaaauucaaaauacaggacaaacgagaaaagacuaccuacgcuuaguggagccucacaaccauga

SEQ ID NO: 5646 - RNA, 4263 nt, Artificial Sequence
  Cas9 variant
auggcaaaaccaaaagauuauacuauaggacuagauauuggaacaaauaguguaggauggguugugacagacgaucaaaauaauauacuuagaauaaaaggcaagaaagcuauaggagcacgucuauucgcagaaggaaaaguagcugcugaaagacgaucauuucguacgacaagaagaaggauaagucgucguagauggagaauaaaauuauuagaagaauuauuugaugaagaaauagccaaaguagauccaaguuucuuugcuaggcuacaugaaagcuggauauccccaaaagacaaaagaaaacgauacucagccauaguuuuuccuagcccagaagaagauaagaaauuucaugaaaguuacccaacaauauaccaccucagagauaaacuaaugaaagacgaucaaaaacaugauauaagagagaucuacauagcaguucaucaaaugauaaaaguucguggaaacuuucugcaugaugaaucugucgaaacauaucggucugguaugaguucucuaggaggaagaagcgaaagaaccauccuaagcguacaaacacuugaagaauugaacgaucuauucgcagaaaaugaaggaacagaagaaguagaacucaacgucgcguccgccgaacaaaucaaugacauauuaacgggugaucaucuaaacgcagacucucaaaaagaaauuagcaacuuacuuuuaccaucaucauuucccucauucgacgacaaagccaaagaaaaacaagugaagaaacugauaaacaacguagccacuaauauaaguaaagcauggcuaggauauaaagcagacuuuucaacaauacucaacuuagcaaaaguagacaaagaucagaagaaaauauucgcguucgcacuccaaggaggagacgaagaagauaaaguacaagaauuagaaagucuccucgaacaaucccaaacagauaucguugauagacuuauugaaaucaggcacgcaauagugcucucugaaauaguaccaguaggaaugacauuaagcgaggcaaugauagacaaauaugaucaacauaaagaagaccuaauuacauuaaaagccguuauuagaaacacaaaagacaaaaagaaagccgccaaacuucaagcuauauacgaccuauauguaaacaacagacaugcagaucuugcuaaagcgaugaaacucacaggaaucaagaaacgaucagaacuacuugacccagaggaauuaaagaaagcuauaucgagccuuuuagacgauucuccagaagcuggggagaucaaacaaagacuugaagggaaaacuuuucuuccauuacaaagauccaacaacaaugguguaauaccaaaucaacuccaccaaguugaguuagacgaaaucaucaagaaacaaagcaaauacuacccauuucucgcggagaaaaaucccgacgaaucggaggaggcacagaagaaagcuccuacaaaauuagacgcauuacugacuuuccgugugccauauuacguaggcccuaugauuacaaaagaagaacaagaagcacaagacggucacaguuucgcauggaugguaagaagagacccacaagaccacgaagcaauaacaccuuggaauuucgagaagaaaguugacaaaauggcaagugccacacaauucaucaaaagaaugacaacaaaagacacauaucuauuaggagaagacguuuuaccagccagcucacuaaaauaucaauuauucacuguauuaaaugaguugaacaaucuacgaguuaauggcaagaaacuuacaagugacgaaaaagagcaagucauagaaggcuuguuuaagaaacagaaaacaguaaaagccgauaaauucguaaaauacuggcaagcaauacacaucggcgcagacauaaaagucaaaggacuuucagauccaucgaaauuuaacucaacaaugucaacuuacauagacuuuaagaaaauauucggugaucaacucaacgaugcgaaccgccaaaacgacuuugagaaaaucaucgaauacucaacgauauuugaggauagaaaaauccuagaagacaaacuucgagcugauuuugcuuggcuaagcgaagaacaaauaaaacaauuaugccgucuaagacuucaaggauggggccgguuaucagauaaauuacucacgagguugacagacgcagacggacaaaauguacuagaaagacucuggaacuccaacgacaauuucguacaaauaguuagcgacccgaacauuaaagcaaaaauagaacaagaaaaucaaaaacuguuacgcgauggacaaucagaugacgcuguagaauccauauuagacgacgcauacacaucaccacaaaacaagaaagcaaucagacaggugaugcgcguaguacaugacauaguaaaagccugcgacgguaaugugccugcaaaauuugcuauugaguucgcacgaagucaagaagaugacccaaaaaggacuacagcgaggguaaaccaaaugcagaaaauauacgaucaaauuucggacgaaguagucucacaaggcguaaaagaacaacucucgggaaugaaauccuuaaaagaccgguauuauuuguacuuuaugcaagguggacgagaugcauacacaggagcuaaacugaauaucgaccgauugucagauuacgauaucgaccauauaaugccgcaaucauuugucaaagacgacucccucgacaacagaguucuuguugcaagagcagucaauaaccaaaaauccgauaaaguuccagcuuucuuauucgggaacaaagugguagcagaucuaggaauaacuguuagagaaaugugggauaaauggcaaaaacuaggaaugauaaguaaacgaaaauuaucaaaccuacuaacagauccagaugcacuaacagaauaucgagcccaaggcuuuauacgccgccagcuaguugaaaccagucaagucauaaaacuuacagcuacuauccuacaaagcgaauuuccagacucaaaaauaauagaaguaccagcaaaauacaacucuauaguuagaaaacaauuugaucuuuauaaaaguagagaagucaacgauuuucaccaugcaaucgaugccuaccuguccacaauaguaggaaacuaucuguaccaaguuuacccuaacuuacgcagaauguuuguuuauggagaauuuaagaaauuuucaucaaacgcagaggaaucagcacaugacauggcuagaagaguuaaaucuaugaauuuccuagaugaccuacuaagaggaacacauggagacaacauauauuguagauccaccggugaaaucgucuucaacagaaaugauauaaucagcaaacuaaaacaggcuuauaguuuuaaacaaaugcugguaacacaagaagucuucacuagaaaaucugcccuuuucgaccaaacagucuaccccucacccgagagggauagcaagaaaagaaguggcuuaauuccaaggaagaaaggaauggauacggaaauauacggaggauacaguggaaauaaagaugcauauuuugugcuagcagaggcaguaaaagaaaaaggacauacucuacaaaucguaggcgucccgauacgagcacugaauacacugaaaaauucagcaaacuauucagaaaaauuacuugaaauuauaaaaccacaaguaauguuuaacaagaaaaaugguaaaccuaagaaagguguaaaugauguaaggauauuaauggauaacaucccguauagacaaccuguacuagaagggggagcuuuauauauguuagguagcagcacauauaaauauagucucaaacaaauuacauuaagccaggaaucaaugaaauauauauuagacuauauugacgaccccagcuucaauaaacacauuauggugaacauagaucaucaagaugagaagaaaugccuacuaucaguauaugacgaaauuuuagauaaaauggacaaauaucuaccauuauucgacauaaauggauuccgcaaaaagcuccaugacggacgagaaaaauuuguaaaacuuccuguagagaaacaagccgaaguuguaaaggauauacucagagggcuccaugcuaacagugaaaugacuaaaccaucagaucucggccuaacaacagcauuaggauucaugcaagcaccagauggcauaaaaauauccgaugaugcaguauuuauauaucaaucgccgacagguuuauuugaaagacgugucaaagugucagauuugcuaaaauga

SEQ ID NO: 5647 - RNA, 4266 nt, Artificial Sequence
  Cas9 variant
augacaaaauucaauaaaaacuacucaauaggcuuagauaucggaguuaguagcgucgguuaugcaguaguaacagaagacuaccgaguacccgccuucaaauucaaagucuuaggaaacacugaaaaagaaaaaauaaaaaaaaaucucauaggauccaccacuuuuguaagcgcccaaccagcuaaagguacacgcguauuuagaguaaacagaagacgaaucgaccggagaaaccacagaauuacauaccuacgugacauauuucagaaagaaauagaaaaaguugauaaaaauuucuauagacgauuagaugaaagcuuuagaguucuuggagacaaaucagaagaccuucaaauaaaacaaccauucuucggggacaaagaauuagagacagcguaccauaaaaaauacccaacgauauaccaucuacgcaaacacuuagcagacgcagacaaaaacucuccagucgcagacauacgcgagguuuacauggcgauaucgcauauuuuaaaauauagaggucacuuuuuaaccuuagacaaaauaaacccaaauaauauuaacaugcaaaauucauggauagauuucauugaaucaugccaagaaguauuugauuuagaaaucagcgacgagucaaaaaacauagcggauauauucaagucaagcgaaaaccgacaagaaaaaguaaaaaaaauucucccauacuuucaacaagaacugcuaaaaaaagauaaauccauauucaaacaacuucuacaauuacuuuucggucucaaaaccaaauucaaagauuguuuugaguuagaagaagaaccagaccucaacuuuucaaaagagaacuacgacgagaauuuagaaaacuuucucggcagcuuagaagaagacuuuagugacguauuugcaaaauuaaaaguccuucgagauacuauacuauuaucagguaugcucacguauacaggagcaacacacgcacgauucucagcaaccauggucgaacgguaugaagagcaucgcaaagaccuucaaagauuuaaauucuuuauaaaacaaaaucuaagcgaacaagauuaccucgauaucuuugguagaaaaacucaaaacggauucgaugucgauaaagaaaccaaaggcuacgucggauacaucacuaacaaaaugguucugacaaacccacaaaaacaaaaaacaauacaacagaacuuuuacgacuacauuagcgguaaaaucacaggaauagaaggugcagaauacuuccuaaacaagauaucagacggaaccuuccugcgaaaguuaagaaccucagauaauggcgcaauaccaaaccaaauccaugcauacgaacucgaaaagauuaucgaacgccaagguaaagauuacccauuccuguuagaaaauaaagacaaacuacuaagcaucuuaaccuuuaaaauccccuacuauguuggaccacuugcaaaaggauccaacucacgauuugcuuggauaaaaagagcgacuucaagcgacauuuuagaugacaaugacgaagacacuaggaacggaaaaauacguccauggaacuaccagaaauuaauaaacauggaugaaacacgcgacgccuucaucacuaacuuaauaggaaacgacaucauccucuuaaaugaaaaagucuuacccaagcggagccuuaucuacgaagaagucaugcuucaaaacgaacuaaccagaguaaaauacaaagacaaauauggaaaagcacacuucuucgauagcgaacuaaggcaaaauauuauaaacggccuauuuaagaacaauucuaaaagaguaaacgccaaaucauuaauaaaguacuuaagcgauaaccauaaagaccuuaaugcuaucgaaauuguaucuggaguugagaaaggaaaaucuuucaacagcacacuaaaaacuuauaaugaccuaaaaaccaucuucagcgaggaauuauuggauagcgaaauuuaucagaaagagcucgaagaaauaauuaaaguaaucacaguuuuugacgauaaaaaaucgauaaaaaacuaucuuacuaaauucuucggucacuuagaaauucuagaugaagaaaagauuaaucagcucucaaaacuacguuauuccgguuggggaagauacagugcuaaauuacuucucgacauacgugacgaagauacaggauucaauuuacuacaauuccuccguaaugaugaagagaacaggaaccuuaccaaauuaauaucagacaauacccuaagcuuugagcccaaaauuaaagauauacaguccaagucuaccauagaagacgacaucuucgacgaaaucaaaaaacuagcaggcucgccagccauuaaaagaggcauccucaacucgauaaaaauaguugaugaacuaguacaaaucaucggauacccuccacauaacauagucauagaaauggcaagagaaaauaugacuaccgaagaaggucaaaaaaaagcaaaaacacguaaaacaaaauuagaaucagcacuaaaaaacaucgagaacucacuauuagaaaacggaaaaguaccacacuccgacgaacaacuacaaagcgagaaacuuuaccuauacuaccuucagaacggcaaagauauguacacacuagacaaaacugguucaccagcaccacuauaccuggaccaauuagaucaauacgaaguugaccacauaauaccauauucuuuccuccccauagauucgauugacaacaagguauuaacucauagagaaaacaaucaacaaaaauuaaacaacauaccagacaaagaaaccguugcaaauaugaagcccuucugggaaaaacuauacaacgcaaaacuaauaagccaaacaaaauaccagagacuuacaacaagugaaagaaccccagacgguguucuaacggaaucaaugaaagcaggcuuuauagagagacaacuaguagaaacgcgacaaauuauaaaacacguagcucgaaucuuagacaaccgauuuuccgacaccaaaauaauaacacuaaaaucgcaacucauaacaaacuucagaaauacguuccacauagcaaaaauucgagaacuuaacgauuaccaccaugcacacgacgcauaccuugcaguagucguaggacaaacauuauuaaaaguuuacccaaaacuggcacccgaauuaauauauggccaucaugcacacuucaaccgacacgaagaaaacaaagcaacccucagaaaacaccuauauagcaacauaaugagauucuucaacaaucccgauucuaaaguaaguaaagacauaugggauugcaaucgagacuuaccgauuauuaaagacguaaucuauaacucacaaaucaauuucguaaaacgaacaaugauaaaaaaaggagcauuuuacaaucaaaauccaguaggaaaauuuaacaaacaacuggcugcaaacaaccgauauccacuaaaaaccaaggcauuaugcuuagauacgaguauuuauggcggcuacggcccaaugaacuccgcucuaucaauaauaauaaucgccgaacgguuuaacgaaaaaaaaggaaaaauagaaacggucaaagaguuccaugacauuuucaucauagauuaugaaaaauuuaacaacaauccuuuucaauuccuaaaugauaccagugaaaauggauuucuaaaaaaaaauaacauuaacagaguacucggcuuuuaccguauucccaaauacagucuaaugcaaaaaauagacggaaccagaaugcuauucgaaagcaagaguaauuuacacaaagcaacacaauuuaaauuaacuaaaacacaaaacgaacuauucuuucacaugaagagauuauuaaccaaaucaaauuuaauggaucuaaaaucuaaaagcgcgauaaaagaaucacaaaacuucauacucaaacacaaagaagaauucgacaauauauccaaucaauuaagugccuucucccaaaaaauguugggaaacacaacuucucuaaaaaaccugaucaaaggauauaaugaaagaaaaauaaaagaaauugacauaagggaugaaaccauaaaauacuuuuacgauaauuuuauaaaaauguuuucauucgucaaaucaggggcucccaaagacauaaacgacuucuuugacaacaaauguacuguagcuagaaugcgaccaaaacccgauaaaaaauuauugaaugcgacccuuauacaccaaagcauuacuggacuauacgagacgcgaauagaucuaagcaaacuaggugaagacuga

SEQ ID NO: 5648 - RNA, 4266 nt, Artificial Sequence
  Cas9 variant
augaagaaaauauugggacucgaccuaggucccaacaguaucggaugggccuuaguaaacgaagcagaaaaugaaaaugaaaaauccagcaucaucaaaauuggaucaagggucauccauuauggagauaaccuugucaaagucgauaaaucggguaaaaucucugcaucaaugacaccagaagaagacuucaguucuggaaaaggauuaucaccgaacgcgggacggacaaaacaaaggucagcacgaagaaacuuacaacgauacaaacaacgacguaauaacuuaauagaaauccuaaaagcacacucccuaauagauaauaauuucauauucucagaagaaggaaaugaaacaacuuucaaaacauacaaaaaucgagcccuagccgccacaaaugaaauaucacuagaagauuucauuaaaguacuuuuuaugaucaauaagaaacguggauauaaaaguaguagaaaagcaaaaggagaugaagacggucaacuaaucgacggaauggcaauagcaauucaauuauacgaacacaaccaaacuccaggacaauuuguauacaaccuacucaaaaacggcaagaaaaacauuccagauuuuuaucgguccgaccuacagaccgaauuugaccgcauauggaauuuucaaaaagcauuccaccaagaaucauuaagcgauggaaucugcgaaaaauugguaggacagaagaaaaauguaacaagugcgauacuauucaaagaguucaaaauagaaucucuugaaaucaaaggaaaaugggacgagaaaagauucuucagauacgaacuaagaaacaaagcugugcaacaagaacuuaaacuaaacgaaauagcagaauguuuaguagaaauaaacggcgaaauauccaacagcaguggauaucuuggcgcaaucagugauagaucuaaagagcuagucuuucagaaaauaaccguaggacaauauuuauacaaacaaauagccgcaaacccgaauacaagccucaagaaacaaauauucuaccgccaagauuaccuugaugaguucaauacacuaugggaaacccaagccaaauaucauaaagaacuuaccgaugaauuaaaaacucagauacgagauguaauaauuuucuaucaacgaagacuaaaaucccaaaaaggccuaauaucauuuugcgaauuugaaucaaaacaaauugaaguauucguugacggcaagaaaaguaucaaaacgcgaggcaugagaguaauuccaaaaucaagcccuuuauuucaagaguucaaaauauggcagauucuaaauaacauagaaaucacagaucucaaaacaaaagagucccgcgaauuaacagacgacgaaagacagcuacuauuugaagaauuaaacauaagaccaaaaauaagcaagaaagaagccuuaaaaauauuaacagaaaaaccagcacaauacgauuuaaacuacaaagauaucgaaggcaauaaaacuaacgcaaaauuuuaugaagcauacaauaaaauuauacaccuuucaggacacgacgagaucgacuuuacagauaaaacgucagauauaaaugaauaccuaaaacaaauauuuuccuuauuaggaauaaaaccagagauccuagauuuugacaguucauuaaaagaugaggacuuugaaaaacaacuacauuuucaacuuuggcacuugcuuuacucguuugaaggugacaauaccaaaaccggcgacgaaaaacuacugcaaaaacucaacacuaaauucggcuucccagucgaguaugccaaaguaauuucaaauaucgcucucccagaugacuacgguucauuaagugcaaaagcuauuagaaaaauccuaccacacuuaaaagauggguuuucauacggcggaaggaaaucgagacccgacgaacccucagcaugugaguacgcggguuauagacauucuaaagcaucauuaacgaaagacgaaaaagaaaacaaaacauacaaagacaaauuagaaauccuacccaaaaauagccuaagaaacccaauuguagagaaaauacuaaaccaaacaauuaauguaguuaacgcuguuaucggagauuaugguaaaccugaugaaauacgacuagaacuagcaagagaacucaagaaaucagcagaagaaagacaagacgccaccgauaguaucucuaaagcgacagcaaaacaugaaaaauaccgaaaaguccuccaaacugaauuuggauuaaaacacauaaguagaaaugacuuaauacgauauaaacuauaucucgaacucaaaaacaacggguuuaaaacucuauacagcgacacuuacauagcacccuacgaaauauucagcaagaaauucgauauagaacacauacuuccgaaagcaaaacucuuugacgacagcuuuuccaauaaaacacucgaacucaaaucuguuaacuugaagaaaggugauaugacagcauaugacuuuguaaaagaagaauacgguacugaaggucuagcuaaguacgaacagagaguccaagacuuauuucuaaacaagaaacgaaaugaggaccuagaucaagaaaacgaaagucgcauuaccgacgagaaaauaucgaaaacuaaaagagacaaauuacuuaugccagaaaauaaaauacccaccggcuuuauagaucgagaauuaagggacucgcaauacauugcgaagaaagcaaaaaccaugauggaagacauaugcaaagauguaguaacaacuacuggaaguguaaccgacaggcucagggaggacuggcaacuaaucgacauaaugcaggaacuaaauuggccaaaauacgccgcacucggcuuaacagaagaguucacaaaugaagaaggcaacguaauaagaaaaauaaaagacuggacgaaaaggaacgaccaccgacaccacgccauggaugcaauaacuauagcauucacuaaacgaucucacauacaauauuuaaauaaccugucugcaagaucagauaaaaguucgucaauuuauggcauagaacaaaaagaacuauauagagacaaaaacaacaaacuaagauucgcaccacccauaccaauaaacgaauuucgagcagaagcaaaaaugcaacucgaaaauacacucaucaguaucaaagcccaaaacaaaguaguaaccaaaaauaaaaacaagauauccggucagaagaaacuacaagaaacucucaccccacgaggacaauuacaucucgaaacaauuuaugguaaaauaaaccaauaccagacagcagaaaucaaagugggagggacccuagauagcgaacuaauaaacaaaguagccaacaaaaagacacgagaagcccuacuaaauagguuagccgaguucggaaacgacccuaaaaaggcauucacagucaaaaacacuaucgacaaaaacccuauauacuuagauaaacaucaaaguuacaaaauaccugaaaaaguuaaaaucguguggcaagaaccuguuuacacuaucagaaaaucaauaacaccagaccucaaacuugauaaaaucaucgacccaaaaauaaaggcuuuacuagaaucuagauuaaaggaaugcaauggcgaugcaaagcuagcuuucaguaacuuagccgagaacccaauauggcugaacaaagaaaaagggauucaaauaaaaagaguaacaauaacaggcauuaguaacgcugcaucuuuacaugacaagaaagaucucaacgguaaaccaauauuagacgaaaaaggcaauaaaauuucugucgauuuuguaaauaccggcaauaaucaucacguagccauauacaaagacgaaaacgggaacuuacacgauaauguaguuacauucuucgaagccguugaacgcgucaaucaaaaccuaccaguaguagauaaauuauuuaagcaaaaagaaggauggcaguuccuguucacuaugaaacaaaacgaauauuucguauucccaaaugaaaucaccgccuucaaccccaaugaguucgaucuacucaacccagacaauuauuacuuaauaucaccaaacuuauucagaguacaaacaaugaguaaagucauguacggaaauaacacacuuagagacuacaaauucagacaccauuuagaaacaaccuuacaagauauaaaagaauuaagggauauaguuuuuaaacaguucaagagcuuaucuaucuuugacaagauagucaaaguacgaaucaaucaccuagggaaaauaguaaaaacuggggaauauuga

SEQ ID NO: 5649 - RNA, 4266 nt, Artificial Sequence
  Cas9 variant
augaaggacaucuuaggauuggacuuaggaacuaauagcaucgguugggcaguaguaaaagaagcucaaaacgacaacgaacagagugaaaucguugacgucggaguucgaguaaauccacuuacaacagaugaaaaaaccaauuucgaaaaaggaaaaccaauaucgacaaacgccgacaggacacuaaaaagauccgcuagacgaaaucuacaaagauauaaacuccgucguaaagaauuaauagaacuacuaaaagaacaucaauugauuuccacagacacuauacuaacagaaaacgguaaagggacuacuuuccaaacauuagaauuaagagcaaaaucagcaaaagaaaaaaucucacuagaagaauuagcacgaguuuuuuugacaaucaacaaaaaaagaggguauaaaucaucacgaaaagcuaaaaacgaagaugaaggacaacuaauugacggcauggaaauugcaaagaggcuauacgaagaaaaccuaacaaccggacagcuaucccuccaauuauuaaaagaaggcaaaaaaagccuaccagacuacuacagaucagaucuucaguuugaacuagauaaaguauggaacuuccaaaaacaguuucacucacacauuuuaacugacgaguucuaugcucaacuaaaagguaaaggucaaagagcaacaagugcucuuuuucucgcaaaauaccaaauauauacagcagaaaacaaaggaucaagagaagacaaaaaauuacaagcuuaccaauggagaguagaugcacuuucaaaagaacuaacaagagaacaacuggcauuugucauaacugaaauaaacaauaacuugaauaauucaucagguuacuuaggagcaauauccgaucguagcaaagaacuauauuuuaacaaugaaaccguaggagaguaccuauggaaacaaauugcagcuaauccccacacgucgcugaaaaaucaaguauuuuauagacaggauuauuuagaugaauucgaacagauauggaagacccaauccgccuucuauccagaaauacuaaccgaaagcuuaaaaaaagaauuaagagauguagucaucuuuuaucaaagaaaauuaaaaagucaaaaaucccucgucuccuucugcgaauucgaaaacaaagaaauagaaauaaaaaaagaagauggaaccaguacaaaaaaaguuauuggccuaaaaguagcuccuaaguccagucccuuauuccaagaauuuaaaauuuggcaaaauuuaaauaaugugcugauuagaaaaaaaggaucuaaaaccaaaaaagcagcaaaaaaccagcaagcgguacuauucgaggaagaaaaaaccauaagcgaacucgaccuggaagcaaaacaagcuuuauucaaugaacuaaaucuaaaaggaaaucuuaaagccgacuauuguuuagaaauauuaggauacucaccgaaagaaugggaaaugaacuacucaguacucgaagguaacagaaccaauaaggcacuauacgaagcauacuuaaaaauuacagacuuagaaggcuacgacgcuaagaaucaccucaaagugaaacuaaauaaagaugaaguagaauuagaugauuugaaaguaccagcaagugaaauuaaagacaugguccaagcaauauucaaagaagcugguauaaacacagauauucuacacuuuaaugcagaacuugacgggaaagacuucgaaaaucaagcgaguuaucaauuauggcauuuacuguauucuuacgaaggcgacgauaguaaaucugguaaugaacuucuauacaaacuucuagaaacgaaauucggauucaaaaaagaauaugcccagauauuagcgaacguuucgcuaagcgacgacuauggaagccuuucaacgaaggcgaugaggaaaauccaccccuacauaaaagaaaacaaauuuuccacagcaugugagcuagcuggauauagacauucgaaacacucccugacaaaagaagagaacgauaaucgaguuuuaagagacagccuagaaguucuaaaaaaaaauuccuuacgacaacccgugguagagaaaauacucaaccaaaugauaaaccuaguaaacgcacuauuaaaaaaguacagaacagaaaacccgaauuuuaaauucgacgaaauuagaauagaacuagcuagggaacuaaaaaaaaacgcugaagaaagagcgaacaugacggcuaauaucaacaaagcaaaaacggaacaugaaaaaaucauuaaaauauuaaaaaaugaauuuggccuaccuaauccaacacgcaacgacauaauacgauacagauuguacgaagaacuuaaagcaaacggauacaaagauuuauacaccaacaucaaaauuccacaggaaaaacucuuuaccaaagaaauagauauagaacacaucauaccaaaaagccgcguauuugacgacaguuuuuccaacaaaacauuauccuuccgcaagacaaaccucgauaagggagaaagaaccgcuuucgauuacauggaauccaaguucggugcugacaaguuagaagaguauguagcacgagucgaagaucuauauaaaaacaacauaaucucaaaagccaaguaccaaaaauuacuaaaaaaagaauccgaaauuggagauggauucgucgaaagggaccuaagagagacacaauacaucgccaagaaggcuaaagagauacucuugcaaauaacaccaaauguacuaaguaccagcggcgguauaacagacagacuaagggaagauugggaccucauaaauguuaugaaagaguugaaucugcccaaauaccgagcguuaggguuaacagaaauggaagacagaaaauauggacaacaagucgaaguaauaauugauuggacuaagcgcaaugaucacagacaccaugcaauggacgcuuuaaccgucgcauucacaaaacauaaucauauacaauaucucaacuacuugaacgcaagaaaaaacgagaaacauaaggaacauagcaauauaaugggaauacaacaacuagaaacaauaaaaguaacggauaaaaacggaaaugaaaaaagaguguucaaagcuccaaugccuaacuucagacaaguaacgaaagcauuucucgaaaacauccuaauuagccauaaagcaaaaaacaaagucguaacgaaaaacaaaaauaagguggcgggcucaaacaaaguccaagagguacuaacaccaagaggacaacugcacaaagagacaguuuaugguaaauaccaauacuauguacaaaaggaggaaaaaauaggaggcaaguucgaccuagaaacuauaaaaaaagucgcaaacccauuguaucaaucauuauuaaagaaacgacucgaggaaaaugguggagaucccaaaaaagcuuucacuggaaaaaauucacuagcaaaaaauccaauuuaccuagaugaugcccaaacggaacaacuaccggaaaaaguuaaauuagucuggcuagaaaauucauuuagcauaagaaaagauauaacaccagaaaacuuuaaagacgaaaaacuaauagauaaaauauuagaugaaggugucaagagaauacuaaaagagagauuacaauccuuuggaaaugaugcuaaaaaagcauucucugauuuagaaaaaaauccaaucuggcuaaauaaagaaaaaggcauaacaauaaaaagaguaaccauaucaggagucgccaacgcagaaccuuuacacacaaaaaaagaucaccugggaaaagagauccuagacaaagaaggaaaaccaauucccgucgauuucauaucaacagguagcaaucaccauguugccguauauagagacgagaagggaaacuugcaagaaaaggucguuucaguauuugaagcagugguccgcgccaaccaaggccucccaauaauagauaagacauauaaccagcauuuaggcugggaauuucuauucaccaugaaacagaaugaaauguucguauucccuaaugagagcacaggauucaauccaaaugacauagaucucuuagaccccaaaaauaaacguaucauuucaccuaaccuguuuaggguccaaaaauuagcgacgggcgacuacugguuuagacaccaucuagaaacaacaguagaaacaaagagcgcgacaaaagauaugacuuacaaaagacuaagccucaaccauaucaaaaacauuaucaaaguaaggauaagccaccuaggagacauaguaucaguaggugaguauuga

SEQ ID NO: 5650 - RNA, 4275 nt, Artificial Sequence
  Cas9 variant
augaaacggauauuagguuuagauuuaggaacuaacucgauuggaugggcgcuaguaaacgaagcugagacagaugaagaagucaguucaauaauacgacuugguguuagagugaaccccuugacaguagacgaaacucaaaauuucgaaaaagguaaaucaauaacuacgaacgcagaaagaacccugaaaaggucaaugagacggaaucuccaaagauauaaguuacgacgagaugcgcuaguagaguuccuaaaagaacuuggauucauuacugacgaaacaauauuaucagaacaagggaacaggaccacauuugaaacauguagguugcgggcgaaagcugccgaagaagaaauuagucuagaagaauuaagcagaguauuacuaaugauaaacaaaaagcgaggcuauaaaagcucaagaaaaguuaagaaagaagaagauggcgucuuaauagaugggauggaaauagcaaagaaauuauacgaggaggaccuaaccccaggacaguugugcagccagcuauuagaaucaggaaagaaaguacuuccagacuuuuaucgcucagaucuacaagaagaacuagaccgaauuugguccgugcagaaacaauuccauccagauguauuuugcgaugcagcaaaagaagaaauaaaaggcaaaaauagaucacaaacaugggcaauauuagcaaacuauuuuguguggaaagaggaaguaguaggauggaaugaucgcgaggcuaaaaaugaaaccaucgaaaaagaaugcaaauuaguaggacuaaaaagaaccacaaaaggcuacgaguugaagaaagaaaacuacagauggagggcacaggccuugacagagcaacuaggacuagaagaaauagcugucguauuacaagaaauuaauggucaaaucaacgcuaguucgggauacuuaggagccauaucagauagaaguaaaguacucuacuucaaucaucaaaccguaggccaauaucaaauggcugaacucgauaaaaauccacaugcuaguuuaagaaacauggucuuuuauagacaagacuauuuagacgaguucgacagaauuugggaaaaacaagcagaauuucacaaagaacuaacugccgaauuaaagaaagaaauacgagacaugauaauauucuaucaacgaagacuaaaaagccaaaaaggauuaauaucuuucugcgaauuugaacgcuuagaaaucguuguagaaaaagacggcaagaaacagacaaaagucauaggaugcaaaguaaucccaagaucacacccccuauuucaagaauuuaaaguauggcaaacucuaaaugauauuaaaguauuaggacgagaaaagaaaagaaaugcauuaucggcgucggaaucacgugcauuauauccagaagaaaaagaaauucuugcaagagaacuagccauaaaagaaaauaugaagaaagcggacgucuuaaaacuacuauucgaaaauccgcaagaacuagaccuaaauuuuaaacaaaucgaugguaaccgaacaggauuuagcuuauucucagcauacucaaaaaugauagaaaaauauggauaugagccucucgacuuuaagaaaccagcugaugaaaucauaggccaacuuagaaccauuuucacagaccuagguuggaauacuaaucuauucaccauagaucuuacaaaagaaggaaaagaacuagagaugcaaccauacuucaggcuauggcacuuauuauacagcuuugagggugacaacacaaguacaggaaauggaaaacucauagagaaaauaaugcaacuauguggaguggaaaaagaauaugccgucgaguuagcuucucuuucauuccaagacgauuacggaucccuaucugcuaaagcaauaaaaaggauucuaccguauuuaaaagaagguaauuuauacgauguagccugugaauacgcaggauacagacauagcaaaucuucucuaacaaaagaagaaauagaaaauaaaguacucaaaggaaaacuugaaguguuaccuaaaaauagcuuaagaaauccagugguagagaaaauccuaagucaaaugguaaauguaaucaacacaauaauagacacuuacgggaaaccagaugaaauaagaguagagcuagcucgcgaacuaaagaaaucagcaaaagaacgugaagaacugacaaaagcaauugcaaaaagcaccagagaacacgaagaaauacgaaagcuccuccaagacgaauuugguaugaugaacgucagcaggaacgauauaaucagguauaaacuuuaugaagaacuaaaagacaauggcuauaagacccuauacagcaaucaauacauaccuaaagagaaaaucuucucuaaagaaauagauauugaacauauaaucccacaaagccgauuauuugacgauucccuuagcaacaaaacauuagaauauaaggcaauaaacauagaaaaaggaaacaaaacagcauaugauuuuguaaaggaaaaauauggugaagaaggucuacagcaauacauaaauagaugcgaaagucuauuuaacgauaagaaagccaaguuaagaaagcuaaaaauggaacaaaaagacauaccagaugguuucauagauagagaccuuaggaacacccaauacauagccaagaaagcacuagcaaugcuuaacgagauuuguaggagagugguggccacgacaggaagcauaacagaccaauuaagagaagacuggcaauuaguagauguaaugaaagagcucaacuuaccaaaauaugaagcauuaggauuuguagaaaccuaugaagacaaggauggccgaaaaauuaaacgaauaaaagacuggacgaaacgaaaugaccacagacaucacgcaauggacgcacucaccguagcguuuacaaaagaugcauucauucaguauuucaauaauaaaaacgcggcccaagacagugguaacagaaaccauacaaacauaaucgguaucaagacacgauauuucgacaaagguagggccuuaccaccaauaccucuggagcaauuuagaauagaagcuaaacaacauuuagaaaagcuccuaguuuccauaaaagccaaaaauaaaguagugacuguaaauguaaaccgcacaaagaaaagaaaaggcgaaaauacuaaaauacaacaaaccccgagaggacaauugcaccuagaaacaguauaugguagucauaaacaguacguaacaaaaauagaaaaaguaaacgcaaguuucgaugcagcuaaaauagcaacgguaucaaaacgagcauacagaaaugcgcuacucaaaagacuagagacauucggaaaugacccaaagaaagcguucacagggaaaaacgcacucgagaaaaacccauuauaugccgauaaauaccagacaauacgcgugccagaaaaaguacaaacagucgaauuugaaacuauauauacaauuagaaaacccgucgaccccgcauuaaauguagacaaaguaguagauguaaaaguaagagcaauauuagaacgaagacuaaaagaauacggaggagaucccaaaaaggcuuucguaaacuucugggaaaaucccauaugguugaauaaagaaaaaggaauaucaauaaaaagagugucaaucagaggaauaaacaaugcucaaaguauacacguuaagaaagauaaaaauggaaacccgauuugggaugaaaaugguaaacaaauaccaguugacuuugucaacacaggaaacaaccaucacguagcaauuuauagaaaacccguucuagacaagaaaggucagguaacauucgaugaggauggcaaccuaauguacgaacuggaugaagucgucguaccauucuucgaagcaguaacucgagcgaaccuaggacuaccaaucauagacaaagauuauagaaaaucagaaggguggcaguucuuguucuccaugaaacaaaaugaauauuucgucuucccaaaugagaaaaccggcuuuaauccuaaagaaguagaucuucucaauccugauaacuacgcgaugauaucaccaaaccuguuccgagugcaaacaaugagcaaaguaauguauggaaacaaugugguaagagauuauaaauuccgucaccacuuagaaacaacagugaaagauaugaaagaauuaaaagauaucgcuuauaaacaauacaaaacuuugagcuuuggcaauucugucguuaaaauaagaaucaaccauauaggucaaauaguaaguguaggagaguauuga

SEQ ID NO: 5651 - RNA, 4275 nt, Artificial Sequence
  Cas9 variant
augaaacgaauuuuaggauuagacuuaggaacaaauaguauaggaugggcacucguaaacgaagcagagaccgacgaagagguuuccaguaucauacgucuaggcgugcgagucaacccccucacgguggacgaaacccaaaauuucgaaaaaggaaaaucaauuacaaccaaugcagaaaggacacuaaaaagaagcaugagaagaaacuuacaaagauauaaauuacgaagagacgcuuuaguugaauuucucaaagagcuuggauuuauaacagacgagaccauccucuccgaacaagguaaccguacaacuuucgaaacuuguagacugcgagcaaaagccgcagaagaagagaucucauuggaggaacuauccagaguccuucuaaugauuaauaaaaagagaggcuauaaaucuagucgcaagguuaagaaagaagaagauggugugcuaaucgacggaauggaaauagcuaagaaauuauacgaagaagaucugacgccaggacaacuaugcagucaacuccuggaaucuggaaagaaaguuuuaccagauuucuaucauagugaccuccaagaagaguuagauagaauauggucuguacaaaaacaauuucacccagauguuuucugcgaugcagcaaaagaagaaauuaaaggcaaaaacagaagucaaaccugggcaauauuagccaauuacuuuguauggaaagaagaagucguaggauggaacgauagagaagcuaaaaaugaaacaauugaaaaagaaugcaaacuuguuggacuuaaaagaacaacaaaaggauaugaguugaagaaagaaaauuacagguggcgagcacaagcauuaacagaacagcuugguuuagaagaaauagccguuguauuacaagaaaucaauggccagauuaacgccucaaguggguaccuaggagcgauuucggaccgauccaaagucuuauacuuuaaccaccaaaccgucggacaauaucaaauggcagaauuagauaaaaauccacaugcaucacuuagaaauaugguuuucuaucgacaggauuacuuagaugaguucgacaggaucugggaaaaacaagcagaauuucacaaagaauuaaccgcagaacuaaagaaagaaauaagagauaugauaauauuuuaucaacgucgucuuaaaucccaaaaaggauugauuucguucugugaauuugagagauuggaaaucgucguagagaaagaugggaagaaacaaaccaaagugauagguugcaaaguaaucccacguagccaccccuuauuucaagaguucaaaguauggcaaacacuuaaugacaucaaaguacucggaagagaaaagaaaagaaacgcauuaucagccagcgaaagccgagcgcuuuacccagaagaaaaagaaauacuugcacgagaauuagcuauaaaagaaaauaugaagaaagcagacguguuaaaacuacuuuuugaaaauccacaggaacuggacuuaaacuuuaaacaaauagauggaaacagaaccggauucagccuuuucucagccuauagcaaaaugauagaaaaauauggcuaugaaccauuagauuuuaagaaaccugcugaugaaauaauuggacaauuaagaaccaucuucacagacuuaggcuggaauacgaacuuauucacaauagaccuaacaaaagaaggaaaagaacuugaaaugcaacccuauuuucgguuauggcaccuauuauacagcuucgaaggagacaauaccucaacggguaacgggaaauuaauagaaaagauaaugcaacuuugcggagucgaaaaagaauacgcgguagaacucgcaucacuuucauuucaagacgacuaugguagcuuaagugccaaagcaauaaaaagaauauuaccguaccucaaagaaggaaaccuauaugauguagccugugaauacgcaggcuacagacacucuaaaagcucacuaacaaaagaagaaaucgaaaauaaaguuuuaaaaggaaaacuagaaguauugccgaaaaacagccuaagaaaucccguagucgagaaaauauuaucacaaauggugaaugugauuaauacuauaauagacacauaugguaaaccugaugaaauaaggguagaguuagcucgagaauuaaagaaaucagcaaaagaaagagaagaacuaacaaaagccauagcuaaaucaacaagggagcaugaagaaauaagaaagcucuuacaagacgaguucggaaugaugaacgucaguagaaacgacaucauaagauacaaguuauaugaagaauugaaagauaauggauauaaaacacuguauucaaaucaauacauaccuaaagagaaaaucuucucgaaggaaauagacauagaacacaucauaccacaauccagacuauucgaugauuccuuaucaaacaaaacauuagaauauaaggcuauaaauauagagaaagguaacaaaacugccuacgauuuuguaaaggaaaaauauggcgaagagggucuacaacaguacauaaauagaugugaaagccuauuuaacgacaagaaagccaagcugaggaaauugaaaauggaacaaaaagacauaccugauggguuuaucgacagagaucuaagaaauacacaauauauagcaaagaaggcacuagcgaugcuaaacgaaaucugucgaaggguaguggcaacuacagguucaauaacagaucaacugagggaagacuggcaauuaguggauguaaugaaagaauuaaaccuaccaaaauacgaagcccugggauucguagaaacauacgaggacaaagacggaagaaaaaucaaaagaauuaaagauuggacaaaaagaaaugaucauagacaccaugcaauggacgcuuuaacaguagcauuuacuaaagacgcauuuauucaguacuuuaacaauaaaaacgcugcacaagacagugguaauagaaaccacaccaacauaauaggcauaaaaacaagauauuuugacaaaggucgagcauuaccuccuaucccacuagaacaguucagaauagaagcuaaacaacacuuagaaaaacuguuaguaaguauaaaagcuaaaaauaaaguaguaacaguaaauguaaauagaaccaagaaacggaaaggagaaaacacuaaaauacaacaaacacccagagggcaacuacaucucgagacaguauacggaucgcauaaacaauauguaacuaaaauagaaaaaguaaaugcaucauuugacgccgcaaaaauagccaccguaaguaaaagggcuuacagaaacgcguuacuuaaaagauuagaaaccuuuggaaacgauccaaagaaagcguuuacugggaaaaacgcauuagagaaaaauccuuuauacgccgacaaauaucaaacaauacgcguaccagagaaaguacaaacuguagaauuugaaacaauuuauacuauaagaaaaccaguugauccggcacugaacgucgacaaaguaguagacgugaaagucagagccauuuuagaacgcagguuaaaagaauauggaggagacccuaagaaagcauucguaaauuuuugggaaaacccaauauggcuaaauaaagaaaaaggaauaucaauaaaaagaguaagcauacggggaaucaacaacgcacagucaauacacguuaagaaagacaaaaacggaaauccaauaugggaugaaaauggaaaacagaucccaguugacuucgucaacaccgguaauaaccaucacgucgcuauuuauagaaaaccaguacuagauaagaaaggacaagucaccuuugacgaagacggaaacuuaauguaugaacuagacgaaguuguuguaccauucuuugaagccguaacaagagccaauuuaggucuaccaauaauagacaaagauuauagaaaaagugaggguuggcaguucuuauucaguaugaaacaaaacgaauauuuuguauucccaaacgagaaaacaggcuucaaccccaaagaagucgaucuauuaaauccagauaacuacgcaaugaucucgccgaaucuuuuuagaguacaaaccaugucaaaaguaauguaugggaauaauguuguaagagacuauaaauuccgucaucaucuugaaacuacagucaaagauaugaaggagcucaaagacauagccuauaaacaauauaaaacucuaucuuuuggaaacagcgucguaaaaauaagaaucaaucauauugggcagauaguuagcguaggcgaauacuga

SEQ ID NO: 5652 - RNA, 4278 nt, Artificial Sequence
  Cas9 variant
augagaagaaacauauuaggccuagaccuaggaacuacaaguauaggauuugccaaagugauagaagaugaagauuaccaaaacuccgcaguagaacuaauaggugugcgcguuaacccauugacuacugacgaacaaaccaauuucgagaagggaaggcccguaagcgucaaugcagacagaacuuugaaacgaggcaugcgaagaaaucuggacagguaccaauuacgacgccaccaucuuaucgagguauuaaaagccaaccauauaaucacaguagacacuaaauuagcugaagacggaaaaaauacuacacaugcaacauacgcaguaagagcauuagcagcaaccgccgaaaucccacuagaggcauuugcaagaguacuuuuagccauuaacaaaaaaagaggcuauaaaagcucuagaaaagcaaaaaaugaagaugaaggacaacucauagaugguauggccguagcuaaacgguuauaugaggagaaucuaacaccagggcaauuauccuacuugcuacuaaaagaaggaaaaaaauacuuaccugacuuuuauagaucagaccuaaacgcugaacuagacaaaguuuggaguuuucaaaaacaauuuuauccugaaaucuuaaccgaggaauucaaaaaacaccuugaaggaaaaggccaaagggcaacaucugcagcauuuuggggacaauauggcuuuaauacugcagaaaacaaaggcaguagagaagaaaaaaaacucaaggcauaccaauggcguagugaagcaguugaccaacaacuaaccaaagaagaggucgccuacgugaucacagagauaaauaacgacuuaaacaaaaguagcggauauuuaggagcaauaucggacagaaguaaagaauuguuuuuuaacaaacagacaguggggcaauaccuguaucaacaauuaaaacaaaacccccauacuagguuaaaaggacaagucuucuauaggcaagacuacuuagaugaauucgaaacaauaugggaaacgcaagcuaaauuucauccugaacucaccgcagcccuaaaagaagaaauaagagauguaauuaucuuuuaccaacggaaauuaaagagucaaaaaggauuaauaaguuucugugaauuugagucgaaagaaauugaaguagaaaaaaauggucuaaaaauaaaaaaacgcauaggacuaagaguugcuccaaaaucuagcccacuguuccaagaauucaaaauauggcaaguacucaauaaccuagaauuucgaaacaaaucgucaaaagaaguauucgucccagauaugacugcuaaacagcaacuauucgacgaguuaaauaucaaagguaacuuauuagcaucagaagcaaucaaaaucuuaggguacaaaacgaaagacugggaggcaaauuaucacacacuagaaggaaauagaacuaauaaaucauuguacgacgcguaucuuaaaauucuggaauuagaaggcuacgacgaagaucuauuaaaacuaagugguucggaugauauagauguaaguaaaauagaaaaaucagccagugagaucaaacaaaugguacaugcugucuuugaaguacugggaauaaauaguacaauccuagacuuugacgcagaagcagauggaaaagcuuucgaacaacaaacagcauacagauuguggcauuuauuauauagcgcagaagaugacaacaagaaauacuuacaagaggauauuuuuauauauggucacgacaacauaggguuaaaaaaaaaguuaugugaaagauucggauuuagaccggaacauacgaagaucuuagucaauguugcuuuuucuggcgauuacgguucauuauccaguaaagccaugcgaaaaauauacccuuucauaaaagaauuaacauacgauaaggcaugucgagaagcuggguacagacacagcgcauccucucuauccaaagaagaaaucgccacuaggccacuacaaaaacgacuaggcuuauuaaaaaagaaugaauuaagaucaccuguugucgaaaaaauacuuaaccaaaugguaaacgucgugaacgcacucauagaugaugaaaauaaacgaagaaaagcaagaggucuaagcgacgacuuccacuucgacgagauucguauagaacuagcucgagaauuaaaaaaaaacgccaaagaacgcgccgagaugacuacaaauauaaacgcagcaaaacaacuccacgaaaaaauaauuaaaauacuccaaacccaguuuggugucaguaauccaaguagaaaugacauaauucgauacaaacuauacgaagaauuaaaaaacaauggauauaaggaccuauacacaaacacauacaucucuccagauauucuuuuuucaaaacaaauagauauagaccacauaauaccgcaaaugagccuauuugacgauagcuucaguaauaagacaguuguguuccgcaaagauaaccaagauaaaggaaacaaaaccgcauacgauuauauacuuggaaaauauggagaacuugcucucgaagaauauauaucgagaaucacuagccuuuucgaauugggcaaaaaaaauaaagaagaagguauuaacaaagccaaauuccaaaaauuacagaaacgacuaauagacauaggugaugguuuuaucgaaaaagaccuaagagagucucaauauauagcaaagaaagcaaaaaacaugcuauaugcaauaugccgaucgguaguugccacaucaggcgaaauaacagcgagauuaagggaagauugggaccuaguaaacguaaugcaagaaaucaauuuaccaaaauuccgagcauuaggccuaacugagauggucgagaaaaaagacggaggucaaaaagaacgaauaauagauuggacgaaacgaaaugaucaucgacaucaugcgauggacgcauuaacuauagccuucacuagacacucacacauacaguaucuaaaccacuuaaacgcucgaaaagacgaagccagcaaguggcauccaguaguuucuaaaauagaagaaaaagaaaccgaccuggucuaugacgauuuaggaaaucguaaaagacgcuuuaaggcuccaaugccaaacuuccgagaaguuguaaaagaacaucuagaaaauguacuaauaagucacaaagcaaaaaacaaaguuguaacgaaaaauaaaaauaaaauaaaaacugccaaaggcgaaaagauaaaaaccgaacucacuccgagagggcagcuccacaaagaaacaauauauggccgcuauagauauuacgaaagcaaggaagaaaaaguugguccaaaauucgacgcagaaaccaucgguaugguaguaaacccacaauaucgaaaauuacucuuagagagacuaacaacaaauggaaaugauccuaaaaaagcauuuggcggcaaaaauacuuuaagcaaaaacccauuauacauagacgaagcuaaacaggaauuauuaccagaaaaaauuuuauuaagaugguuaaacgaugauuacucaauucguaaagacguaaccccagaaaaucuaaaagacgucaaaacgauagaaaaaguacuugaugaagggauuaaaaagauacugcuaaaaagauuagucgacuuuggaaaugauccgaaaaaagcauuuucagauuuagauaaaaacccuaucugguuaaacgaagccaaggguauaacaauaaaaagaguaaccaucucaggagucaaaaacgccgaagcccuacauuauaagaaagaucauuucggcaaugcuaucuuaaaugaaaauggaaaauugauaccauccuccuuugucucuacuggaaauaaucaccacguugccauauaccgggacgcagaaggaaaucuacaagaacgagucguuaguuuguucgaugcagugcaacugguaaacgcgggagaagcuguaauagauagggaauauaauaaagguauagguuggcaauuuuuauuuacaaugaaacaaaaugaaauguuuguuuucccaaaugaaaagaccgguuucgaucccaaggaaauagaucuacuaaauacagauaaucgaaaacuaauuaguccuaauuuauuccgcguucaaaaaauugcuagcaaaaacuacuucuucagacaccacuuagaaacaaacguagaagaaagaaaagaacuaaaagauauaguauauaaaccacaacuaggucugaaugcaaucaaagacguagugaaagucagaauaaaucacuuaggcaagauaauauccgugggagaauauuga

SEQ ID NO: 5653 - RNA, 4281 nt, Artificial Sequence
  Cas9 variant
augccucgaaagaauauacucgguuuagaucucgguacaaccaguauaggauuugcuaaaauaauagaagacgacgacuaucaaugcuccagcguugaacuaauaggagucagagucaauccucuaacuacagaugagcaaacaaauuucgaaaaaggaaaaccaguaucaguaaaugccgaccggacuuuaaagaggggaaugagacguaacuuagaucgguaucaauuaaggagagacuauuuaauugagauacuacgaacacaucacauaauaacugcagauaccaaauuagccgaagauggaaagaacaccacacacaccacuuaugcauuacgagcacuagcugcaacagcugaaauaccacuggaagcauuuguacgaguuuugcuagccauaaauaaaaaaaggggauauaaaucgagucgaaaagcuaaaaaugaagaugaaggacagcucaucgacggaauggcuauagcaagacgucuuuacgaagagagccuaacaccaggacaauuuucauaucaacuacuaaaagaaggcaaaaaauaccuaccagauuuuuauagaucagaucuaaauaccgaacuaaauaaaguuuggaauuuccaaaaacaauuuuauccagagauacugacggaugaauucaaaaggcaucuagaaggaaagggacaaagagcaacugcaguggcuuuuuggggucaacacggcuucagcauggcggaaaauaaaggaucuagggaggaaaagaaacuucacgcauauaaauggagaagugaagcugcucacaaacaacuaaccaaagaagaaguagcauucgucauaacagaaauaaacaaugaucuuaauaaaucuaguggguaucucggugccauuucagaucguagcaaagaauuauuuuuuaacaagcaaacuguaggacaauaccuccaccaacagcuaaaagaaaacccacacacacgauuaaagggccaaguuuuuuaccgacaagauuaucuagaugaauuugaaacaauaugggaaaugcaagcgaaauuuuauucagcacucacacuagaauuaaaagaggaaguuagggacgucguuauuuucuaccaacgaaaguuaaaaagucaaaugggucuaauuagcuuaugcgaauuugagucaaaggaaauugaaaucgaaaaaaauggugaaaaagcaaaaaaaagaauugggcuacgaguugccccuaaaucaucgcccuuauuccaagaauucaaaauauggcaaguucugaacaaccucgaauucagaaauaaaaagacaaaagaaguauuuguaccagaaauggcagcaaaacaacaauuauuugaugaacuaaacauaaaaggcaacuuauuagcaagugaagccauaaaaauuuuaggauacaaaacaaaagauugggaggcaaacuaucacacucuagaaggcaacagaacaaacaagaguuuauaugaugcuugguuaaaaauuuuagaacucgaaggauaugaugaaaacuuauuaaaacuaagcggaucagacgauauagauguuucaaaaauugaaaaaccugcccuagaaauucggcaaaugguucuugccguuuucgaaguguuggggauaagcggagcaauauuggacuucgaugcagaagcugauggaaaagcguucgaacagcaacccgcauaccaacucuggcauuuacucuacucagccgaagacgacggaaaaaaauauucacaggaagacauauuuacguacggacacgacaacauaggucuaaaaaagaaacuaugugaaaaauucggauuucgaccagaacauacgaaaauucuaguaaacguaguguuuucagacgauuacggaaaccuaaguucaaaagcuaugagaagaauuuacccuuucauaaaagagcuaacauacgacaaagcuugugcugaagcagguuaucgccauagcgcggcaagcuuaaccaaagaagaaaucgcugccagaccacuacaaaauagauuagaccuacuaaaaaaaaaugaguuacggucuccaguuguagaaaagauacuaaaucaaaugguaaaugugguaaauacauuagucgacgacgaaaaccagaacagaaaagccagaggccuaucggaagauuuccauuuugacgagauaagaauugaauuggcuagagaacuaaaaaaaaacgcaaaggaacgagcagaaaugaccacaaacauaaauaccgcaaaacaaagucaugaaaaaaucauuagaauacuccaaacagaauuuggagugccaaacccaagccgaaaugauauuguaagauacaaacucuaugaagaauuaaaaaauaauggcuauaaagaccuuuauaccaacacauauauaucgagagacaucuuauuuuccaaacaaauagaugucgaucacaucauuccacaaaugaguuuauucgacgacagcuuuucaaauaagacuguugucuuuagaaaggauaaccaagauaaaggaaauaaaacagcuuacgacuauauccuaggcaaauauggcgaacaagcgcuagaagaguauauaucacguauaaccucgcucuuugaauuaggaaaaaaaaauaaagaggaagggauuggaaaagcaaaguuccagaaauugcagaaaagacuuguagacauaggagacggcuucauugaacgagaucuaagggaaucacaauacauagcuaaaaaagcaaauaacauguuauacgccaucuguagaaguguagucucgacauccggcgagauaaccgcuagacuacgagaagacugggaucugguaaacguaaugcaagaaauaaacuuaccaaaguuuagagcgcuaggauuaacagaaaugguagaaaagaaagauggcgcacaaaaagagagaauuacagauuggaccaaacgaaaugaucaccgacaccaugccauggacgcauuagcaauagcauucacgagacacucucacauucaauacuugaaccaccuaaacgcacgaaaagaugaagcaaauaaauggcacccagucguaucaaaaauagaagaaaaggaaacaguuuugaucuacgaugacuuaggaaauagaaagagaaaauucaaagcaccuaugccgaauuuccgagaaguaguaaaggaacaccuagaaaacguacucaucagccauaaagcaaaaaauaaagucgugacgaaaaauaaaaacaaaauaaaaacgguccgaggcgaaaaaguaaaaacagagcuaacuccucguggacaauuacacaaagaaacaaucuacggacgauacagauacuacgaaucaaaggaagaaaaaauuggaccaaaauuugacgcagaaaugaucgguaugguuacuaauccacaauauaaaaaacuacuauuagaacgccuagccgcaaacggaaacgauccaaaaaaagcauuuuggggcaagaaugcgcugaacaagaauccccuuuacguugacgaagcaagacaagaacuccugcccgaaaaaauacuauugcggugguuaaaugacgacuacucaauacgcaaggacguaacaccagaaaacuugaaagauauaaaaacaauagaaaaaauacuagauaaaggcguaaagaaaauauuacuaaagcgucucgccgacuucggaaacgauccgaaaaaagccuucagcgauuuagauaaaaacccuauuuggcaaaacgaagcaaaacgcauagccauaaaacgaguaaccauaucagguaucaaaaaugcagcaccucuucaucacaaaaaagaucaccuaggcaaugauauauuagaugaaaaggguaaacaaauaccaucaaguuuuguuucaacaggaaauaaccaccauguagcaauuuaucgagaugcugaagggaaucuucaggagaggguaguaagccuauucgaugcaguacaacuaguaaacggaggagaaccuguaaucgauaaggaauacaauaaaggaaucggauggcaauuccuguuuacaaugaaacaaaacgaaauguucguuuuuccagacgagaaaacaggauuuaaucccagagaaguugaucuauuaucgucgggcaauagaaagcuaauaucuccaaaucucuuucgaguacaaaaacuugcaucaaagaacuacuucuuccgccaucacuuagaaacgucaguagaagaaaaaaaagaguuaaaaaacaucgccuauaaaccccaauuaggccuaaacgcacuaagcaacauaguaaaaguaaggaucaaucacauuggagaaauaguuaguguuggagaauauuga

SEQ ID NO: 5654 - RNA, 4281 nt, Artificial Sequence
  Cas9 variant
augaaaaauauacucggauuagauuuggguaucacaucaauuaguuucgcacacauaguagaagaugaaaacaaagaaaaaucagaaauaaaagaacuagguguaaggaucguuucacuaacuacggacgaacaaagugauuucgaaaaaggaaaaucgauuaccacaaacgcuaauagaacacuaaaacacggagccagacucaaccuugaucgauaccaacaacgacggaaauaucuaaucgauuuguuacaaaaagcaaaucuaaucacaucaucuucaauacuagccgagaauggaaagaauacaacacauaguaccuggcaacucagagcuaaagcaguaaccgaaagaauagaaaaggaagaauuugccagaguucucuuagcaauaaacaaaaaaagagguuacaaauccucaagaaaagcaaaaacagaagaugaaggacaagcaauagacgguauggcaauagcuaaaagguuauaugaugaaaacuuaacaccaggacaacuuucauuacaacuacuucaacaaaacaaaaaauuacuacccgauuuuuacagaagugaucuucaaagggaauuugauuuagucuggaauuuucaaaaacaauucuacccagacauucuaacugacucauucuauaaagaauuacaaggaaaaggaaaagacgcaacauccaaagcuuuuucaaaaagauaccauuucgauacagcagaaaauaaagguucaaaagaaucaguacgauuacaagcauaucaauggcgagcagaagcaauaucuaaacaacuuuccaaagaagagguagcauacgucuuaacagaaaucaacaacaaucucaauaacgcguccggauaucucggagcaauauccgacagaucaaaagaacucuacuuuaaccgccaaacagugggucaauaucucuacgcacaacuacaggaaaacagacauaacucucuaaaaaauaaaguuuucuaucgacaagauuauuuagaugaauucgaacgaauaugggaaacgcaggccucauuccauaaagaguugacagaugaauuaaaaaaacaaauccgagauguuguaauauucuaccagagaaaacuuaaaagccaaaaaggacuaauaucuuuuugcgaguuugaaucaaaagaaauagaaauugaaaaagacggcaagaccauaaccaaaacaauaggagcccgcguaguaccaaaaucaagcccacuguuccaagaguuuaaaauuuggcaaauacuaaauaauguaacuugcaaaagaaagggaauacggaaaaaaaaauccuccgccaaauccacagagcuagaccucuuuaacgagccuucacaaaccaucuuuucuuuagacauggaaugcaaacaauuacucuucgacgaauuaaauuugaagggcgaucuaaaaucagacaaaguacuaaaguuauugggauacuccccacaagaaugggaaauaaauuacaaccaacuagagggaaaucgaacccaaaaagcacucuacgaagccuaccuaaaaauaguagagauggaggcccaugacguuaaagauauacuacaaaucaaaucugcgaaagacgauuggucucuugacgaaucgccccucagugcuagugaaauaaaagaaaaaguuaaagacauuuuccaagcccucgggauauguacaaaaauucuauacuuugacccacugcuaccaguuaaagaauucgaaaaacaagacucauaccaacuguggcaucuacuauauucuuacgaauccgacgauucaacaucaggaaaugaaacucuauaccgaauccuagaaaagaaauacgcuuucaaaagagaacacgcaagaauccuagcuaauguagcacuacaagacgacuaugguucacuaucaacuaaagcaauacgaaaaauauacccaaacauaaaagaaaaccaauauagcaaagccugugaacuggcgggauauaaacauagcaaauuaagccuaaccacagaggaacuagaagcaagagaguuaaagaacauaauaccgcucuuaaaaaaaaacgcgcuaagaaauccgguagucgaaaaaauucuuaaccagaugauaaacguaguaaacgcauuaauagaaaaaaauagugaaagagaugcagaaggaaagaucaccaaauauuuucacuuugaugaaauaagaauugaacuagcuagagaacucaaaaaaaacgcacagaaaagauacgaaaugacgcaaaacauuaacaaagccaaauuagagcaucaaaaaauaucagaaauacuacaaaagaaauucggaauuaagaaucccacaaaaagugacauaauuagauaccguuuauaucaggaacuggaacacaauggcuauaaagaacuuuacacaaacgccccaauagcccgugauaugcuguuuagcaagaacauagaaauugaacacauaguaccaaaagcacgggucuucgacgacagcuucucaaacaaaacacugaccuuucacagaauuaacucuaacaaaggcgaguauaccgccuucgacuacauuacaucccucaauucagaagaggaauuaaaccaauaccuuacaagaguagaaaaugcauauaaaaccaaaaguauuucauuaacaaaauauaaaaauuuacugaaaaaggccuccgaaauuggagacggauucauaaacagagaucuacgagacacccaauauaucgcuaaaaaagcuaaagaaauauuauuucaaguaaccaaaaacguucuuucaaccucaggaaguaucacagaccgucucagagaggacuggggauuagucgauguaaugaaagaacuaaacaugccaaaauaccagucacuagguuuaacugaaguagaagaacgaaaggaagguaauaaaguaacaguuauuaagaacuggacaaagaggaacgaccaccgacaucaugcaauggacgcacugaccguugccuuuaccaaaccauccuauauucaauauuuaaaucaccucaacgcacgaaaagaugaaaacaacaaaaauuauucagucauccuggcaauugaggagaaagaaacaauaaaaguaccgaccaacaacggaaaaaacaaacgaguauucauugaaccgauuccgaauuucaggcaaguagcuaaaaaacaccuagaagaaauauuuauaucacacaaagcaaaaaacaaaguaguaacaaaaaacguaaacaaaccagcaggcacggauaaacaacagauaacccuaaccccaaggggucaauuacauaaggaaaccauauacggaaaguaccaauacuauguaaacaaagaagaaaaaguaggaguaaaauucgacgaaagaacuauaacaaaggugucaaacccgcuauacagagaagcacuucuaaaacgucugcaagcaaacgauaaugacccgaaaaaggcauucacaggaaaaaacgcauuaucgaaaaacccaauauacuuagaugaaaccaaaacgaaaacauuacccgaaaaaguaaaccuuacguaucuagaagaggacuucucuauaagaaaagauauauccccagacaauuucaaggaccuaaaaucaauagaaaaaguaauagaccaaggaguaaaaagaauauuaaucaaacgauugcaggacuacgauaaugauccaaaaaaagcauucgucgaucuugaaaaaaaccccaucuggcuaaauaaagaaaaagguauagcaauuaaacgaguuacuaucagcggcguuucuaaugcacaaccauuacauaucggaaaggaccaccuggguaaaacuacauuaaacaaggaaggcaacgaaauaccaguggacuauguaucuaccggaaacaaccaucacguagcuaucuaccgagauaaagaaggcaacuuacaagaacaaaucgugucuuucuuugaagcaguaguacguacacaacaaggguuaccuauaauagacaagacauauaaacaagaagaaggguggcaguuccuguucacgaugaaacaaaacgaaauguuuguuuuuccaaaugccacaacaggguucaacccugcagaaaucgauuuacucgauccaaaaaacaaaaaacuuaucucccccaaccuauuuagaguacagaaaaucgcaacaaaagauuacuuuuucagacaucaucuugaaacaaauguagaaaccgauaauguacucaaaaacaccacauggaaaagagaaggccuaaguggccuaaaagauauagucaaaguucggauaaaccaccuaggugauauaguaaguauaggggaauacuga

SEQ ID NO: 5655 - RNA, 4281 nt, Artificial Sequence
  Cas9 variant
augaaacacauucugggccuugauuuaggaacgaauucaauaggaugggcacucauuaaacaagauuucgaaaacaagcagggugaaaucuuaggaaugggaucucgaaucauaccaaugucacaagacauucugggcgacuucgguaaaggaaacaguguuagccaaacagcagaaagaaccaaauacagaagcguacgacgccuaagagaaagauuucuguuaagacgcgagcgcuuacacagaauauuaaacguccuaggguuccuacccgaacacuacgcaucacaaauugauuucacaaaaagauuuggaaaguuuaaggaggaaacagaaccaaaacuaguauauagcaacgaaggcuuuauauucaaaaagucguuugaagaaauguuaucagacuucaaaacacaucaaccacaauuacuugaggacaacaaaaaaauaccauaugauuggaccauauacuaucuccguaagaaagccuuauccagaaaaauugaaaaagaagaacucgcauggauauuauuaaauuuuaaucaaaaacgcggcuauuaccaauuacgcggugaagaagaagaagaaaacccaaauaaacuaauagaauucuauucacuaaaaauagucgacguauuagcagaugaaccgcaaaaagguaaaagugacauaugguacagccugauauuagaaaacggauggauauauaggagaucuuccaaaaccccacuguuugacuggaaagagaaaacaagagauuucaucguaacaauagaucuaaaugaugauggcucagucaaaaccgacaaggagggaaacgagaaaagaucauuuagagcuccuggagaaaacgauuggacauuaguuaagaaaaaaacggaacaagaaauagacucaaguaggaagacuguaggaaccuacauuuaugaaacgcuacuuaaaaaccccaaacagaaaauaaaaggaaaauuaguacgaacaauugaaagaaaauuuuacaaaacagagcucaaacaaauccuugagaagcaaaaagaauuccaccccgaacuucgacaagacgaucuauacagugauuguguucgagagcuuuacaaaaacaacgaagcucaccaacuaacuuuaucaaaaaaagacuuuguacacuuauucauggaagauaucaucuucuaccaaagaccucuaggaagucaaaaaucuucaaucucuaacuguaccuuagaauuucgaaaguacaaagacgaaaauggcacggaacacacgcaauaucucaaagcuauaccuaaaucaaauccguacuaucaagaauuccgaauauggcaauggauguauaacuuaaacauauacaaaaaagaagaugacacgaacguuacaaaagacuuuuuaaacacaaaagcagacuucgagucacuauuugaauuccuuaauaaccgaaaagaaguagaucaaaaggcauugcucaaacauuuuaaacuaaaugacaagacccaccgcuggaacuauguagaggauaaaaaauauccguguaaugaaacuaaaaccaugauuuuaucaagacuagauaaaguagaaaacauaagcgacgacuuuuuaacaagagaaauggaacagaaaaucuggcauauaauauacaguguaaacgacaagguagaauacgaaaaagcauuaaaaaguuuugcaggcaagaauaacuuagaagauaacuccuuuuuugaagcauuuaaaaaauucccaccguuuaagagugaguauggugcuuucucagaaaaagcgauaaaaaaacuauuaccacuuaugaggaugggcaaauuuuggaauuauaacaauauuagugaacagagcaaaagcaggauucaaaaaauaauaacaggagaauacgacgaaaauauuaaagacaagguuagagaaaaagccauccaucugacaacugaaacagacuuccaaggacuucaacucuggcuaguccaauauauuguguauggacgacacucugaagcggcaaugcuggguaaauggaauuccgcagacgacuuagaagaauuucuuaaagaauucaaacaacacucgcuaagaaaccccaucguagaacaaguaauaacugaaacgcuaagaguaguaaaggacaucuggcaaaaauacggaaacggugccaaagacuucuucagagaaauacacauagaacuaggccgggaaaugaaauuaccagcagaggaaagagaacgccuaacacgacaaaucucagaaaacgaaaacacaaauuuuagaaucaaagcguuacuagcagaaaugauggaugauaauaguguugagaaugugagaccauucucgccuaugcaacaagaaauacuaaagauauaugaggaaggaguccuaaacucggauauagaaauagaggacgauauacuaaagauaucaaaaacugcacaacccaguucgagugaccucaagagauauaaauuaugguuagaacagaaauacaaaucaccauacacaggucaaaucauaccacuaaauaaacuauucacaccagaauacgaaauagaacacauaauuccgcagucgcguuauuucgaugacagcuucacaaacaaaaucauuugugaaagugccguaaacaaacuaaaagauaauuauauaggauuagaauuuauuaaaaaauuagguggaagcauaguugaaugcggaaauggaaaaucuguagcuauccuaaaacaugacgcauacgaagacuuuauaaagaaacauuacgccaacaacagaucaaaaagaaacaaacuauuacuugaagauauccccgaaaaaaugauagaacgacaaaugaaugacacgcgauauauaagcaaauacaucucuggaguacuaucaaacauuguacgagucgaagacggcacagacgaggguguuaauuccaaaaauauagucccggguaaugggaaaauaacaacacagcuuaaacaagacuggggucuuaacgacguguggaacgaccuaauacuuccacgguucgaaagaaugaaccaccuuaccaauucaaccgacuuuacagcauggaaugagaaccaccagaaauuucuucccaccguuccuguagaguuuucuaaaggauucaguaaaaaaagaaucgaccaucggcaccaugcuuuagacgccuugguaauagcaugcgccacaaaagaccacgucaacuuauugaacaaccaaucagcuaaaucagacacaaaacgguaugaucuaaaaaagaaauuaaugaaauucgaaaaaguagcauacaaccacccacaaacuggagaaagaauugaaagagaagcaccaaaacaauuucucaaaccaugggaaacguucacuauagaugcaaaaaaccaccucgagacaauaauaguaucuuucaaacaaaaccuuagaguaauaaacaaagcaaccaacuauuaugaaaaauauguagaaaaagagggaacgaaaguuaaagaacgaguagaacaaaaaggaacaaauugggcaauaagaaaaccuaugcauaaagaaacuguaucagggaaaaucgaccuaccgagaauuaaaguaccaaaagggaaaauauuaacagcaacgaggaaaucacuagauacaaguuuuaaccuuaaaacgaucggcucaauaaccgauacaggcauccaaaaaauacucaaaaacuauuuacaauauaaagauaacaacccagaauuagcauucucaccagaaggaauagaagacaugaacaaaaauauugaaaaauucaacaacggaaaggcacaccaaucuaucucaaaaguuagaguauuugaacuagguucuaaauuuccccugggccaaagugguaacaaaaaggaaaaauaugucgaagccgcaaaaggaaccaaccuauuuuucgcaauauaccaagauaagaaugguaaaagaucauaugagacaauaccacucaacgaagucauagaacgacaaaaacaaggccuaucaguaguugaccugaaaggaguagaugauuucuaccucucaccaaaugaucuagucuacgugccauccgaagacgaguuagaaaauauauccaugauugacuucaauaaaaugucaucugaaaggauauauaaagucguaagcuucaccggaaaccaaauauucuucguucgccaagauauagcgacuucagugguaaacaaagcagaauuuucuacacuaaauaaaauggaaagagccauagacgggacuaugauaaaagaaacaugcguaaaacuccaaaucgauagacuaggcaauauuucaaaaauuuga

SEQ ID NO: 5656 - RNA, 4281 nt, Artificial Sequence
  Cas9 variant
auguauaauauaggacuagacauaggaaccggaaguguaggcuggugucuaacagacgaaaacggcuaucuccucaaaguaaacagaaaaggaaacaaugguaacaccuacagaaacagcgcauggggaguacgacucuucgaaagcgcugacacggccgcagauugccgaauaaaacgcagcacaagacggcgauacaaaagaaggcgaaccagaaucauagaacucaggaaaauaaugagugacaugauaaugccaauagauccaaacuucuacgcacgacuugacgaagcuuuuuuauggaaugaggauaaaagugauaaggccaaagcaccauuuuuacuauuuaacgauaacggauaugacgauguaaaauacuacacagacuacccuaccaucuaccaccuaagaaaacaucuuuuagaaaccaaagagaaggcagaucccagguucaucuauuuagcacuucaucauaugaugaaauacagaggacacuuuuuauucgaaggacagucauucgaagcuauugauaauaucgaagacacauucaucgaauuagagcaccuaguuaacguguauguaaaagaaaaagaagacacagacaacaacgcagaaaacaacgcacuauaccaggaaaugaaaaacuaccuagcugauaauaagguaaaaaauaaagacaaaaaagaauacauaacagacacauucauaaaagcagauuaugacaacaaauauucaaaagaauuagcugcagcuguguuaggauacgaguuuaacguagguauaauagucaacgacaacucacuaacugaugaagacggaaaagcacugaaagccaaauuugcagacgcaaaauaugaagaaaaagaggaaaaauuauccgacacauugggagaaagauacuacauuauagaaacgcuuaaaaaaauuuauaguuggaaagucuuacacucaauacuaggcgacaauaaauaucuaagcuaugcuauggucgacaaauacgaaaaacauucagaacaacuaaaagcccuaaaauacuuauuucacaaguauacaagccaggacgaauauucagaauuuuuccaucaagaaaaaaauaaagaagggaaauauauuguaaacuaugcuaacuacauuaagggcaucaaaagacucaguaacgaaaccaacaaaaaauauaauacuaaacaacaauuauaccagagcauaaugaagauccuaggagagagagcggcagacgacgaaguauacaagaaaauuuuaguagagauggaacaagaaacauuuuuagaaaaaauuaauaacguggacaacagcgccauacccuaccaacuuaaccuaauggaaauggacaaaauuuuaacacaacaaggugucuacuauaaagaacuuagagauaacaaagaacuguuauuaaaaaugcuaaccuccaaaauaccuuauuacguuggaccacuaaauaacaacucaaacggcaauagaaacuucgcuuggaugacaaagaaagacgggaaagagaaugaaaaaguauacccuuggaauguuaaagacgucguagacauagauguaacagcugaagacuucauaacuagaaugacaaauuauugcacuuaucugccuaaugaaaaaguacuuccuaaagagucacugcuuuaucagcgguacaugcuacuggaagaacuaagucaaaucaggaucgauggcagaaaauuaaguaaagaagaucguaaagcuauaauuaacgaucuuuucauaggcaaagggcguguaaagguuagugacaaagauuucaaggaauauuugaauaaaguuaauuauguaaaaguaaacgguaaaggauaugacguuaccggauaucaauccgacgacggguucgcgugcgcucuaucaucauacaauaaauucagacgaauacuuggacacauugaugaacagaacgaaaaaaugauagaagacaucaucuacuggauaaccguauuugaagacaaggacaucguaaaacgaaaaauuaacaaacaauacgcagacaggcuuagugcagaacaacugaaaaaaauccuaaaacuaaaauucaaaggauggggacgauauucaaguaaacuccuaaacgguauuaaaggagauauggguacgacaauaauugaaauguuagaagacgcagaugaaagauucgcuuacugcgauuauugcccaaauuucaugcaaauaauuaauaaggacgaaaaaauaaaacagauaauugaugauaacagaccaagauacgauggaacgaaggaucuuuuagacguuauacaagauaugcauacaagcccagccaauagaagaggaauuuggcaaacaaugaaagcaauagaagaaauaauugaauacaugggagaaaaaccccaacaaauauauauagaauucgcuagagaggacgacccaaaagcaaaaaacaagagagcagauaguagaaaacgagcuaucgauaaggcccugaaaaaacugaaagaagauguaguagacgaauacaacgaaaaggucuacaaagaauuaaaacaauacgaaaaaagacuggaugaagaaaaaguauauuuguauuuuaugcaaaauggcaaagaccuauacuuuccagauaaagaauuaaacuuagacgaacucgaaaaacuagagauagaccauauaaucccauauucgcuaucagacgaugacucguuagacaacaaagcucuuguacuaaaaggaaauaaucaaaauaaaggaaacaaaauagugaaagaagcuuucccacaauuauucucaaacucuggaacagucaacuauuggaaaaaccuaaaaaaggcaggucuuauaucagaaaagaaauacaauaaucuacaaaaaaacaauguugacgacauauuaacaaaaggauuuauuaaucgacaacuaguagaaacaaggcaaauaguaaaaagcgucgcaaaucucauacuagacuauuacaaugagcaaauagacgucauagaagucaaagccucacuuuccaccucaguaagaaagauguugacguaugagaagaaagauaacaaugguuuuuggauagaaaauaaggacaauuguauguuuuacaagaaccgagacaugaacgacuaccaucaugcacaugacgcauaccuugcaaauauaauaggacuguacauucaaaaaaauuauccgcgauuacaaaaagaauuaaauuauucacaauaccgaagaauauggagaaaauauuacgaaaacacaaaaaacaacaacgggguaaauugguucgccaccuuaggaaaauucucaagcaacaaugaagaagccgacugguacgggcaagauauuaucgcauacaugagaaaaauauuuuguuauagggacguacuaauauccaaaaaaguggaagaaaacaccggugcauuuuacagugaaaccaaguacccacgcgaagacaaagcgggaucaaaauuagucccccuuaaacaaggaaacaacaugaggggagcaaacaaucugaaagaauuggacgcucggaaauacgggggauauaaaggaggcgaaaaggccuauuucguacuaguaaaauacuguaucgaaaaagcauuaaaaaaaaaaguaaaaaaagaauaucauauggaauuugucgaaauuccugucuauauagcaagaggaaucaagaauaaagacauaaaccuauaugacuauguuugcgacauucuaaacgaagcuaacaaaaauucaguagcagacguagaaauacuaagaaauaaaguuccuaaauaucaaaugauaauaggcgaaaauggcgaagaauauuauuuaguaagcgcaacagagguaauaaauagcaaacaauucguauuaggaggggccaaccaacaauauaauagacuucuaaacuauaucaaauacgguaaaaaugacaaauggcaauacauacaaacagaacucuuagacgaacaauuaauaggacuuuacaacuuauuaaucgcaaaaauaaaagaugaauauaaaggcuucucgaaagaagcaguaagaauacaggaaaacaacucauucgauaaauuagacguaaaagacaaaaaagaauuuaucgcagagaugaucaaacugguacaaccugauucagauuacccauacuugggaaaauaugcuacaggacuguccaacagaaugggcaggaaaacaggggagaaaguugggaaaaaaauaacauuagucgauaaaagcguuacuggacuauaugaaaggcgaacaacuuuugaacuagaagacgauuccagcacaaaaucauguuga

SEQ ID NO: 5657 - RNA, 4281 nt, Artificial Sequence
  Cas9 variant
augaaaaauauacucggcuuggaccucgggacuaccagcauagguuuugcgcacaucguggaagacgaaaacaaagaaaaaucagaaauuaaagaacucggaguaagaauaguaucgcuaacuacugacgaacaaagugauuuugaaaaaggaaaaagcaucaccacaaaugcaaacagaacacuaaaacacggagcacgacuaaauuuagaccgcuaccaacaacgacgcaaauacuuaauugaccuauuacaaaaagcuaaccuaauaacaccauccucaauuuuagcagaaaaugguaaaaacaccacucauagcacuuggcaacuaagagcaaaagcuguaacagaaaggauagaaaaagaagaauuugcuagaauauuauuagccauaaauaagaaaagagguuauaaaagcagucgcaaagcuaaaacagaagaugaaggacaagcuauagauggaauggcuaucgcaaaaagauuauaugacgaaaaccuuacuccaggacaacuuucauuacaacuccuacaacaaaauaagaaacuauuaccagacuucuaccgcuccgaucugcaaaaagaguucgaccuaguauggaacuuucaaaaacaauuuuauccggauauuuuaacagauauuuucuacaaagaacuacaaggaaaaggaaaagacgcgacaucgaaagcauucucuaaaagauaccacuuugauacaacugaaaauaaaggauccaaagaaucuguccgucugcaagcauaccaauggcgugcggaagcaauaucaaaacaacuaagcaaagaagaaguugcauacguacucacagaaauaaacaauaaccuaaacaacgcaaguggauaccuaggugcaauaucagauagaucgaaagaacuauacuucaaucgccaaacagucggccaauauuuauaugcaaaauuacaagaaaacagacacaacagucucaaaaacaaaguauucuacagacaagacuaucuagacgaauuugaaagaauaugggaaacacaagcaaguuuccauaaagaacugaccgacgaacuaaagaaacagauucgagauguugugauauuuuaccaacguaaaccaaaaucacagaagggacugauuaguuuuugcgaauuugaauccaaagagauagagaucgaaaaagaugguaaaacaauuacuaagaauauuggagcaagagucguaccaaagucaucccccuuauuccaagaguucaaaauauggcaaauacuuaauaauguuauauguaaaagaaaagguauucggaaaaagaaaauuuccgcuaaaacaacgcaacuagaucuauuaaaugaaagcagucaaacaauauuuagucuagacauggagugcaaacaacucuuguuugaugaacucaaucuuaaaggagaccuaaaaucagauaaaguauuaaaacuacuaggauacaguccccaagaaugggaaauaaauuacaaccaauuggaaggaaaucgaacccaaaaagcauuauacgaggcuuaucuaaaaaucgucgaaauggaagcgcaugauguaaaagauauacuacaaauuaaaagcgccaaagaugacuggucgcuagaugaauccccacuaucagcaucagaaauacgagaaaaaguaaaagccauauuucaaacacuaggcauuugcaccaaaauauuauacuucgauccacuacuccccguaaaagaauuugaagaacaagacucauaccaacuauggcaucuccuuuauucauaugaaucagaugauagcaccucugguaaugaaacccucuaucguauucuugagaagaaauaugccuuuaaaagagaacacgcaaggauuuuggcaaaugucgcacuucaagaugacuaugggucacugucaaccaaagcaauacgcaaaauauacccaaauaucaaagaaaaccaauauuccacggcuugcgaaaaagcaggcuacaaacauucaaaacuuucacucacuacagaagaauuggaagcgagagaacuuaaaaauauaauaccacuacuaaagaaaaacgcauuaagaaacccaguaguugagaaaauccuaaaccaaaugauaaacguaguaaacgcccuaauugagaaaaacucugaaagagaugcagaggggaaaaucacaaaauacuuccauuuugacgaaauacggauagaauuagcaagagaacuaaagaaaaaugcacaaaaacgcuaugaaaugacccaaaauauuaacaaagcaaaauuggaacaccagaaaauaucggaaauccuucaaaaagaguucggaaucaaaaaccccacuaaaucagacauaauaagauacagguuauaccaagaacucgagcauaacggauauaaagaacucuauaccaaugcaccuauagcgcgggauaugcuauucuccaaaaauaucgaaauagagcauauagucccuaaagcucgcguauucgaugacagcuucagcaacaaaaccuuaacauuccauagaaucaauagugauaaaggcgaauauacagcuuuugacuacauaacuucguuaaacucugaagaagaauuaaaccaguacuuaacgagaguugaaaacgccuauaaaacaaaaucgauaaguccuaccaaauacaaaaaccuccugaagaaagcauccgaaauaggagacgauuucauaaacagagauuuaagagacacccaauauauugccaagaaagcaaaagagauuuuguuucaaguuacuaaaaacguauuauccacaucaggaaguaucacugaccgacuaagagaggacuggggacucguugacgucaugaaagaauuaaacaugccuaaauaccagagccuagggcuaacagaaguagaagagagaaaggaugguaauaaaguaacuguaauaaagaauuggacuaagagaaaugaucaucgccaucaugccauggacgcacuaacaguugcauucacaaaaccaucuuauauccaauaccugaaucauuuaaacgcucgcaaagaugagaauaacaaaaacuacagcguuauauuggcgauugaagaaaaagaaaccauaaaagugccaacaaacaacgguaaaaauaaaagagucuucauagaacccauaccaaacuuccgacaaguugccaagaaacaucuagaagaaauauucauaucacauaaagcuaaaaauaaagucgucacgaaaaauacaaauaaacccgcagguacagacaaacaacaaauaacacucacaccgcgaggucaacuacacaaagaaaccauauacgggaaauaucaguacuacauaaauaaagaggagaaaauaggagucaaguuugacgaacgcacaauugcaaaaguaucaaacccaguauacagagaagcucuccucaaaagacuccaggccaacgacaacgacccaaagaaggcuuuugcagguaaaaaugcacuaucuaagaacccaaucuaucuugaugaaaguaaaacgaaaacacuaccagaaaaaguaaauuuaacauaucuagaagaagacuucuccaucagaaaagauauaucccccgacaacuucaaagauuuaaaaucuauugagaaagucaucgaucaaggaguaaagagaauacuuauuaaaagacuucaggcauacgauaaugaccccaagaaagccuucguagaucuugagaaaaacccuauauggcugaacaaggaaaaaggaauagcuauaaaaagagucacaauuagcggaguaaauaaugcacaaccucuacauauugggaaagaucaucuaggcaaaacaacauuaaacaaagaaggaaaagaaauacccguagauuacguaucuaccggaaauaaccaccacguagccauuuaucgcgauaaagaaggcaaccuucaggaacaaauaguaucauuuuucgacgcaguaguaagagcucaacaaggaaucccaauaauagauaaaacauacaaacaagcugaaggcuggcaauuucuauuuaccaugaaacaaaaugagauguuugucuuuccaaaugcaacaaccggauuuaacccggcagaaaucgaccugcuagaucccaaaaacaagaaacucauaucaccaaaccuauuuaggguacagaaaauagcaacaaaggauuacuucuuucgccaucauuuagaaacaaacguugaaaccgacaacauacucaaaaaugucaccuggaaacgugagggauuaucuggacuuaaagacauagucaaaguccgaauaaaccaccuaggagauauaguauccaucggagaauacuga

SEQ ID NO: 5658 - RNA, 4281 nt, Artificial Sequence
  Cas9 variant
augaagaacauccugggucucgaucuaggcacaacaaguauagguuucacacacauaguagaagacgagaacaaagaaaagagcgaaauuaaagaacuaggaguaaggaucguuucauuaacaacggacgaacaaucagacuucgaaaaaggaaaaaguauaucaacaaacgccaaucgaacauuaaaacacggugcccgccuaaaucuagaccguuaucaacaaagaagaaaauuccuaauagauuuacuacaaaaagcuaaucuuauaacuuccucaaguauacucgccgaaaauggaaaaaacacaacacacucaacauggcaacuucgagcaaaagcugucacagaaagaauugaaaaagaagaauucgcucgcguauuguuagcuauuaauaaaaaaaggggcuacaaaucaucuagaaaagccaaaaccgaagacgagggacaagcaaucgacggaauggcaauagcaaaaagacuuuaugacgaaaacuuaacuccgggccaacucucacuacaauuauuacagcaaaacaaaaaguuguuaccggacuuuuauagaucagauuuacaaaaagaauucgacuuagucuggaacuuccaaaaacaguucuacccagauauacugacagacucauucuacaaagaacuucaaggaaaaggaaaagaugcaaccucaaaggcuuuuaguaaacgguaucauuucgacacggcagaaaacaaagguaguagggaauccguaagacugcaagcauaccaguggagggcagaagccauaagcaaacaacuaucaaaagaagaaguggcuuacguccuaacugaaauaaauaacaaucucaauaacgccuccggguaccuaggcgcuauaucagaccgaagcaaagagcuuuacuucaacagacaaacaguaggucaauaccuuuacgcacagcuccaagaaaauaaacacaauucauuaaaaaacaagguuuuuuauagacaagacuacuuagacgaauucgaaagaauaugggaaacccaagccucauuccauaaagaauuaaccgaagaacuaaaaaaacaaauaagagauguagucaucuucuaccaacgaaaauugaagucucaaaaaggacucauaagcuuuugcgaauuugaaaguaaagaaauagaaauagaaaaagacgggaagacaaucacaaaaaguaucggagcucguguugugccuaaaagcucaccacuuuuccaagaauucaaaauauggcaaauauuaaacaaugucacaugcaagagaaaaggcauacguaaaaagaaaaguuccgccaaaucuacugaauuagaccuuuuuaaugaaccgucacaaacaaucuucagccuagauauggaauguaaacaguuauuauuugaagaauuaaaucuaaaaggagaccuaaaaagcgauaaaguauugaaacucuugggauacuccccacaggaaugggaaauaaauuauaaucaauuagaaggcaaccgcacgcaaaaagcacuguacgaagcguacuuaaaaauaguugagauggaagcgcacgauguuaaagauaucuuacagaucaaaagcacuaaagacgacugggcauuggaagaauccccccuaagcgcauccgaaauccgagaacgaguuaaggcuauauuucaaacacuagguauaugcacaaaaauacuuuauuucgacccgcuguuaccaguaaaagaauucgaagaacaggauucuuaccaauuguggcaccuccuauacaguuacgaaagcgaugauaguacauccggaaaugaaacacucuauagaauacuagaaaaaaaauacgcauucaaaagagagcacgcuacaauauuagcaaacguaaccuuacaagacgacuacgggagcuuaaguacgaaagcaauaagaaaaauauacccguacauaaaagaaaaccaauacagcaccgcgugcgaaaaagcuggauauaaacauucaaaacuaagcuuaacgacagaagaacuagaggcccgagaauuaaaaaacaucauucccuuacuaaaaaaaaacgccuuacgcaauccaguagucgaaaaaauacucaaccaaaugauaaacguaguaaaugcauuaauugaaaaaaauagugaacgugaugcggaaggaaagauuacgaaauauuuccacuuugacgaaauaaggauagaauuagcaagagaacucaaaaaaaaugcacaagaacgauacgaaaugacacaaaauaucaacaaagcaaaauuagaacaccaaaaaauaucaggaauccuacaaaaggaauuuggaauuaaaaacccaacuaagucugacauaacaagguacagauuauaccaagaauuagcacacaacggauacaaugaccuauacacaaauacauauauaccgaaagagcuccuuuucagcaaaaauauagauauugaacauaucguuucuaaggcuagaguguuugaugacucauuuaguaauaaaacacuagcauuuagagaauuuaacauuaaaaaaggagaauccacggcauuugauuacauaacgucuuuaaacaacgaagaagaauuaaaucaauacuugaaccggguagaaaacgcauacaaaaccaagaacauaucacccgccaaauacaagaaccuuuuaaaaaaggcuucugaaauaggagauggguucaucaauagagauuuaagggacacacaauacauagcgaaaaaagcuaaagagauacuauuccaaguaacaaaaaauguacuaagcaccaguggaucaauaacggacagacuaagggaagacugggggcuaguugacguuaugaaagaacugaacaugccaaaauaccaaagccuagguuugaccgaagucgaagaaagaaaagaaggcaauaaaguuacagugaucaaaaauuggacaaaaaggaaugaucaucgacaucacgcaauggaugcacuuacaguagcauuuaccaagccuaguuacauacaguaucuaaaucacuuaaaugcgagaaaagacaagaacaacaagaacuacuccguaauccuagcaauagaagaaaaagaaaccauaaaaguacccaccaacaacggaaaaaacaaaagaguuuuuauagaaccaauacccaacuucagacagguugcaaaaaaacacuuagaagaaauauucauuagccacaaagcaaaaaauaaaguaguaacaaagaauacaaauaaacccgcgggaacagacaaacaacaaauuacccugaccccacggggccaauuacauaaagagacaguauacgggaaauaucaauacuauguaaauaaagaagaaaagauaggaguaaaauucgauaaagaaacaauagccaaaguaagcaacccaguuuacagagaagcccuauugaaaagauuacaggccaaugauaaugacccaaaaaaagcauuugccggaaaaaacgcacuaaguaaaaaccccaucuaccuagacgaggccaaaacaaaaacccuuaccgaaaaaguaaaccugaccuacuuagaagaagauuucaguauacgcaaagacauaucacccgacaacuuuaaggaccuaaaaaguauagaaaaagucauugaccaaggcguuaaacggauacuaauaaaaagacuucaagauuacgauaaugacccgaaaaaagcuuuugucgaucuagaaaaaaaccccauauggcuaaauaaagaaaaaggaaucgcaaucaaaagagucacuauaaguggugucaacaaugcccaaccauugcauauagguaaggaccaccuagguaaaacaacccuaaacaaagaagggaaagaaauaccgguugacuaugucuccaccgguaauaaccaccacguugcaauauaccgagauaaagaaggaaacuuacaagagcagauaguaucguucuucgaagcgguggucggcgcccaacaaggccuaccaauaguagacaaaacguauaaacaagcagaagguuggcaguuucuauuuacgaugaaacaaaacgaaauguuuguguuuccuaacgaagcuaccggauuuaacccagcggaaauugaccuacuagacccaaaaaacaaaaaacaaauuucacccaaucuauucagaguacaaaaaauugcuacaaaagauuauuucuuccgucaucaccuggaaacaaacguagacacagauaacguucucaaaaacacuacauggaaacgagaaggccuauccggccucaaagacauaguaaaaguaaggauaaaccaccugggggauaucguuucaauuggugaguacuga

SEQ ID NO: 5659 - RNA, 4284 nt, Artificial Sequence
  Cas9 variant
augaagaaaauacucggauuagaccuuggaacuagcaguauaggcugggcacugguaaaugaagcagaaacgagcgaagagaaaaguucaauaauaaaauuaggaguacgaguaaauccccuaacaguagacgaacuucaaaacuucgaaaaaggcaaaagcauaacaacaaacgcagaucguacugcaggaagauccaugagacgaaauuugcaaagauauaaacucagacgagaaaaucuaauagaaguauuaaaagaauacaacuucauuacugacgaaaugauauugagugaaaacggaaacagaacaacauuugaaacauaucgauuaagagcaaaagcagcaguagaagaaauaagucuagaacaauuugcaagaguacuacuaaugaucaauaagaaaagaggauauaaaucuucaagaaaagcaaaaggagcagaaaaugguacacuuaucgacggaauggaagucgccaagaaaauguaugaugaaggaauaacaccaggagaacuuugucuccaacuauuaacagcgggaaaaagauauuuuccagacuucuaucgaagcgaucuacaagcggaauuugauagaaucuggaacuuccaaaaacaauuuuauccagauaguuuaauagauaaaguaaaagaugaaguacgagguaaaaauaaaagccaaacaugggcaauacuagccaaauauuucguuuggaaagaagucgaaaacagcuggaacgaagaagaagcgcaaacuagaagaguagaaaaagaauacagauuagucggcauaaaacguggaguuaaacgagaagaacuaaaacuagaaaauuuucaauggaggguaaaagcgcuaagugaaaggaugaacccagaagaauuagcaauuguauuacaagaaauuaaugaacaaauaucuaacucaagcggauaucugggggcaauaagcgacagaucaaaagaacuauacuucaaccgacaaacugugggacaauaccaaauggcaguucuagauaacaaucccaacauaggacuaagaaacaugguauucuauagacaagauuaccuagacgaguucaauacaauaugggagaaacaagcagaauuucacaaagaauugacagaagaucuaaagaaagaaauucgcgacauaguuauauucuaccaaaggagacuuaaaagccaaaaaggauuaauaaauauaugugaguucgaaagacgacaaauagaaguagaaauagauggcaaaaagaaaauaaaaaccauaggaucaagaguuauuccacgcaguuccccacuauuucaagaauuuaaaauauggcaaacacucaaugauauagaggucagcguauugggcguuaaaaacaaaagaaagaaacaagaugauaacucaaccacacuacuagacucagcagaaaacauagacucacugaaacucaacguaaguagaccacuagaugcagaugagaaaaguuugcuagcaaaagaacuauuuauccgagacaaacuuaccaaaagugacguacuuaaauugcuguucaacaacccacaaaacuuaaaccugaauuuuaaaaacaucgacggaaaccggaccggcagcgcacuauaucaagcauuuaguaaaauuuuagagauaaguggccacgaaucgaucaauuuuaagaaaucagcugacgaaaucguggaacaagucaaaacuaucuucuccgcauuaggauggaacacugaaguacuuugcuuugauucagaaaaagaguuagacaaacaaccauacuuuaaacuauggcaccucuuguacucauucgaaggagacaguacaccaacaggugaugguaacuuaauacagaaaauugcggacuugugcggguucgaaaaagacuacgcuaguauacucgcaaauauaacauuccaggaggacuacggauccuuaagcacaaaagcaauaagaaaaaucuuaccccacuuaaaagacggaaaucaauaugacguagccugcgaguacgcgggcuauaaacacagcaaaucaucccuuaagaaagaggaaaucaaaaauaaagugcucaaagauaaauuagaacuacuaccuaaaaauagucugagaaacccaguaguagagaaaauacuaaaccagaugguuaauguuaucaaugcuauaauaacaacauauggcaaaccagaugaaauacguaucgagcuagcacgggaauuaaagaaaaacgcuaaagagagagaagaauugaccaaaaguauaguagauacuacuaaaacacaugaaggaauaagagcuauacuacagaaugacuucgggaugagccauguaucuagaaacgcaauuauaagauauaaauuauaugaagaacuaaaagauaacggauacaaaacucucuauuccaacacauauauaccgaaagaaaaacucuucucuaaagauuucgauauagaacauauaauuccucaagcaagauuauucgacgacucuuuuagcaacaaaacacuugaaguaaaaaguaucaauauagagaaaggauccaagacugcguacgauuucguugaagaaaaauauggcgaacaaggucuacaagaauaucuuaaccgaugugaaguacuuuuuagggacaaaaagaccaaacucagaaaguuaaaaaugcaagaaagcgaaauaccagaaggauucauagacagagaucugcggaacacacaauacauugccaagaaggcuuuaucgaugcuaaacgaaauaugcaggagaguaguggcaaccaccggagcaaucacugaugaguuacgagaggauuggcaacugguugauguaaugaaagaacuuaauugggaaaaauacaaaguucucggauuagucgaauauuucgaagacaaugaugggcgauuaauaggcagaauuaaagacuggaccaaaagaaacgaucaccgacaccacgcaauggacgcacuaacgguagcauucacaaaagauguuuuuauacaauacuuuaacaauaaaaaugcaucacucaaaccagauaccaaugaagcggcaauacgaaauaaauauuuccaaaauggaaaagccauucccccaaugagcuuggaugaguucagagcagaggccaagaaacaucuaaaugacacacuuaucaguaucaagacgaaaaauaaaguagucacaauaaacuuaaaccgaaccaagaagaaaaauggaauuaauaagaaacagcagcaaaccccucgaggucaacuacaucuagaaaccguauacggaucacacaaacaauaugucguaaaagaagaaaaaguuaaugccucauucgaugcggcuaaaauagcuacuguaaacaaaccugcuuacagagaugcacuucuucguagauuacaagaaaacggaaacgauaguaagaaagcauuuacagguaaaaacagucuggacaaacaaccaguaugguuagaugcaaaacagaacgaaugcguaccugaaaaaguuaaaacagugauguuagaaacagucuacacagucaggaaaccuauagaugagaaacuuaacguugauaaaguaguagaugcaagaauacgcaaacuacuacaagauagaaucaaagaauauggaaaugccaaaucugcuuucgccaaccucgacgagaacccaauauggcuaaauaaagaaaaaggaauaacgauaaaacgaguaaguguuaguggaaucucaaaggcucagagcuuacaugaaaagaaagacaaagaugggaauuucauccuugacaaggauucaagacgaaucccaguagacuuugucaacacagguaauaaccaucauguagccauuuaucgcaaaccagugcucgacaagaaaggucaagcaguauucgacgaaaacggagagcugaaauuugaacuugaagaaguaguaguaaguuucuucgacgcuguaacaaggguaaauuugagucaaccaauaaucgacaaagacuauaaaagaagugaaggauggaaauuucuauuuagcaugaaacaaaacgaauacuuuguuuuuccaaacgaaaagaccggauucgaccccaaagaaauagauuugcucaacccugaaaacuaugcucuaauaucacccaacuuauuccgaguacagaaaauagccaguaaagacuacgucuuccgucaucacuuagaaacggugguagcggaccgaaaggaauuacaagagauaacauggaaaagaauaagcucacugucaauauuaaauagaauaauaaagguuagaguaaaccacauaggccaaauaguuaugaucggugaauauuga

SEQ ID NO: 5660 - RNA, 4284 nt, Artificial Sequence
  Cas9 variant
auggcaaaaccgaaagacuauacaauaggacucgauauuggaaccaauucagugggauggguagugaccgaugaucaaaauaauauauugcguauaaaaggcaagaaagcgauaggagcacgacuauucgcugaaggaaaaguugcagccgaacguagaucauucagaacaacacgccgaagacuuucaagaagaagguggagaauaaaauugcucgaagaacucuucgacaaagaaauagcaaaaguugaccccucauucuucgcacgauuacaugaaucuuggauuucaccuaaagacaaaagaaagcgauacucagccauagucuuuccaucuccugaagaagauaagaaauuucacgaaucuuauccgacuauauaccacuuaagggacaaacucaugaaagaugaccaaaaacaugauauaagagaaaucuauauugccguacaucaaaugauaaaagcaagaggaaauuucuugcacgaugaaagcguagaaacuuacagguccggaaugucaucucuaggaggaagaucagaacgaacuauacugagcguccaaacccuagaagaauuaaaugacuuauucgcagaaaacgaagguacagaagaagcuaaauuaaauguagcaucagcagaacaaauaaaugauauauugacagggggucauuugaacgcagauucacaaaaagaaauugguaauuuauuacucccaagcagcuuuccaucauuugaugauaaagcaaaagaaaaacaagucaagaaauugaucaaaaauguagcaacaaauauaucaaaagcauggcucggguacaaagcagacuuuucgacuauacuaaaucuagccaacguagauaaagaccagaagaaaauauucgccuucgcauuacaaggaggagaugaagaagauaaaguacaagaauuagagagcuuacuagaacaaucacaaacagauaucguagacagacuaauagaaaucaggcacgcaauuguauuaucagaaauuguaccgguagguaugacacuaagugaagcuaugauagauaaauacgaccaacauaaagaagacuuaauaacacucaaagcgguaauucguaauacgaaagacaaaaagaaagcugcaaaauuacaagcaauuuacgaucuauaugucaacaauagacacgcagaucuugcuaaagcaaugaaacuuacaggaauuaagaaacgaucugaacuauuagaccccgaagaacuuaagaaagccauaucaucuuuauuggaugauucacccgaagcuguagaaauaaaacaaaugcuugaagagaaaacauuucuacccuuacaaagaucaaauaauaacggcgucauacccaaucaauuacaucaaguagaauuagaugaaauaaucaagaaacaauccaaauacuacccauuuuuagcagagaaaaaucccgaugaaucagaagaagcgcagaagaaagcuccaacaaaacuagaugcauuacuaaccuucaggguaccauacuacguugguccgaugauaacgaaagaagaacaagaagcacaagacggccacaguuuugcguggaugguaagaagagacccgcaagaucacgaagcaauaacaccauggaauuuugaaaagaaaguggacaaaauggcaagcgcaacucaauuuaucaaaaggaugaccaccaaagauacguaucuacuaggugaagauguucuuccagccucaucguuaaaauaucaacuauuuacuguuuugaacgaacucaacaaccuccgaguaaacggcaagaaauuaacaagugaugaaaaagaacaaguaauagaaggacucuucaagaaacagaaaacgguaaaagccgacaaauuuguaaaauacuggcaagcaaaacauauaggugcagauauaaaaguaaaaggucuuucugacccaucgaaauuuaacucuacaaugaguacauacauagauuuuaagaaaauuuuuggagaccaauuaaaugauguaaaccgucagaaugauuucgagaaaauaauagaauacucuacaauauuugaagaccgcaaaauucuagaagauaaacuaagagcagauuucgcaugguuaucagaagaacaaauaaaacaacucuguagauuacgauuacaagguuggggaagacuaagcgacaaauuacuuacuagacuaacugaugcugaugggcaaaacguauuggaaagacuuuggaacucaaacgacaauuuuguccagauaguaagcgauccaaauauuaaagccaaaauagaacaagaaaaucaaaaacuacucagagauggucaaucagaugacgcaguugaauccauccuagaugaugcauauacaucaccacaaaacaagaaagcgauucggcaaguaaugaggguagugcaugacauagucaaagccugcgaugguaacguaccugcuaaauucgcaauagaguucgcucgcagucaagaagacgaucccaaacguacaaccgcgagaguaaaccagaugcagaaaauauacgaccaaauaagcgaugagguagucucucaagguguuaaagaacagcucucagguaugaaaucacuuaaagacagauauuauuuauauuucaugcaaggcggacgggaugcauacacaggagccaaauuaaacauagaucgacucucagauuaugacauugaucauaucaugccccaaaguuuugucaaagaugauucacucgacaaccgugucuuaguugcaagagcaguuaauaaccagaaaagcgauaaaguaccagcacuauuauuuggaaacaaaguuguagcggaccuaggaauaacuguacgcgaaaugugggauaaauggcaaaaauuaggaaugauuuccaaaagaaaauuaaguaaucuuuuaacggacccagacgcccuaacagaauauagagcucaagguuucauacgaagacaacuuguagaaacuucacagguaauaaaauuaaccgcaacuaucuuacaaucugaguuccccgacucaaaaauaauagaagugccugcuaaauauaacaguaucguaagaaaacaguucgaccuauacaaaucacgagagguaaaugauuaccaccaugcaaucgacgcauaucuaaguacaauagucggaaacuauuuauaccagguauacccaaaccugagaagaauguucgucuauggagaauuuaagaaauucucauccaaugcggaagaaagcgcauaugacguaguucggagaguaaaauccaugaauuuccuugaugaucugcuucgaggcacucauggagacaauauauauugcagaagcacaggagaaauaguauucaaucgaaaugauauaauauccaaacucaaacaggcguauagcuucaaacaaaugcucgucacacaggaaguauuuacaaagaaaucggcacuauuugaucaaaccguauacccgucuccugaaagagacuccaaaaagagaaguggacuaauacccaggaagaaaggaauggauacagaaauauacggagguuacagcggaaacaaagacgccuauuuuguacucgcugaggcgguaaaagaaaaaggucacacauuacaaauaguaggaguucccauaagagcgcuaaauacccucaaaaauucagcaaacuauucggagaaacuacucgaaauaauuaaaccacaaguaauguuuaauaaagacacagguaagccuauaaaagguauaaaagacgucaaaauauuaauggauaaaauaccgugucgacaaccuguacuagaaggagaaucauauuacauguuagcaucaucuaaauaccgauacucacugaaacaaauaucauuaagucaaauguccaugaaauauauuuuagauuacauagaugacccaaauuuuaacaaacacgaaaugaucaauauagaccagcaagaugaaaaagagugucuucuuucaguauacgaugaaauauuagagaaaauggacaaauaccuacccuuauuugacauaagaucauucaggaagaaauugcacgacgguagagacgccuucauugcguuaccaguagcauccgaagagaagaaaccaggaaaagucgaugucauucguaaagucuuaaaaggacuacaugccaaugccgauauaacaaauuuagcagaguuagguuucggaacugcugcauuaggugcccuagucucaaccggcggaauuaaaauaagugacgaugcaguauucauauaucaaucaccaacuggucuauucgaacgaagaguaaagguaagcgaucugcuaaaauga

SEQ ID NO: 5661 - RNA, 4287 nt, Artificial Sequence
  Cas9 variant
augaagaaaauauugggcuuagauuuaggaacuacgagcauaggaagugcauacguauuagaggcagagaaaagcgccgaacagacuaaaauaguguaucuaggcacucgaauaauucugagcuccgcagacgcugaaaauuuuuccaaagguuuaagcuguucuccaacuaccgacaggacguucaaaagaucaaugaggagacgucuacaacgauauaagcaaagaagaucaucacucauccaacaauuuaagaagauuggaauuaucacaaacacugaacagauaauaagagaacccauaucagagacccacgaacuacuaaggaucagauccaaggccgucucagaacguguaucacuugaagaguucgcaagaauauuacuuacaaucaauaaaagacgaggguauaaaaguaauagaaaaacgucgaagaguacagaagaagacggaaagcucguugacgcgauggcagugacaaaagaacuuauaaaauuaaagaaaacaccgggccaauauauguucgaaagauucaaaagagggaaauaugcagaaaucgacuucuacccauucgaucucaucaacgaacuaaaacagauaugggaaguacaaggacaaaaauacccggauguacuaacugaagauuuacuaagcucauuacuuaaacagaaaacugggaaagccaaagaacuuauauacagcaaaagcgacuuaaacccagccgaaguaccaaucgacuaccaaaaagguaagaaauuacgaaaaacaauucuaaacaaauauuuugccuacgaaucuagaaguuuggcagcaacuaacauaauaccaguugaacaaguaauaaccgcaauuguagccauaugcaaacaaauuaacaauagcucgggauacuuaggagccauaggugacagaagcagaguacuguacgccaacaaucaaacaaucgggcaauaucuauaugaacgaaucaaagcaaauccccacgacagaauccgaggagaaguauucuauagacaggauuacuuagaugaauuugacagaauaugggaaugccagcaaaauuacuauccagcuauauugacaaaugacagaaaacaauuuauacguaaccgaaucaucuuuuaccaacgaccgcuaaaauccaagaaaucagagcuggcauucugcgaguucgaaucaagagaaguagaacacaacggaaagaaauacacugaaggauuacacguagcgcccaaaucuaguccuguauuccaacauuuccgacuauggcaaagacuaggccaaauagaaguaaguccacucaggaaauggaacaaacaaagcaacgaacuuuuugaacaacaaaaugacacagaucaagaacguauccuaaauacugaagcuaagcaaaaacucuucucauacuuaaauuugcuagaccaccucacagauaaugaaauauuaaacauacuagguuacaguccagauaaauggaagaucaacuucagggaaauaauuggcaauaggaccaauaacucaaugaugaaagcauuuuucaacaugaaagaaaugacugauggcgaacaaauaaauugggagaaaaauuuaacaaaaauaacaaauggacaaagccuaaucagcccagaacaaaucguagacuuaauaagacaauucuuugaaagagaaggaauuacaacaucacuauuguacuuugacccuacaacagacaauuuuagagaacaaucucacuacucccucuggcaccuauuauacaguuaugaagacgacaauaguccaaccggaacaaccagucucugcaaaacauuagcuaaaagauauggcauaccccaugaacuuugcccccugcucgcuucguuaaccuuugagccucaauaugguagccuaucaacaaaagcgaugagaaaaauccugccauuuaugcaagaaaacgguuacgacaaagccugugaauuagccggauacagacacagcgcauggacuaccaaagaagaaaacacagaaagaacccugaagaacucacucccacuauuacguaaagguagucuaaggaacccgguaguagaaaagauacuaaaucagaugacucacguaauaaacacacauauauccgaauacgggaaccccgaugaaauuagaauagaaauggcacgcgacaugcaagcaaacuccaagcaacgaaaagcaaugacaacagccauagcugaagccacaaaaagaaacacucaauuuauagaagaaauacaaaaagaguucgguuucaacccaagcaaaaacgaucucaucaaauacaaguuauggaaggaauuagcuccccuaggaaguaaaacccuauacuccaauaccuacauuccuaaagaagaacucuuuacagcgaaauuugaaauagaacauaucaucccaagggcuuuguucuaugacgauagcuucucuaacaaaacacuagaauuaaacagcguaaacaaauuaaaaggaaauaaaacugcccuugacuauauggacacauuaagccaagaacaagcaaaugauuauauaauaagagucgaagaacugaagaaaauaggugccauuacacaggcaaaauauaaaaagcuauuaauaagagaaaaagacuuaggagacgacuucacaaaccgagaucugacaaauacaagauauauaauccgacaugcugcugauaugcuacuacaaguaaccccaaguauaguccacacuaauggaucaauuaccgcaauucuuagaagagacugggaacugcuagacauccuaaaagaauugaaucugccgacuuacgaaucgauagauaggaaaauaucagauccaaaagaaaaacuaacggaaagcguugaaagaaaagacggacaagcgauuaaaaugaucaaggacuggaguaaacgugaugaccauagacaucaugcaauggacgcacuuauaaccgcucuaacgacgagaaagcaugugcaauaccuuaauggaaaccgaggcgcagaagaaacugauaagguucaaaaacuacaacaacucaaagcccuacgaaaacagcucaucggaagcgauggccauuuuauaccgccaaugcaugauaucagaguacaagcgaaggaagcucuuucaagaguuauaaucucaacaaaggcaaaaggaaaaguaacaacuccaaauacuaauauuauaugcuccagagauaaaacuacuggacgaaaaaucuacguaaaacaaacgacauuaaccccaagaggagcguugcauaaagaaaugcaauauggauguaaccacuacuaucuagagaaacaaauaccaauaggauccaaacuaacugaagaggaaauacgacucguaucuucaccaaaaauuagaaguauguuaagcgaacggcuucaagcauauaacaaugacccaaaaagcgcauuuaccgggcgaaacaguauggacaaaaagccacuagaagacaaaaacaagaaauuaguauauacagauaagaaagucaaacaaacaauucuagcgaaucgguucguaaaaagagauagaguaaacagcaaacuagacuuggacaaagucauagauacaggaauaaaaaggauuuuagaaagaagacugaaacaauaugggggcaaauaugaaacugccuuuucugaccuugaaaacaauccaauaugguuaaaugaagaaaaaggaauagcaauuaaaucaguacgcauuagagguaaaaauaacacaauaaccauacgacaaacgaauacaugcagaauaaaauacguagcaaacgauaacaaucaucauuuagcaguauacgcacuucccgacgguaguauagaagaugacauaguaucauucuuugaugcuguagaacgcucgagaaaaggacucccaauaauagauaaacacaaaaaccaaucacuaggauggaaauuuuuauuuagugucaaacaaaacgaauauuuucuacucccacagcaaggagaaaagauagauauagacacaggcgaaaucagcaugcaaacaacauucucaccgaaagacuuaucacccgaauauauaaugaacccagacaacuacgcagaacuugcaccgcauauuuuucgaguacaaucgauuucgaaaacuccacaagguaacagagacguaagaauuuacuuauucaaacaacaguacauauccggaagccaaaaagauucucuacacuuaaaaggaauaacacauaggcaaaucagcucggccaaagaccucgccgguuuaguaaaaauccgaguaaaucacuuaggucgaauaguagccgucggugaaaaauga

SEQ ID NO: 5662 - RNA, 4287 nt, Artificial Sequence
  Cas9 variant
augaagaaaaucuuaggacucgacuugggcaccgccuccauuggcucugcauacgugcuugaagcagaaaaaucugcagaucagacaaaaaucgucuacuuagguaccaggaucauacucucaucagcagaugcagaaaauuuuuccaaaggccuuuccugcucuccaacuacugacagaacauucaaaagaaguaugaggcgacgacuucaaagauauaaacaaagaaggucaucccucauacaacaauucaagaaaauaggcauaauaacgaauacagaacaaauaauaagagaaccaaucucagaaacacaugaauuacuacgaauaagaaguaaagccguaucagaacguguaagucucgaagaguuugccagaauccuauuaacaauuaacaaacguagaggcuacaaaucaaauagaaaaacaaguaaauccaccgaagaagacgggaagcuaguugacgcuauggcagugaccaaagaacugaucaaauuaaagaaaacaccaggucaauauauguuugaaagguucaaacguggaaaauaugccgaaaucgacuuuuaucccuuugauuuaauaaaugaauuaaaacaaaucugggaaguucaaggacaaaaauaucccgacguacuaacagaggaccuacuaucaagccuuuuaaaacagaaaacgggaaaagccaaagaacuaauuuacucaaaaucagacuuaaauccagcagaagugccuaucgacuaccaaaaagguaaaaagcuaagaaaaacaauacugaacaaauauuuugcauacgaaagucguagucuagcagugacaaacauuaucccaguagagcaagccaucacugccauuguagcaaucuguaagcaaauaaauaacagcucggguuaucucggagcuauaggagauagaucaagaguacuauaugcgaauaaucaaacgauaggacaauaucuguacgaaagaauuaaagcaaacccacaugacaggaucagaggagagguauucuacaggcaagauuacuuagaugaauuugauagaaucugggaaugucaacagaacuacuauccagcaauacuaacuaacgauagaaaacaauauaucagaaaucgaauaauauuuuaccaacgcccacucaaaaguaagaaaucugaacuagcuuuuugcgaguucgaaagucgugaagucgaacacaacggaaagaaauacacugaaggcuuacauguugcccccaaaagcucaccaguauuccaacauuuuagacuauggcaaagacuugggcaaauugaaguaucuccauuaagaaaaugggauaaacaaucaaaugaacuauucgaacaacagaacaaugcugaccgagaaggaauauuaaacacagaagcaaaacaaaaacuauuuucauauuuaaacuugcuagaucaucugacagauaacgaaauccuuaacauacuagguuacucaccagacaaauggaaaauuaauuucagagaaaucaucggaaauagaacaaacaaccuaaugaugaaagcauucuuuucgaugaaagaaaugacagauggagaacaaauagauugggagaaaaaccucaccaaaaucacaaauggccaaaguuuaauaucaccagaacagaucgucgacuuaaucagacaauucuuugaaagggaaggaauaacaacuagcuuacuauacuucgaccccgcuacagacaacuuccgcgaacaaagccauuacucauuauggcaccuacuauacucuuaugaagacgacaacucucccacaggaacaacaucuuuauguaaaacauuagcaaaacgauacggaauaccacacgaacuaugcccucuccuagccagucuuacauucgaaagacaauauggcucucugagcacaaaagcaaugagaaaacuccugccuuucaugcaagaaaagagauaugaugaagcaugcgaacuggcuggauauagacacucagcauggaucacuaaagaagaaaaugcaaaaagaacauugaaaaacaaacucccauuacuaagaaaaggcuccuuaagaaauccugucguagagaaaauucuaaaccaaaugacacauguaaucaauacgcauauagcugaauacgguaaucccgaugaaauacgaauagaaauggcacgagacaugcaggcgaacagcaagcaacgaaaagcuaugaccgccgcgaucacggaagccaccaaacgcaauacacaauuuauugaagaaauacaaaaagaauuuggcuucaacccgaguaaaaacgacuugauaaaauauaaacuguggaaagaguuagcuccccuugggaacaaaacauuauacuccaauauuuacauaccaaaagaagaacucuuuacagccaaauuugaaauagaacauaucauuccaagagccuuauuuuacgaugacucuuuuucaaauaagacucuugaauuaaauucaguuaauaaacuuaaagguaacaagacggccuuagauuauuuagacacacuaggucaagaaaaagcaaacgauuacauacuccgaguagaagaauuaaagaaaauuggugccauaacacaagcaaaauauaagaaacuacuaauacgagaaaaagaccuaggggacgacuucacaaacagagaccuaaccaauacaagguacauaaucagacaugcagcagacauguuacuacaaguaacaccaucaaucguacauaccaauggauccauaacagccauuuuaagaagagauuggggauuacuagauauacuaaaagagcuaaaccuuccaacauacgaaagcauagacagaaaaauaucugacccagaagaaaaacuaacucaauccguggauagaaaagauggacaagccaucaaaaugauaaaagauuggaguaaaagagaugaccaccggcaccaugcaauggaugcccuuauuacagcacuuacaacuaggaaacauguucaauaccuaaacggaaauagcggggccgaagaaacggauaaagcgcaaaaacuggaacaacuaaaggcuuuaagaaaacaauuaaucggaagcgauggucacuucaucccacccaugcaugauauaaggguccaagccaaagaagcauuaucaagagucauuauuucaacgaaaguuaaaggaaaaguaacgacucccaauacaaauauaauauguaguagggauaaaacaacuggaagaaaaauauaugugagacaaacaaccuuaacaccgagaggugcucuacaucucgauacuaaauacggaauaaaucgguacuaucaagaaagagaaguuucaauaggaucaaaacucacccaagaagagaucagauuaguuuccaguccucauauucaaucaaucuuacuugaacgcuugagagcuuucgauaauaacccaaaaucagcauucacaggucgaaacucuguagacaagaaaccacuagaagauaaaaauaaaaagcuaguauacacugacaagaaaguuaaacaaacaauccuagcaaauagauuugucaaaagggaccaaguaaauuccaaacuaaauuuagauaaaguaauagacaccgggaucaaacggauacuagaaggaagauuacagcaauaugguggaaaauacgaaacggcauuuuccgaccuagaaaauaauccgauauggcuaaaugaagaaaaaggcauugcgauaaaaaguguaagaauaaggggcaaaaauaaugcuauccccauccaccaaaccgauaccugccccauagacuaugucgcaaacgauaauaaccaucaccuggcaguauacguccuaccagaugguaccauagaagacgauauaguaacuuucuucgaugccguagaaagaagccgccagggacuaccaaucguggacaaaaauaaaaaucaaucgcuaggauggaaauucuuauucagcauaaaacagaaugaauacuuuuuacucccucaacaagcagagaaaauagauauugauacaggcgaaaucaguacacaaacuacuuuuucaccaaaagacuuaucacccgaauacauaaugaacccagacaacuacgcagaacuagcgucacacauuuucagaguucaaucaauaucaaaaacgccacaaggaaauagggauguaaggaucuaccucuucaaacaacaauauauaucuggaucacagaaagauucacugcauuuaaaagguauaacuuacaggcaaaucuccagugcuaaagaucuagcagagcuagucaaaauacgaguuaaucaucuagguagaaucguaagcguaggggaaaaauga

SEQ ID NO: 5663 - RNA, 4287 nt, Artificial Sequence
  Cas9 variant
augacgaaaaaaaucuuaggcuuagaccuuggaacaaccucgauaggcugggcauacguaaucgagagcgacaauccagaugagucugaaauuaaacaaauaggaguuagggugaacccauugacgaccgaugaacaaaccaacuuugaaaaaggcaaaccauuuagcauuaauaaagaacgaacucuaaaaagaggagcaagacggaaccucgacagauacaaagacaggagaaacaaccuaauagaaguacuuaaaaaagcaaauauucucagccaagauaguauacucacagaagaaggacaacacacuacacaccaaacuuggcaacucagagcaaaagcggcgguugacaaaauugaaaaagaagaacuugcuaggguuuuauuagcaauuaauaaaaaaagaggauauaaaucaagcagaaaagcaaaaaaugaggacgaaggccaagccauagacggaauggcaguagccaaaagauuauaugaugaacaaauaacauguggccaauuagucuaccaacuauugcgggaagggaaaaagucgauuccagauuuuuauagaucugaucuacaagcagaauucgacaaaguauggaacuuccaaaaacaauuuuaucccaaaauacuaacagacgaguuuuacaaagaacuaaaaggcaagggacaaagagcaacgagugcccuuuuuuacaaaacauauaacuuuaacacagcagaaaauaaaggaucaagagaagaaaaaaaaauacaggcauauaaguggcgcucagaagcgauaucucaacaguuggaaaaagaggaaguugcuuuuguacuaacugaaauaaauaauaauuuaaacaacucuaguggauacuuaggagcaauuuccgacagaaguaaagaacucuauuuuaauaaacaaacaguaggucaauauuuauaccaacaauuacaggaaaacagacacgcucgcuuaaaaaaucaaguauucuauagacaagacuacuuagacgaauucgaagcaauuuggaaagaacaggcaaaacaccacacagaguuaaccgaggaguuaaaggcagaaauccgugacauuaucauauucuaucaaaggaaacuuaagucccaaaaaggccuaauaucauuuugcgaauuugaaagccgugaaauccaaauagauggcaaaaaaaaaacaauuggauuacgaguugcacccaagucaaguccauuauuucaagaauuuaaaauauggcagaaucuaaacaaugucuuagucagaaaaaaagggucuagaaaacgcaacguaaaacaagagauacaaggaucauuauucgaagaagaaaaggaaauauucguuuucgauuuagaaacuaaagaaaaacuuuuugaagaauuaaaucuuaaaggaaaucugagcgcuaacaaagugaucgagcuucugggacauaaaccuacagaaugggaaaucaauuauuccgcauuagaaggaaaucguacuaaucaagcucuauacaaugcguaccuuaaaauacuagacauagaaggauaugaugaagaucugcucaaacuaucagauaaagaugauauaaacguugcagaucugaaaacgccagcaucagaaauuaaaaacaugguacgagacauauuucaaguucuaggaauaucaaccgauauccuagaauucgaugcagaacuagacggcaaggauuucgaacaacaagcaaguuaccaauuauggcaccuucucuauucauaugaaggagaugauucucaaucaggaaacgaaaaacuguacgaguuacuagaaaaaaaauuuggauucaaaaaagaacacagccaaguacuugcgaacgucacauuaagcgaugacuauggcaaucucucaaguaaagcaaugcgaaaaauauacccauuuauaaaggaaaauaacuacucaacagcaugugaacuagcagguuaucgacauucuaaacauucccuaacaaaagaagaaauagaaaauagaccuuuagaugauaaacuagaacucuuaaaaaagaauagucucagacaaccaguaguggaaaaaauucuaaaucaaaugguaaacgugguaaauucacuacuagagaaaaauaggaaagagaauccagauuuucguuucgaugaaaucagaauagaacuagcaagagaauuaaaaaaaaaugcaaaagaacgagccgagaugacaacaaacaucaacuccgccaaaacagagaacgaaaaaaucuucaagcuucuucaagcugaauuuggacuaaaaaauccaaccagaaacgauauuaucagguaucgcuuauaugaagaacuaaaaaauaaugguuauaaagauuuguacacaaacaaauauauacccagagaaauauuguucaguaaacagguugacauagaacauauuaucccacaaucuagacuuuucgacgacucguucucaaauaaaaccauaguauaccgggaaacaaaccuagauaaagguaaucaaaccgcguuugauuauauagacucaaaauacggaaacgaaaaagucgaagaauacauacuccgaauugaggcucuacaugaugcauggaaaaaaaacaaagaagaaggaaucucaaaagcaaaauaucaaaaacuacuuaaaaaagaaacagaaauuggagacggauucaucgaaagagaccuaagagaaucucaauacauagccaaaaaggcaaaggaaaugcuguuuaaaauaacaaggucaguaguaucaacaaguggauccauaacagauaaauuaagagaagacuggggguuaauaaauauaaugaaagaacuaaaccuaccaaaauauagaagcuugggauuaacugaaaugcaagaacgaaaauuuggacaaaaaguugaaguaauaaacgacuggacaaaaagaaacgaucaucgacaccacgcuauggacgcauuaacaguagcauuuacuaaacauaaucauauccaauaucuaaauuauuuaaacgcaagaaaaaacgagaaccacaaguuacauaauaauauuaucgcaauugaaaauuuagaaacagaaacaaugauagacaauaaugguagcaaaagaaggguuuuuaaagcgccaaugccaaauuuccgucaaguggcaaaggagcacuuagaaaacguacuaaucagucauaaagccaaaaauaaagugguaacgaaaaacaaaaacaaaaucgccggcaaagucgcagcucaagaaacucucacaccgagaggacaacuccacaaagagacaguauacggcaaauaucaauacuacgucaauaaagaagaaaaaauuggcacgaaguucgacgaagaaacuauaaacaaaguuucaaauccucaauacagaaaauuacugcuggaaagacuaucagcaaacggcaacgaucccaaaaaagcauucagugguaaaaacgcacucucaaaaaauccuauauacuuaaacgaaacaaaaaccgaaacaguacccgaaguuguaaaauuaacuugguuagaagaagacuacucaaucagaaaagacauaacaccagacaauuucaaagaugaaaagaguauagauaaaauacuagaugagggaguaaaaagaauccuaaaaaaaagauuaagaaagaacgacaacgaucccaaaaaagcauuuagugaucucgacaagaauccgauauggcucaaugaggaaaaagggauaaguauaaaacgaguaaccauuagcggagucaacaaugcagaaccgcuucauuauaaaaaagaccacuucggaaaugauauucuagacgaaaaaggcgacaaaauaccuguugacuuugugagcaccggaaacaaccaucacguugcaguguaccgagacgaaaagggaaacuuacaagaaaauaucguauccuucuucgaagcagugauacgagucaaucaaggacuccccauaauagacaaggcauauaaucaacauuuaggauggcaguucuuauuuacaaugaaacagaacgaaauguuuguguucccuaaugaaaagagcggauuuaauccacaagaaaucgauuuacuggacccaagcaacaaaaaaaaaauaaguccaaaccuauucagaguccaaaagaugucgaaaguuauuuaugguaauucaccuguccgcgaauaugucuuuagacaccaccuagaaaccaacguagaugaaaaaaaggaauuaaaagauauaacuuuuaagaacaucaaaucacucggauacuuugaagauauagugaaagucagaauuaaucaucuuggugauaucgucagcguuggugaauauuga

SEQ ID NO: 5664 - RNA, 4293 nt, Artificial Sequence
  Cas9 variant
augaaacauauacuaggauuagaccuuggcacaaacuccauagggugggcagucguaaaagaggcucaaaaugauaacgaacaaucugaaaucguggauguaggaguccgagucaacccacuaacgacagacgaaaaaacuaacuucgagaaaggaaaaccaauaaguaccaacgcugaccgaacucucaaaagaucggccaggagaaauuuacaaagauauaaacugagacgcaaagagcuaaucgaacuucugaaagaacaucaauuaauuuccacagacaccauacucacagaaaaugguaaaggaaccacauuccaaacacuggagcugagagccaaaagugcgaaagaaaagaucucccucgaagaauuagcacgaguauucuuaacgauaaauaagaaaagaggcuacaaaaguucuagaaaagccaaaaaugaagacgaaggucaacuaauagacggaauggaaauagcaaaaagacuauacgaagaaaauuuaacaacaggacaacucucacuucaacuccuaaaagaaggcaaaaaaucacucccugacuacuauaggucagacuugcaauuugaacuagauaaaguauggaacuuucaaaaacaauuccacagcgauauacuuacugacgaauuuuaugcccagcucaaaggaaaggggcaacgcgcaaccagcgcacuauuccuugcgaaauaucaaauuuacacagcagaaaacaaaggaucacgugaagacaagaagcuacaagccuaccaauggcgcguggacgcauuaucuaaagaauuaacacgcgagcagcuagcguuuguaauaacagaaaucaacaauaaucuaaauaauucaagcggguaccucggugcuaucucggacagauccaaagaacuauacuucaacaaugagacaguuggagaauaucuauggaaacaaauagcagcuaauccucauacaucacuaaaaaaucaaguauuuuacagacaagauuauuuagacgaguuugaacaaauuuggaaaacacaaagcgcauuuuacccagaaauacuaacagacgaauuaaaaaaagaacuaagagauguaguaaucuucuaucaaagaaaauuaaagagucaaaaaucccuagucucuuucugugaauuugaaaauaaagagaucgaaauuaaaaaagaggacggcacuucaacaaaaaaaguaauaggacuaaaaguagcaccaaaaucguccccauuauuccaagaauuuaaaauauggcagaauuugaacaauguguuaauacgaaaaaaaggaagcaaaacaaaaaaaguagcaaagaaccagcaagccguccucuucgaagaagaaaaaacaauaucagagcuagacuuagaagccaagcaggcacuuuuuaaugaauuaaaucugaagggcaaucuaaaagccgauuauuguuuggaaauucuaggauauucaccaaaagaaugggaaaugaacuauagcguuuuagaaggaaauagaacuaauaaagcucuguacgaagcauaccuaaaaauuacagauuuagaggguuaugaugccaaaaaccaccuaaaaguaaaacucaauaaagacgaaguagaacucgaugacuuaaaaguaccagcauccgaaauaaaagacauggugcaagcaauauucaaagaggcgggaaucaauacagauauacuacacuucaaugcggaacuagacggaaaagauuucgaaaaucaggcaucuuaucaacuguggcacuuacucuauucauaugaaggugacgauucaaaaucaggaaacgaacuacuauacaaacuauuagaaacuaaauuuggauucaaaaaagaauacgcccaaauacuugcaaauguuucucugagugaugauuauggaagccuaucaacaaaagcaaugagaaaaauacacccguacauaaaagaaaacaaauuuagcacagcaugcgaacuagcuggcuaucgacacaguaaacacagucuaacuaaagaagaaaaugacaaucgaguauuaaaagauucauuagaaguacuaaaaaaaaacucacuaagacaacccguaguugaaaaaauacuaaaccaaaugauaaaccugguaaaugcucucuuaaaaaaauauagaacagagaauccuaacuuuaaauucgacgagauacguauagaauuagcaagagagcuaaaaaaaaaugcagaagaacgagcuaacaugacggccaauauaaauaaagcaaaaacagagcaugaaaaaauaaucaaaauccuaaaaaacgaauuuggauugccaaacccaacuagaaaugauaucauucgguaucgauuauaugaagaacucaaagcaaauggauauaaagaccucuauacaaacauaaaaauaccacaagaaaaauuauucaccaaagaaaucgacauagagcacauaauaccaaaauccagaguguuugaugauagcuuuucaaauaaaaccuuaucauucagaaaaacaaaccucgauaagggagaaagaacugcguuugacuacauggaaucuaaauucggcgcugacaaauuagaagaauacgucgcacgggucgaggaucuauacaaaaacaauauaauaucaaaagcaaaauaccaaaaacuauuaaaaaaagaaucagaaauuggcgacggcuuugucgaacgagaucugagagaaacucaauauauagccaaaaaagcaaaagaaauuuuguuacaaaucacaccaaauguacuaucuacaucagguggaauaacagacagauuaagggaagauugggauuuaaucaacgucaugaaagaacucaaucuacccaaauauagagccuuaggacucacacagauggaagacagaaaguacggacaacaggucgaaguaauaacagauuggacaaaaagaaacgaccauagacaccaugcaauggacgcauuaacaguagcauucaccaaacacaaucacauacaauacuugaacuaccugaaugcgcguaaaaacgaaaaacacaaggagcauagcaacauaaugggcauccaacaacuagaaacaauuaaaguaacugauaaaaacggaaacgaaaaaagagucuucaaagcuccaaugccaaauuuucgucaagucacaaaagccuuccucgaaaacauucuaauaucacauaaagccaaaaacaaaguaguaacaaagaacaaaaacaaggucgccgguucaaauaaaguacaagaaguauuaacaccaagaggucaacuucauaaagaaacaguauauggaaaauaccaauauuacguacaaaaagaagaaaaaauaggugccaaauuugaccuugaaacaaucaagaagguagcuaacccacuauaucagucacuauuaaaaaaacgcuuagaagaaaacggaggugauccaaaaaaggcguuuacaggaaaaaacucacuagcaaaaaauccaauuuaccuggaugacacacaaaccgaacaacuuccugaaaaaguuaaacuagucuggcuagaaaauagcuuuagcauaaggaaagauauaacacccgaaaacuucaaagaugaaaagcucauugauaagauccuugacgaagguguaaaacgaauccuaaaagaaagacuacaaucauucgguaacgaugccaagaaagcguucucagaucuagacaaaaaccccauauggcucaacaaagaaaaggguauaacaaucaaaagaguaacaaucagcgggguagccaaugcagaaccucuacauacaaaaaaagaucauuuagguaaagaaaucuuagauaaagaagggaaaccaauuccgguagauuuuauaucaaccgguucaaaucaucacguagcaguauaccgugacgaaaaggguaaucuacaggaaaaaguggucucuguguucgaagcagucgugagggcaaaucaaggauuaccaauaauagacaaaacuuauaaucagcaucucgguugggaauuccucuucacaaugaagcaaaacgaaauguucguguuuccaaacgaaaguacgggguucaauccuaaugauauagaccugcuagacccaaaaaauaagagaauaauaucacccaauuuauuccgaguacaaaaauuuucaaaauugcaauacgguaacaguuucguccgcgaauucguauuccgacaucacuuagaaacaaccguagaagauagaaaggaacugcaaggcauaaccuauaaacaaaugaaaaauaguaccuucuucaaugacaucauaaaaguccgaaucaaccaccugggcgauauagucucgauaggagaauauuga

SEQ ID NO: 5665 - RNA, 4293 nt, Artificial Sequence
  Cas9 variant
augaaacacauuuuaggauuagaccuaggaacaaauucgaucggaugggcaguaguaaaagaggcgcaaaaugauaacgaacaaagugaaauagucgauguagggguccgagugaauccccuaaccacggaugaaaaaacgaauuuugaaaagggaaaaccuauaucgacaaacgcugaccgaacacuaaaaaggucugcaagaagaaaccuacaaagauauaaacuuaggagaaaagaacuaauagaauuacuaaaagaacaccaauuaauaucaacugauacaauucuuaccgaaaauggcaaagggacuacauuucaaaccuuagaacuacgcgcuaaaucagcaaaagaaaagaucagcuuagaagaauuagcacgaguuuuccugacgaucaacaaaaaaaggggguacaaaaguucaagaaaagcuaaaaaugaagacgaaggacaacuaauugacgguauggaaauagccaaaaggcuuuaugaagaaaaucuuacaacaggacaacuuagccuacagcuauuaaaagaaggaaaaaaaucacuuccggauuacuacagaucugaucuucaauuugagcuugacaagguauggaacuuucaaaagcaauuccauagccacauuuuaacugacgaauucuacgcccaauuaaaaggcaaaggucaaagagcuacaucagccuuauucuuagcaaaauaucaaauuuauacagcggaaaauaaaggcuccagggaagacaaaaagcuucaagcauaucaauggagaguagaugcauuaucuaaagaauuaacaagagaacaacuagcguuuguuaucaccgaaauaaacaauaaccuaaacaacagcaguggguaccugggcgcgauuucagacagauccaaagaacuauauuuuaauaaugaaacaguaggagaauaccuauggaaacaaauugcagcuaauccacacacaagcuuaaaaaaucaaguauuuuacagacaagauuaccuugaugaauucgaacaaauauggaaaacucaaucagccuucuaccccgaaaucuugaccgacgaacuuaaaaaagaauuacgagauguaguuauuuucuaccaaagaaaacucaaaagccaaaaaaguuuaguauccuuuugugaauuugagaauaaagaaaucgaaaucaaaaaagaagacggaacaucuacaaaaaaaguaauaggcuuaaagguagcaccaaaaagcucccccuuauuccaagaauuuaaaauauggcaaaaucuaaauaaugugcuaauuagaaaaaaaggcucuaaaacaaaaaaagucgauaaaaaccaacaagcuguacuauuugaagaagaaaaaacaauauucgaauuagaucuagaagcuaaacaggcccuauucaaugaauuaaacuuaaagggcaauuuaaaagcauacuacugccuagaaauucuaggauacucaccaaaagaaugggaaaugaacuacaguguacuugaggguaaccgcacgaacaaagcacuauacgaagcauaucuaaagauaacagacuuagagggauaugaugcaaagaaucauuugaaaguaaaacuuaauaaagaugaaguagaacuagaugaccuaaagguaccagcgagugaaauaaaagacaugguccaggccauuuucaaagaggcgggcaucaacacugacauauuacauuucaacgcagaauuagacgggaaagacuuugaaaaucaagccaguuaucaacuguggcaccucuuauacucauacgaaggagacgacuccaaaaguggcaacgaacugcuauacaagcuuuuagaaacuaaguuuggauuuaaaaaagaauaugcacaaauauuagcaaauguuagcuuaucagacgauuauggaagucugaguacaaaagcgaugagaaagauacaucccuauauaaaagaaaauaaauucucaacagccugcgagcuagccggauacagacacaguaaacacucauuaacaaaggaagaaaaugacaacagaguccugaaagacucgcuugaaguauuaaaaaaaaauagucuucgacaacccguaguagaaaaaauccucaaccaaaugauaaacuuaguuaaugcauuauuaaaaaaauauaggacagaaaauccaaacuuuaaauuugacgaaauaagaauagaacuagcaagggaauuaaaaaaaaaugcagaagaacgagcaaacaugacuguaaacauaaauaaagccaaaacugaacaugaaaaaauuauaaaaaucuuaaaaaaugaauucggguuaccuaacccuacucguaacgacaucauuagauaccgauuauacgaagaacuuaaagcaaacggauauaaagacuuauacaccaacgaauacauagaaaagcaagaucuauuuacaaaaaacauugauauagaacacauaauccccaaaagccgaguguucgaugacaguuucuccaauaaaacauuaucuuucagaaaaacuaaucucgacaaaggagagcguacagcuuuugacuacaucgaaagcaaauuuggcgcagauaaacuugaagaauauguagcaagaguggaagaccuauacaaaaacaacaucauauccaaagcaaaauaucaaaaauuauuaaaaaaagaaucagaaauaggggauggauuugucgaacgcgauuuaagagaaacccaauacauugcuaaaaaagccaaagaaauuuuacuccaaauaaccccaaacguacuaaguacaucagguggcauaacagaucgucuaagggaggauugggacuuaauaaauguaaugaaagaacuuaacuuaccaaaauaucgagcacuaggacugacacaaauggaagacagaaaauauggacaacaaguagaaguaauuaucgauuggacaaaacgaaacgaucaucgacaucacgcgauggacgcccuaacaguugcauuuacaaagcauaaucauauacaauaccucaacuaucucaaugcaagaaaaaaugaaaaacaccgggaacacucaaacauaaugggaauccaacaacuugaaacuauaaaggucacagacaaaaacggaaacgaaaaaaggguauucaaagcucccaugccgaacuuuagacaagugacgaaagcauuucuagaaaacguucuaaucucccauaaagccaaaaacaagguaguaaccaaaaauaaaaauaaaguagcuggaucuaauaaaguccaagaaguacuaacgccaaggggccaauuacauaaagaaaccguauauggaaaguaucaauacuacguucaaaaggaagaaaagaucgguggcaaauucgaucuugaaaccaucaagaaaguugcaaacccccuauaucagagcuuacuaaaaaaaagauuagaagaaaauggaggagacccuaaaaaagcauucacuggaaaaaauagccuagcaaaaaauccaauauacuuagaugaugcacaaacagaacaacuaccagagaaaguaaaacucguauggcucgaaaauucauucuccaucagaaaagacauuacgccagaaaacuuuaaagacgaaaaguuaauagacaaaauacuagaugaaggcguaaaacguauacuuaaagagagauuacaaaguuucgggaaugacgcuaagaaggcauucagugaucucgacaaaaaccccauaugguuaaacaaagaaaaaggaauagcaauaaaaagaguagccauuaguggaguagcuaacgcugaaccauuacauacaaaaaaggaccauuugggaaaagagauauuagauaaagaaggaaaauccauaccggucgauuuuauuagcacgggaaacaaccaucauguagcaguauauagagaugaaaaaggaaaccugcaagaaaaggugguuucaguuuuugaagccgucguuagggcgaaucaaggacucccaauuauagacaaaaccuacaaucaacacuugggcugggaauucuuauuuacaaugaaacaaaacgaaauguuuguuuucucaaaugaaucaacaggcuucaaucccaacgauaucgacuuacuagacccgaaaaauaaaaaaauaauaaguccaaacuuauucagaguccaaaaauuuagcaaauuacaauauggcaauucauuuguacgugaauuuguauuuagacaccaucuagaaacgacaguggaagaucgaaaagaacuccaaggaauaacuuacaaacaaaugaaaaacuccgcauucuucaacgacaucauaaaaguccgaauuaaccaucucggaggcauuguaagcgugggagaauacuga

SEQ ID NO: 5666 - RNA, 4293 nt, Artificial Sequence
  Cas9 variant
augaaggauauucuaggacuugaucuagguaccaauucgauagguugggccgucguaaaggaagcacaaaaugauaaugagacaucagaaauaguugauuuaggcguacgaguaaauccacuuaccacagaugaaaaaacaaacuucgagaagggaaaaccuaucaguacaaacgcagacagaacuuuaaaaagaagcgcaaggagaaacuuacaacgauauaaacuccgaagaaaagaacuuaucgaacuguuaaaagaacaccaauuaaucucaacugauacaauacuaacggaaaauggaaaaggaacaaguuuucagacacucgaacuacgugcuaaaucagcaaaagagaaaaucucacuggaagaacuagcuagaguuuuccuuacaauuaacaaaaaaaggggauacaaaucgagucgaaaggcaaaaaaugaagacgaaggccaauugauagauggaauggaaauagcaaaacgccuauacgaagaaaauuuaacaacgggacaauugucauuacaacuacuaaaagaaggaaaaaagucacucccagauuauuaccggucagaccuacaauuugagcucgauaaaguauggaacuuccagaaacaauuucauucacauauuuuaacagaugaauuuuaugcucaauuaaaagguaagggucaacgcgcaacauccgcuuuauuuuuagcaaaauaucaaauauauaccgcagaaaauaaagggaguagggaagacaaaaaauuacaagcuuaucaauggcguguagacgcacuuaguaaggaacuaacaagagaacaacuagcauucguaauaaccgaaauuaauaacaaccuaaauaauucaagcggauauuuaggggcaaucagcgaucgaucaaaagaacuguauuucaacaacgaaacaguuggagaauaccuguggaaacaaauugcagcaaacccgcauacgaguuuaaaaaaucaaguauuuuauaggcaagacuaucucgaugaauucgaacaaauauggaacacacaagcacaauuuuauccacaaauacuaacagacgaacucaaaaaagaguugcgcgaugucgugauauucuaccaaagaaaacuaaaaucacagaaaucacuaguauccuucugugaauucgaaaauaaagaaauagaaaucaaaaaagaggauggaacaucaacaaaaaaagugauaggccugaaaguagcucccaaaaguucacccuuguuccaagaauucaaaauuuggcaaaaucuaaauaacguacuaauacgcaaaaaggguaguaaaaccaaaaaagcagcaaaaaaccaacaagcuguauuauuugaagaggaaaagaccauaucagaacuagaccucgaagccaaacaagcucuauucaaugagcucaauuuaaagggaaaccuaaaagcagacuacugcuuagagauacucggauacaguccaaaagaaugggaaaugaacuacucaguauuagaaggaaaucgaacaaauaaagccuuauacgaagcauauuuaaaaauaaccgaucuugaaggauaugaugcuaagaaucaccuaaaaguaaaacucaacaaagacgaaguagaacuggaugaucugaaaguuccugccucugaaauaaaagauauggugcaagcaauauuuaaagaggcaggaauaaacacugauaucuuacauuuuaaugcugaauuagauggaaaagacuucgaaaaccaagcaagcuaccaacuauggcacuuacuauauucauacgagggagacgacuccaagucaggcaaugaguugcuuuacaaauuacuagaaacaaaauucgguuuuaaaaaagaauaugcacagauccuagcaaacgugucauuauccgaugauuacgguagcuuaucuacuaaagcaaugagaaaaauccacccuuacauuaaagaaaauaaauucucgaccgcaugcgaacucgcaggauaucgucauagcaaacauuccuuaacaaaagaagaaaaugauaauagagugcuuaaggauucacuagagguauuaaagaaaaacucacuaagacaaccaguaguagaaaaaauccugaaucaaaugauaaaucuuguaaaugccuuacuaaaaaaguacagaacagaaaauccuaauuucaaguuugaugagauaaggauugaauuggccagagaauuaaaaaaaaacgcagaagaaagagcaaacaugacggcaaacauuaacaaagcaaaaacagaacacgaaaaaauaauuaaaauauuaaaaaaugaauuuggacugccaaauccgacaagaaaugauauaauacguuaucgacuauaugaggagcuaaaagcaaacgguuacaaagacuuauacaccaacauuaaaauaccgcaagaaaaacuauucacgaaggaaauagacauugaacauauaauuccaaaaucgagaguauuugacgauuccuuuuccaacaagacacuaagcuuuagaaaaacaaaucuagacaaaggagaaagaaccgcauuugacuacauggaaaguaaauuuggagccgacaaacuagaagaauauguggcgagagucgaagaccuauacaaaaauaauauaaucucuaaagcaaaauaccaaaagcugcucaaaaaagaaagcgagaucggagauggcuucgucgaacgagaccuaagagaaacucaauauaucgcaaaaaaggccaaagaaauauuauuacaaauaaccccgaacguauuauccacaucgggaggaauaacagacagacuaagagaagauugggaccuaauaaacgucaugaaagaauugaacuuaccaaaauauagggcacuuggacuaacagaaauggaagaccgaaaguacggccaacaggucgaaguaauaauagauuggacaaaaagaaacgaucauagacaucacgcgauggaugcccuaaccguugcauucaccaaacacaaccauauacaauaccugaauuacuuaaacgcaagaaaaaaugaaaaacacaaagaacacagcaauaucauggguauacaacaacuagaaacaaucaaaguuaccgacaaaaaugguaaugaaaaacgaguauucaaagcuccaaugccaaauuuuagacaaguaacuaaagcuuuccuagaaaacauacucaucucccacaaagcaaaaaacaaagugguaacaaaaaacaagaauaagguagcuggaucgaauaaaguacaagaaguucuaacaccaagaggacaauuacauaaagaaacaguauacggaaaauaucaguacuacguacaaaaagaagagaaaauagguggcaaauucgaccuagagacaaucaaaaaaguugcgaacccacuuuaccagucacuacuaaaaaaaagacuagaagaaaauggcggagauccuaaaaaagcuuuuacaggaaaauacucacuagcuaaaaauccgauauaccuggacgaugcacaaaccgaacaacuccccgaaaaagucaaacugguaugguuagaaaauucauucucaaucagaaaagacauaacacccgagaauuucaaagaugaaaaauuaauagauaaaauacuggaugagggaguaaaaagaauacuaaaagagagacuacaaagcuucggaaacgaugcaaaaaaagcauucucggauuuagacaagaacccuauaugguuaaauaaagagaagggaauaacaaucaaacgcguaacuauaucaggaguagccaacgcugaacccuuacauacaaaaaaagaucacuuaggaaaagagauauuagauaaagaagguaaaccaauaccaguagauuuuauuucuaccggaucaaaccaucauguagccguauaucgcgacgaaaaaggcaaucuccaagaaaaaguaguaucaguuuucgaagcagucguacgcgcuaaucaaggauuaccgauaauagacaagacauauaaccaacaucuaggaugggaguucuuauucacaaugaagcaaaacgaaauguuuguauuccccaaugaaagcaccggauuuaauccaaaugauaucgacuuacuagacccaaaaaauaaaagaauaauaagcccaaacuuguuuagaguccaaacgauaucuguagucaaauacggaaaugccauaguccgagacuuuaaauuccgacaucaucuagaaacaacaguagaagacaaaaaagaacuacaagguaaaacauaccaacaaauaaaaucucuaucaccacucaacgauauaauaaaagugcgcauuaaccacuuaggagacaucguuucgguaggagaauacuga

SEQ ID NO: 5667 - RNA, 4293 nt, Artificial Sequence
  Cas9 variant
augaaacacauauugggacuugaucuugguacaaauaguauuggaugggcauacguaaaagaagcggaaaaugacacggaaacaucggaaaucguagacuuaggcgugcgagucaauccacuaacaacggaugagaaaacaaacuucgaaaaaggaaaaccuauuucuaccaacgcagauagaacacuaaaaagaucugcaagaagaaaccuacaaagauauaaacuuagaagaaaagaauuaauugaauuacuaaaagaacaccaacuaauuuccgaaaacacaauucucacagaaaacgguaaagguacaacauuccaaacucuggaauuaagagcgaaaagugcaaaagagaaaaucaguuuaggcgaacuggcaaggguguuuuuaacaauuaauaagaaacgcgguuauaaaaguucaagaaaagccaaaaacgaagaugaaggacaauugauugacgguauggaaauagcaaaaagacuauacgaagaaaacuuaacaacuggacaacuaucacuacaacugcucaaagaaggcaagaaaucguuaccugauuauuauagaucagaucugcaauuugaacuagauaaaguuuggaacuuucaaaaacaauuccauucagacauacugaccgaugaguucuacgcacaauuaaaagggaaagggcaaagagccacuuccgcgcuauuccuggcaaaauaccaaauauacacagccgaaaauaaaggcagcagagaagauaagaaacuacaagcauaucaguggagaguagacgcacuaucaaaagaacuaacuagagaacagcuagccuuuguuauaacagaaauaaacaauaaccucaauaacucgucaggauacuuaggugcaauaucagaccgcuccaaagaauuguauuucaauaaugaaacuguaggagaauaucuauggaaacaaauugcggcaaacccacacacaucgcugaaaaaccaaguauucuacagacaagacuauuuagacgaauuugaacaaauauggaacacacaagcacaauucuacccacagauccuaacagaugaacucaagaaagaacuucgagauguaguaauuuucuaccaaagaaaauuaaaaagucagaaaagucuagucagcuuuugcgaguucgaaaauaaagaaauagaaauaaagaaagaagacggaaccucgacaaagaaagucauuggauuaaaaguagcaccaaaaucaucacccuuguuccaagaguuuaaaauauggcaaaaucucaacaauguauuaaucaggaagaaaggcucaaaaaccaagaaagccgccaaaaaccagcaagcaguauuauuugaagaagagaaaacuauauccgaauuggacuuagaagcaaaacaagcacuauucaacgaacuaaaccuaaaaggcaaucugaaagcagacuacugucuagaaauacuaggauacagcccuaaagaaugggaaaugaacuacucgguguuggagggaaacagaaccaauaaagcucuauacgaagccuaucuaaaaauaacagaccuagaaggguaugacgcuaaaaaccacuuaaaaguaaaacuaaacaaagaugaggucgaauuagaugaucuaaaaguaccugcaucagaaauaaaagagaugguacaagcaauauuuaaagaagcggggaucaauaccgacauauuacacuucaacgcagaauuagauggaaaagauuuugaaaaucaggcaucauaucaacuguggcaucuacuauauucauacgaaggcgaugacagcaaaaguggaaacgaauuguuauauaaauuguuagaaaccaaauucgguuuuaagaaagaauaugcacaaauucuagcaaacguuucauuaagugacgacuacggaaaccuaagcacgaaagcuaugcgaaaaauauauccauauaucaaagaaaauaaauucuccacagcaugcgaacuagcaggcuauagacauaguaaacauagucuaacaaaagaagaaaacgacaacagaguacucaaagauucuuuggaaguacuuaaaaagaacucucuaagacaacccguagucgagaaaauacuaaaccaaaugaucaaccuuguaaacgcacuucuaaagaaauacagaacagaaaacccuaauuuuaaguuugacgagauacggaucgaacuagcgcgagagcuuaagaaaaacgcagaggaacgcgcaaacaugacagccaauauaaacaaggcuaaaacagaacacgagaaaaucaucaaaauucuaaagaaugaguucggucuaccuaaucccacccgcaacgacauaauccgauauagacuauaugaagaacuuaaagcaaauggauacaaagacuuauacacaaauauaaagauuccccaagaaaaauuauucaccaaagaaauagauauagaacacauuaucccgaaaucacgaguauucgaugauucauuuaguaacaaaacacucucauuccgaaaaacaaaucuagacaaaggcgaaaggacagcauuugacuauauggaaaguaaauucggugcagauaaacuagaagaauacguagcucgagucgaagaccucuacaaaaacaacauuaucucuaaagccaaauaccaaaaacuauuaaagaaagaaagugaaaucggugauggauucguagaacgagaccuuagagaaacacaauacauagccaagaaagcuaaagaaauacuacuucaaauaacaagaaacguacuuuccacaaguggaggcauaacagaucgguugagagaagacugggaccugguaaacguaaugaaggaacuuaauuuaccgaaauacagagcacuuggauuaacagaaauggaagaccgaaaauacggacaacaaguugaagucauaaucgauuggacaaaacgaaacgaucaccgacaccaugcuauggacgcauugacaguagccuuuacgaaacacaaucacauucaauaucuaaauuaccuaaaugcuagaaagaacgaaaaacacagagaacacagcaacauaaugggaauacaacaacucgaaaccauaaaaguaacagacaaaaacggcaaugaaaaacgaguuuuuaaagcaccaaugcccaacuuccgccaaguuacaaaagccuuucuagaaaacguauuaauuucacauaaagcuaaaaacaaaguaguaacgaaaaauaaaaauaaaguagccggaucuaauaaaguacaagaaguacuaacgccuagaggacaauuacauaaagaaacggucuaugggaaauaccaauacuaugugcaaaaagaggagaaaauagggggcaaauucgauuuagagaccauaaagaaaguagccaauccacuauaccaaucccuacuaaagaaaagacuagaagaaaaugguggugacccgaaaaaggcuuucacagggaaaaauagcuuagcuaaaaacccaaucuauuuagacgaugcgcaaacagaacaacuaccagaaaaaguaaaauuagucuggcucgaaaauucauuuucaauaagaaaagacauaacccccgaaaauuucaaagaugaaaaauugauagacaaaaucuuagaugaaggcgugaaaagaauauugaaagaaagacuacaaucauucgggaacgacgcgaaaaaggcuuucagcgaccuggacaaaaacccaauauggcugaacaaagaaaaagguauaacuaucaaaagaguaacaauuucuggaguugcaaacgcugaaccacuacacacuaagaaagaccaucuaggaaaagaaauacucgauaaagaaggcaaaccaauaccgguugacuuuauaagcacagguucaaaucaccauguagcagucuauagagaugaaaaaggaaaccuccaagagaaaguaguguccguuuucgaagcaguagucagagccaaucaagguuuaccaaucauagacaaaacauacaaugaacacuuaggaugggaguucuuauucacaaugaaacaaaacgaaauguuuguauuuccgaacgaaagcacaggcuucaaucccaacgacauugaccucuuagauccuaaaaauaaaagaauaaucagcccaaaccuguucagaguacaaaccauuucaguuguuaaauacggaaacgcgauaguuagagacuucaaauuccgacaucaucuagaaacuacaguagaagacaagaaagaguuacaaggaaaaacauaucagcaaauaaaaaguuuaucaccucuaaacgacauaauaaaagugagaauaaaccaucugggagacauaguaucgguaggagaauacuga

SEQ ID NO: 5668 - RNA, 4293 nt, Artificial Sequence
  Cas9 variant
auggcgcaaaaauacauacuugggcuagaccucgggacaaacaguauagggugggccguaguaaaggaagccgaaaacgacaacgaacaaagugaaaucguagauguaggaguaaggguaaacccacuaacaacugacgaaaaaaccaauuuugaaaaaggaaaaccgauuagcacaaacgcggauagaacauuaaaacgaggagcacgaaggaacuuacaaagguacaaacuaagaagaaaagaacuaauuaaaauauuaaaagaacaccaguuaaucucugacgauacgauccuugcugaaaauggcaaaggcacuaccuaucaaacacuaaaacuacgagcaaaaagcucuaaagaaaaaauaagcuuagaagaauuagcacguguuuuccuaacaauaaauaaaaaaagaggcuauaagucaucuagaaaaacaaaaaacgaagacgaaggucaacuaaucgauggaauggaaauagcaaaaagacuauacgaagaaaaucuaacaacuggacagcuaucacuucaacuacuuaaggaaggaaagaagaguuugccggacuacuacagaucugauuuagaacuggaacuagacaagguauggaacuuucagaaacaauuccacagugacauacuaacugaugaauuuuacacacaacuaaaagggaaaggacaaagagcuacaagcgcacuauuucuugaaaaguaccaaauuuauacgguugaaaauaaaggaaaucgugaggaaaaaaauuuacaagcuuaccaauggagaguagacgcauuaagcaaagaacuaacuagagaggaacuagcuuuuguuauaacugaaaucaauaauaaccucaauaauucgucagguuaucuuggcgcaauaagugauaggucaaaagaacuauauuuuaauaacgaaacagucggggaauauuuauggaaacaaauagcagcgaauccccacacaagucuaaaaaaucaaguauuuuaccgccaagacuaucuggacgaauuugaaagaauuuggaacacacaagcgcaauuuuacccacaaaucuuaacggaaagucucaaaaaagaacuaagggauguuguuauauuuuaccagagaaaacuaaagagccaaaagucccucguauccuucugugaauuugaaaacaaagaaauagagaucaagaaugaagacggaacaacuacuaaaaaagucauaggacuuaaaguagcaccaaaaaguucaccccuauuucaagaauucaaaauauggcaaaauuuaaacaauguucuuauacgaaaaaaaggcagcaagacagaaaaaguggcaaagaaccaacaaguaguacuauucgaagaagaaaaaacuauaagcgagcuggacuuagaagcaaaacaagcuuuguucaaugagcucaauuuaaaagguaaucuaaaagcugacuacugccuggaaauacugggauauucgagcaaggaaugggaaaugaauuacucaguucuagaagguaacagaacaaacaaggcacuauaugaagcguacuuaaaaaucacggaucuagagggauacgacgcaaaaaacuacuuaaagguaaaaaguaacaaagacgaaguugaacucgaugaccuaaaaguuccagcaagugaaauaaaagaaauggugcaggcuauuuucaaagaagcaggcaucaacacugacauauuacacuuugaugcggaguuggacggaaaagacuuugaaaaccaagguaguuacaaacucuggcauuuacuuuauucauacgaaggugacgauaguaaaagcggcaacgagcugcuauacaaacucuuagaaacgaaauuuggacucaaaaaagaauacgcucaaauauuagcaaacaucuccuuaagugacgauuacggaaaccuuaguacgaaagcaaugcgaaaaauacauccauauauaaaagaaaacaaauuuucaaccgcaugcgaauuagcggguuaccggcauagcaaacacuccuuaaccaaagaagaaaacgagaaaagaguguuaaaagacggauuagaaguacuaaaaaaaaacagucuuagacaacccguugucgaaaaaauacuaaaccaaaugauuaauuuaguaaaugcucuguuaaaaaaauaccgaacagaaaaucccaacuuuaaauucgacgaaauacgaauagaauuagcgagagaauuaaaaaaaaaugcugaagaaagagcuaacaugaccgcuaacauaaacaaggcuaagacggagcaugaaaagaucgauaaaauacucaaaucagaauucggauugccaaacccaacaagaaaugauaucaucagguaccgccuuuacgaagaacuaaaagcuaacggauacaaagaccuauacacgaaccgauauauaucaucugagaaauuauuuucuaaagaaauugauauagaacacaucaucccaaaaucaagaguguucgaugacaguuucagcaacaaaacaauaguauauaggacagauaacuuagacaagggcgaacaaacagcauacgauuauauagaaucaaaguuuggugccgagaaacuaaaagaauacaugacacgcguuaaagaucuauaucaaaaaaaaauaauaagcaaagcuaaguaucaaaaacuacuaaagaaagaaagugaaauuggagacggcuucguagaacgagaccuuagagaaacgcaauacauagcaaaaaaagcaaaagaaauucuacuacaaauaacacauaauguacuaagcacuucaggaggcaucacagaccgccuaagaaaagacugggguuuaguaaacguuaugaaagaauugaacuuaccaaaauauagagccuuaggacuaacaaaaauggaagaccgaaaguacggacaacaaguagaagucauuacagacuggacaaaacggaacgaucuacggcaucaugccauggaugcucuuacuguagcauucacaaaacacaaccacauacaauaccuaaauuaucuaaacgccagaaaaaaugaaaaacacaaggagcauaacaacaucauggcaauucaacaacuagaaacuauaaaagucacggacgaaaacggaaaugaaaaaagaaucuucaaagcaccaaugccaaauuuuagacaaguagcaaaaacuuuccuggaaaauguacugaucucacacaaggcaaagaacaagguaguuaccaaaaacaaaaauaaaaucucaggauccaauaagguucaggaaguguuaaccccuagaggacaacuacacaaggaaacgguuuauggcaaauaccaauauuauguucaaaaagaggaaaaaauaggagcuaaauucgacucugaaaccauagaaaaaguagcaaauccacuauaccagucacuuuuaaagaaaagauuagaagaaaacggaggagauccaaaaaaggccuucacagggaaaaacucacucgcaaaaaaucccaucuaucuagaugauacucaaacugaacaacucccagaaaaaguuaaauuaguuugguuagaaaacagcuuuaguauaagaaaggauauuacuccagaaaauuuuaaagacgaaaaauuaauagauaaaauacuagacgaggguguaaaacggauucugaaagaaagacuacaaaguuucggaaaugaugcgaaaaaagcauucuccgaccucgaaaaaaacccaauauggcuaaauaaagagaaagggauagcuaucaaaagagugacaauuucuggaguggccaaugcugaaccacuacacacaaaaaaggaccaucuugguaaagagaucuuagauaaagagggaaagccuauaccaguagacuucauaaguacuggaaacaaccaccauguagcaguuuaucgagaugaaaaaggaaaucuacaagaaaagguacuaucaguauucgaagccguaguccgagcgaaccaaggccugccaauaauagaaaaaacuuacaaccaacacuuaggaugggaauuuuuguucucaaugaaacaaaacgaaauguucguuuucccaaacgaaaguaccggauuuaauccaaaugacauagaucuccuagaccccaaaaacaagcguauaauauccccaaaccuguuuaaaguacagaaacuagcaacgaaaaauuauauguuuacacaccauuuagaaacaaaauccauugauggagacaugcuaaaaaacaaaaaagaauuaucagguauacuauacaacuucauacaaacaccgcaaaaauuauacggaauaauaaaaguacgaauaaaucaccuaggagauauuguuaguguaggggaauacuga

SEQ ID NO: 5669 - RNA, 4296 nt, Artificial Sequence
  Cas9 variant
augaagagaauacuaggguuggacuugggaucaucaucgauaggaugggcauuagugaaugaagcagaaucaaagaaugaaagaucgucaaucguaaaacugggcguaagagucaacccacucacaguugaugaaagcauuaauuucgaaaaaggaaagucgauaaccacaaacgcggauagaacacuuaaaaggaguaugagaagaaauuuacaucgauauaaacugcgccgugaagcacuuauagagguacuuaaagaaugcaaauuuauaacggaagauacuauccugucggaaaauggcaacagaacuacguucgaaacauaccgguuacgugucaaagcacuuacagaagaaauaucccuagaagaauuugcaagaguauuaauuaugauaaauaaaaaaagaggcuauaaaaguagcagaaaggcaggaggcgcagaagaagacacauuaauagacgggauggauauagcaaggaaauuauacgaugcuaauuugacaccgggagaacuaugucuacaauuacucucggcaggaaaaaaagugcuaccagauuucuacagaucagauuugcagaaugaauuggauaggauaugggagaagcaaaaagaauauuauccaggaauacucacggcagcccuuaaagaagaauuacgagguaaaaaacgugaugcaguaugggcaauuugugcaaacgcauucguauggaaggaaaccuauacugaauggaacaacgaagaaucaaaaaacgaacagauagaaaaagaacacaaacuggaagguauauacaguaaaagaaaacgcgaugaagcuaaaaaagaaaaccugcaauggagagugucagggcuaaaagaaaaacuaucauuagaacaacuuguaauaauacuucaagaaaucaauacccaaauaaacaauaguucaggauaucuaggaacaauaagugaucgaucaaaagaacuauacuucaacaagcaaacaguaggccaauacuugauggauauucuagacaauaauccuaacgcgucauuacgaaacauaguuuucuaccgacaggacuaccuagaugaauucaacguacucugggaaaaacaggcagaauuucacaaggaacuuacaggagaacuaaaaaaagaaauaagagacauaauaauuuuuuaccaaaggaggcucaaaucacaaaaaggccuaauuagcuuuugugaauuugaauccagacaaauagaaguaaaaauagacggaaaaagaaaaauaagaacaguuggaaaucgagucauuccaagaagcucuccacuauuccaagaauuuaaaaucuggcaaauacugaauaacauugaaguaacugcaguuggcaacaaaaacaagcaaaggaugcaaaauggaagcaacgaaccggacgauacugaacaauuagaacucaauggacgacgcuaucuauaccaagaagaaaaagaacuacuagcaaaagaauuauucgucagagacaaaaugacaaaacuagacguacuaagauuacuguuugacaacccggaagaacuugacuuaaacuucaaaacaaucgauggaaacaaaacuggauacuuguucuuucaagcauauucuaaaaugauagaaaugucaggacacgaaccgguagacuuuaaaaagccgauugaaaaaauaguagaacaaguaaaaucagucuuuguauuauuaaauuggaacacugacauauuauccuucgauagcaacaaagaauuagauaaacaaucauauuacaaauuauggcauuuguuauacagcuucgaaggagacaacacacccacagggaacggaugccuaguucaaaaaauaauggacagcuauggcuuagggaaagaauucgcaaaaauacuggcaaauauaacguuccaagaagacuaugguagccucagugcaaaggcaauacauaaaauucuaccccauuuaaaagaaggaaaucaguacgacguggcaugugaauaugcaggauaucgccauaguaaaaguucgcugacaaaagaggaaauugccaauaaaguauuaaaagauaaauuggaaguacuacccagaaauucgcuuaggaacccaguaguagaaaaaauacuaaaccaaaugguaaacguaauaaacgcaaucauagaagcauacgggagaccugaugaaauuagaguagaacuagcaagggagcugaaaaaaaacgccaaggaaagagaaaaacucacuaaauccauagccgaaacaacuaaaacacacgaagcgcacaaaaaacuucuacaagaggaauuuggauuaaaaaacguggggagaagcgacauccuaagauauaaacuguauaaggaacuagaauccaggggauauaagacgcuauauagcaauaccuacauaccuagagaaaagcuuuuuaguaaagaauuugacauagaacauauaaucccacaagcaagacuguuugacgacucuuuuagcaacaagacccuugaagcaagaaauguaaacauugagaaagguaauagaacugcguaugauuucguaaaagagaaauucggcgaaaguggaacagauaacagucuagauugcuaccuuaauaauauagaaguacuauuuguaagcggaaagauaucaaaaaccaaauauacaaaauuaaagaugacugaacaggauauaccaggaggcuucaucgaaagggaucucagaaacacccaauauaucgccaaaaaggcacugaguaugcuaaaugaaauaagcagaugcgucgucgcaacaucuggaaguauaaccgauaaacuucgagaagauuggcaguuaguagauguaaugaaagaacuaaacugggaaaaauacaaagcuuugggauuaguagaauacuucgaagauaaagacggcaagcaaauaggacguaucaaagauuggagcaaaagaaaugaucaccgucaccaugcaauggaugcgcucacaguagccuucacaaaagaaguuuucauacaauacuucaacaacaaaaaugcuucguugaaucccaauacgaacgaauaugcaauuaaaaauaaguacuuucaaaauggaagagcaaucgcaccaauuccacucaacgaguucagggccgaggcaaaaaaacaccuagaaaauacucuaaucucuauuaaagcaaaaaacaaagucauaacaaauaacauaaacaaaacaaaaaaaagaggcggaguaaauacaaaaaagcaacaaacaccaagaggccaacuucacuuagaaacuauauauggaugcuguaggcaauacuuaaccaaagaagaaaaagugaacgcaagcuuugauguuucaaaaaucgcaacaguaucuucaucuguuuauagagaugcacuacugaaaaggcuacaagaacaucacaacgacccgaaaaaagccuucgcuggcagaaacucacuugauaaaaaaccaguauggcuagacaaagaacaaauaagaaaaguaccugagaaggucaaaacaguuaccuucgaaacaauauauacaauaagaaaagaaauaucaccugauuugcgugucgacaagauaauagacucaggaguucguaagauguuaacggguagacugaaagaauaugggaacgacgcaaaaaaagcauucagcaaccuagacgaaaaaccaaucugguuaaacaaggaaaagggcauaccaauaaaaagagucacuaucucaggaaucagcaacgcgcaaaguuuacaugucaagaaggacaaagacggaaaaccagucuuagauggaaaugggaggaacauccccguggacuucguaaacaccggcaacaaccaucacguagcugucuaucguagaccuguaaucgauaaaaauggacagaugguaauagaugaaaauggaaaucucaaauaugagcuagaggaaguaguagucaccuucuuugacgcaguaacgcgagucaaccuaggacaaccaauuauagacaaggacuacaaggcuucagaaggauggcaguucuuauucaguaugaaacaaaaugaguauuuugucuuuccaaauaagaaaacaggauucaaccccaaagaaauugaccuacuagaugcagacaauuauggacuaauaucacccaacuuauucagaguacaaaaauucacacauaaaaauuacguauuuagacaccaucuugaaacaacaauaaaagacacuucauccauacuccgaggaauaacauggauugacuuucgaucaagcaaagggcuagacucaauagucaaaguucgcguuaaccacauaggacagauaguaucuguaggagaauauuga

SEQ ID NO: 5670 - RNA, 4299 nt, Artificial Sequence
  Cas9 variant
augaagaaaauccuagggcuagacuuaggaucgaauaguauagguugggccuuggucaaugaagccgaaaacagggaugaagcaagcagcauaauuaaauuagguguccgaguaaauccauuaacgguagaugagaugcaaaacuucgaaaaagggaaaagcauuacaacaaacgccgaccguacuuuaaaaaggucaaugcgaaggaaucuucaaagguauaaacuucgaagggacgcauuaauaaaauuacucaagaaaguagguuucauagcggaugguacaauauuaagugaacaaggcaacagaaguacauuugaaacuuauagacuaagggcaaaagcaccagacgaagagauaagucuacaagagcuagcgagaguauuauugaugauaaauaagaaaagaggauacaaauccucaagaaaaauuaaagagaaagaagccggaacauuaauagauggaaugaaagucgccaagaaauuauacgacgaagauuuaacuccgggacaauuaugucuacaacugcuagaguccggaaagaaaagucuaccagacuucuauaguucagaccuucaagaagaguucgaucgaauauggaauuuccaaaaacaauuuaacccaaaagcauucugugauaccgcaaaagaagaaaucaaagguaaaaauaaaucgcaaaccugggcaauacuugcaaaguacuuuaucuggacagaugaaauggucguuuggaacgaaaaagaaaguaaaacagaacggguagaaaaagaaugcaagcuagucgggcucaaacgaacagugaagaaagaagaacaaagaaaagaaaauuaucgauggcgaguucaagcauuaacagaacaacuugaccuuggaaaaguagcuguaguauuacaagagauuaauggacaaauuaguacaucgagcgguuauuuaggagcaauaucugauagaagcaaaguauuauacuuuaacagacagacaguaggccaguaucaaauggcagaauuagagaaaaacccaaauacgucauuacggaacaugguauucuaccggcaggacuacuuagaugaauuugauaaaaucugggagaaacaagcagaguuucauaaagaauuaacaguggaacuaaagaaagaaaucagagacauaauaauauuuuaccaacgaagacuaaaaucacaaaaaggacuaauaggauucugugaguucgaaaauagagaaauuaugguagagaaaaacgguaaaaugcaagcuaaagucguuggaugcaaagugauuccaagaucccaucccuuauuccaagaauuuaaaauauggcaaacccuaaacaacguagaaguauucgcaggggaaaagaaaugcaaaagaaaacguaccgacgccuuccccgguuuauucgauggaacugaagauacacuaaugguagaaggcuggagguaucuauaucaggaggaaaaagagauacuugcaaaagaacuuucugugaaaaagagucucaagaaagaauauauucuaaaauuacuauucgauaacccacaagacuuagauaugaacuucgagcaaauugaaggcaaugacaccggcaauguccuauuuagcgcauauuccaaaaugauagaaaaauauggguacgagccacucgauuucggaaaguccacagaugaaauuauagagagauuacaagugauuuucacugauuuaggcuggaacaccgaucuucuauucguagaccuuaacaaagaaggaaaagacuuagaaaaacaaccauauuucaaacuauggcaccuauuauauagcuuugaaggagauaacacgccuacaggaaacggcaaacuugucgagaaauuaauggaauuaugucacguaggaaaagagugugcccucgagcuagucaauauuagcuuucaaaaugauuauggcagcuuaagugccaaagcuauaaagaaaauauuaccguaccuaaaagaaggaaauagguacgauguagcaugcgguuacgcaggguacagacauucuaaaucuagucuuacuaaagaagaaauagaaaauaaaguucuaaaagauaaacuagauauacuacccaaaaauucauuaagaaaccccguuauagagaaaauauugaaccaaaugguaaauguaauuaaugcaauaauagauacguacgguaagccggacgaaauuagaguagaauuagcuagagaacucaagaaaagugcgaaagaacgagaugaacuaacaaaagcaaucgcuaaaucaacaagagagcaugaagaaaucagaaaaguacuucaggaagaguucgggaugauaaacguaucacggaaugauauaauacguuauaaauuauacgaagaauuaaaagacaauggguacaaaacauuauacucgaaucaauauauaccuaaagaaaaaguauuuucgaaagaaaucgauaucgaacauaucauaccucaagcaagacucuuugacgauagucuaucuaauaaaacccuagaauacaaagcaauuaauauagaaaaaggaaauaaaacagcguacgacuucguuaaagagaaauacggugaaaaaggucuacaacaauaucuaaauagaugugagagcuuauucaaaggccauaggacuaaguuacggaaauuaaaaaugggccaggaaaauauaccagaaggauucauagaucgcgaucuaaggaauacacaauauaucgcuaagaaagcacucgcuauguuaaacgaaauauguagaaggguagucgcaacaacaggaagcauaacagaccgacuaagagaagacuggcaauuaguugauguacugaaagaauuaaaucuaccaaaauaugaaaccuuaggauuaguugaaguuuaugaagauaaagacggacgaaaaauaaaaagaauaaaagacuggacgaagagaaaugaccacagacaccacgcaauggacgcgcucacaguagccuucacaaaggauguauuuauucaguauuucaauaauaaaaaugcagcuuggcaagcagacugcaaagaacacagcgacauaauuggaauaaaaacgagguauuuugaaaacggcagagcauuaccgccaaugccucuuguaagauucagagccgaagcaaaaucccaccuagaaacauuauuagugucuaucaaagcaaagaacaagguugugacuaauaacguaaauuguaccaaaagaaaaggaggagagaauaagaaauuacaacaaacaccaagaggccaacuucaccuagaaaccauauacggaagccacagacaauacguaaugaaagaagaaaaagugaacgcaucguuugacucaucaaaaauugcaacagucuguaaacaagcguacaggaacgcccuacucgaaagacuugccgcauucggaaaugauccaaagaaagcauucacagggaaaaauagucuggagaaaaauccuguauaccuagauagagaacaaacugccagagugccagaaagaguucgaacaguagaguuagaaacagucuacacuauacgaaagccaguagauccgaacuuaucgguggauaaagucguagacgccaaaguacgcucuauauuagaacaaagacuuagagaauaugauggagaagccaaaagagccuucguaaaucuugacgaaaacccgauauggcuaaaugaagaaaaaggaauagcaaucaaaagaguuaccauaaggggaaucaacaaaguacaaucacuacauggaaagaaagauaaaaaugguaauuuaauccuagaugagacaggaaagaaaauuccaguagauuuugugaauacugggaauaaucaccauguagcaauuuacaggaaaccaguacucgacaaaacgggacaggaaauguuagacaaugaaggaaauccuguauaugagcucgacgaaguaguaguaucauucuucgaagccguaacuagaguaaaccuaggacuacccguaauagacaaaaacuauaacaaaucagaaggauggcaguuuauguucacuaugaaacaaaaugaauacuuugucuuuccgaaugaaaagacaggauucgauccuaaggaaguagaucuauuaaaucccgagaauuaugcggucauuaguccaaauuuauuuagaguccagaaaauaacagaaaaagauuauauguuucgccaucaccuagagacuaaaguggucgaugacaaguuuuuaaaagaaaucacauggaaaagaauacucacuccuaauaaauuagaaggaaucguaaaaguacgaguuaaccacauaggacaaauuguaucaguaggugaauauuga

SEQ ID NO: 5671 - RNA, 4299 nt, Artificial Sequence
  Cas9 variant
augaaaaagaucuuaggacuggaccucggaucuaacaguauuggaugggcgcuagugaacgaagcugaaaacucugaugaaguaucuagcauuaucaagcuaggcguacgaguaaauccacuaacaguagaugaaaugcaaaacuuugagaaaggcaagucuauaaccacgaaugccgaccgaacacugaagagaucgaugcgaagaaaccuacaaagauacaaacuacgaagagaugcacuaauaaaauuguugaagaaagugggcuucaucacagacggaacaauauuauccgagcaaggcaacagaacaacguucgaaacuuacagauuaagagcaaaagcaccagacgaagagaucagcuuacaagaacuagcuagaguacugcuaaugauaaacaagaaaagaggauacaaauccuccaggaaaauaaaagaaaaagaagccggaacacucauagacgggauggagguagcgaagaaauuauacgacgaagaucuaacaccgggacaacuaugccuucaauuacucgagucagguaagaaaucacuaccagacuucuauucaucagaccuacaagaagaguucgacagaauauggaacuuccagaaacaauucaaucccaaagcauuuugcgauaccgcgaaagaagaaauaaaagguaaaaacaaaucacaaacuugggcaauacuagccaaauauuuuauauggacagaugaaauggugguguggaacgaaaaagaaucaaaaaccgaaagaguagaaaaagaauguaaacucguaggacuaaaacgaacuguuaaaaaggaagaacaaaggaaagaaaauuacugcuggcgagugcaagcgcugacagaacaacuagaucuagagaaaguagccguaguacugcaagaaauaaauggacaaauaaguacaaguucgggguauuuaggggcaauaagugaucgaaguaagguacuuuauuucaacagacagacugucggucaauaucaaauggcugaauuagaaaagaacccaaacacaucguuacggaacaugguauuuuaucgacaagauuaccuggacgaguucgacaaaauaugggaaaaacaagccgaauuucacaaagaacuuaccguagaauugaaaaaggaaauaagagauaucauuaucuuuuaccaacgaaggcuaaaaucgcagaagggacucaucggauucugugaguucgaaaacagagaaauaaugguagagaaaaauggaaaaaugcaagcaaagguugucggaugcaaagucauuccgcgaagccauccguuauuccaagaguucaaaauauggcaaacauugaacaacguugaaguauuugcgggugaaaagaaauguaaaagaaaaagaacagacgcauucccaggcuuauucgaugguaccgaagacacacuaaugguagaagguuggcgauaccuguaccaagaagaaaaagaaauacuagccaaagaauugucuguaaagaaaagccuaaagaaagaauacauccucaaauuacuauucgauaauccacaagacuuggacaugaacuucgaacaaauugaagguaaugauacuggcaauguguuauuuagugcauacucgaaaaugauagaaaaauacggauacgaaccguuagauuucggaaaaccuacagauaaaauaauugaacaauuacaaguaaucuuugcagacuuaggauggaauacugaccuacuguucguagaccuuaacaaagaaggaaaagacuuagaaaaacaacccuauuuuaaacuguggcaccuuuuauacaguuuugaaggagacaacacaccgacgggaaauggaaagcuaguagaaaaacuaauggaacucugucauguagguaaagaaugugcauuggaauuaguaaauauaaguuuucaaaacgauuacggaucacucucugcaaaagcaauuaagaaaauacuaccauaccuaaaagaaggaaauagauaugacguagcaugcggauaugcugguuauagacacuccaaauccagucucacaaaagaagaaauagaaaauaaaguauuaaaagacaaauuagauauacuaccuaaaaacagucugcgaaauccaguaguagagaaaauauuaaaucaaauggucaaugugauaaacgcaauaaucgauacuuacggcaaaccagacgaaauccguguagaacuagcccgagaacuaaagaaaucagcaaaagaaagagaagaauuaaccaaagcaauugcaaaaagcacacgagaacacgaagaaauaaggaaaguccuacaagaagaguucgggaugauaaaugucaguagaaaugacauaauuagauauaaacuuuacgaagaauuaaaagauaacggcuacaaaacauuauauaguaaccaauacauacccaaagaaaaaguauucaguaaagaaaucgacauagaacauauuauuccucaagcuaggcuauuugacgacagccuaucaaacaaaacacuagaauauaaggcgaucaacauagaaaaaggaaauaaaacugcauacgauuuuguaaaagaaaaauacggagaaaaaggauuacaacaauaucucaaucgcugcgagagcuuauuuaagggacaacguaccaaacuuagaaaacuuaagaugggccaagaaaauauaccagaaggauucauagacagagacuuaagaaauacccaauauauugcaaagaaagcucuagcaaugcuaaaugaaauaugcagacgaguaguugcaacaaccggaaguauaacagauagguuaagggaagauuggcaacuugucgacguacuaaaagaauuaaaucuaccaaaauacgaaacuuuaggccuaguagaaguuuaugaagacaaagacggaagaaaaauuaagagaaucaaggauuggacuaagcggaaugaucaucgacaucacgcgauggaugcacuaacaguagcauuuacaaaagaugucuuuauccaauauuucaauaacaaaaaugcagcauggcaagccgauugcaaagaacauagcgauauaauaggcauaaaaacaagauacuuugaaaauggaagaagucugccaccuaugccucucguaagauucagggcagaagcaaaaagccaucuugaaacacuucuaguaagcaucaaagcaaagaacaaaguaguuacaaauaauguaaauugcacaaagcgaaaagguggagaaaacaagaaacuacaacaaucacccagaggacaauuacaucuagaaacaauauaugguagccaccgccaauaugucacaaaagaagaaaagguaaaugccucauuugauucauccaagaucgcgacaguaugcaaacaagcauauagaaacgcucuacuugaaagauuagccgcauuuggaaaugaccccaagaaagcauucacugguaaaaacagucuagagaaaaauccaguauaccuaaauagagaacaaacagcaagaguaccagaaaggguaaggacaguugaauuagaaacaguguauacaauuagaaagccaguagaccccaacuugucaguugauaaaguuguugaugcaaaggugcgaucaauucuagaacagcgacuuagagaauacgacggagaagccaaacgggccuuuguaaauuuagaugaaaacccaaucuggcuaaaugaagaaaaaggaauagcuauaaaaagaguaacgaucagaggaauaaauaaaguacaaucacuacacggaaagaaagacaaaaauggaaacuuaauauuggacgaaacaggaaagaaaauaccgguagauuuuguaaacacaggaaauaaccaccacguugccaucuaucgcaaaccgguccuaaacaaaacaggacaagaaauguuagauaaugaaggaaauccaguauaugaauuagaugaaguaguagucaguuucuucgaagcggugaccagaguaaaucuaggucuaccaguaauagauaaaaauuacaauaaaagcgaaggauggcaauucauguuuacuaugaaacaaaaugaguacuucguuuuuccaaaugagaaaacacgcuucgacccuaaagaaguagaccuucuuaauccggaaaacuaugcuguuaucucuccgaaucuguucagaguucagaaaauaacagaaaaagacuauauguuucgucaccacuuagaaaccaaaguuguagacgacaaauuucuuaaagaaauaacauggaaacgaauacuaacaccaaauaaacuagaaggaaucguuaaaguuagaguaaaccacauuggucaaaucguuagcguaggggaguauuga

SEQ ID NO: 5672 - RNA, 4299 nt, Artificial Sequence
  Cas9 variant
augaaaaacauacucggacuagacuuaggaacaacauccauaggauucgcucacaucguagaggaugagaacaaagaaaagucagaaauaaaagaauuaggaguccgaauagugucacuuacuacagaugaacaaagcgauuucgagaaagguaaaagcaucacuacaaacgcaaacaggacuuuaaaacacggcgcuagacuaaaccucgaucgauaucaacaacgucgaaaguacuuaaucgaucuauuacauaaagcaaaccuaauaacaccaagcucaauacuagcugaaaaugguaaaaauacaacccauuccacauggcaauuacgugcaaaagcaguaaccgaacgaauagaaaaagaagaauucgcaagaauucuacuugcaauuaauaaaaaaaggggguauaaguccucaagaaaagccaaaacggaagacgaaggacaagcaauagacgggauggcuauagcaaaacgccuauaugacgagaaccugacucccggucaauuaagccugcaacuacuacaacaaaacaagaaguuacuaccagacuucuaccgaagugaucuacaaaaagaauucgaucucgucuggaacuuucaaaaacaguucuaucccgacauuuuaacugauauuuuuuauaaagaauuacaagguaaaggcaaagacgcaacaucuaaagccuucuccaagagauaucauuucgacacggccgaaaauaaagguucaaaagaauccguaagacuacaagcguaccaauggcgagcagaggccguaucaaaacaauuaagcaaagaagaaguagccuacguacucacugaaauaaacaacaaccuaaauaaugcgagcgguuauuuaggagcaauuucagaucgaucaaaagaacuauacuucaacagacaaacaguaggucaguaccuuuaugcacaacuucaggaaaaucgacacaauucccuaaaaaauaaaguuuucuaccgacaagacuaucuagaugaauucgagaggauaugggagacacaagcgcuauuucauaaagaauuaacggacgaauuaaaaaaacaaauuagagacguuguaauauuuuaucagagaaaaccaaaaucccaaaaaggacuuauaaguuucugugaauuugaauccaaagaaauagaaauugaaaaagauggaaaaaccauaacuaaaaacauaggcgcaagagucguaccuaaaucauccccccucuuucaagaguuuaaaaucuggcaaauacuaaauaacguaaucugcaaaagaaaaggaauaagaaaaaaaaaaauaagcgcaaaaacaacccaacuagauuuauuaaacgaaagcucccaaacuauauucagucucgauauggaaugcaaacaauuacuauucgaugaacuaaaccuaaaaggagacuuaaaaagugauaaaguauuaaaauuauuaggcuauucgccucaagaaugggaaauaaauuacaaccaacuagaaggaaacaggacucaaaaagcacuuuacgaggccuaucugaaaauaguagaaauggaagcccaugauguaaaagauauucuacaaauaaagucuacaaaagacgauuggagccuagaugaaucaccccuaagugcauccgagauaagagaaaguguaaaagcuauauuccaagcacuaggaauuugcaccaaaauauuauauuucgacccguuacuuccuguuaaagauuucgaggagcaggauucauaccaacucuggcaucuauuauauuccuaugaauccgaugauucaacaucugguaacgaaacuuuauaccguaucuuagaaaaaaaauacgcauucaagcgagaacacgcucguauucuagccaauguagcacuacaagacgacuacggcucacugaguacaaaagcaauaagaaaaauauacccuaauauaaaagagaaccaauauagcaccgcaugcgaaauggccgguuacaaacacagcaaauuaucccuuacuaccgaggaacuagaagcaagagaacuaaagaauauuauuccgcuauuaaaaaaaaacgcauuacgcaacccugucguggaaaaaauucuaaaucaaaugauuaacguuguaaaugcauuaauagaaaaaaacagugaaagagaugccgaaggaaaaauuacuaaauacuuccacuuugaugaaauacguaucgaauuagcaagagaauuaaaaaaaaacgcgcaaaaaagauacgaaaugacccaaaacauaaauaaagcaaaaucggaacaccaaaaaauaagugaaauuuuacaaaaagaauucgguaucaaaaauccaacaaaaagcgacauaauccgcuacaggcuuuauaaagagcuugaacauaacggauacaaagaauuauacacaaauacauacauagccccagacguguuauuuucuaaaaauauagauauagaacauauaguaccaaaagcaagaguuuucgacgacuccuucucaaacaaaacacuugcauucaaggauuucaauauuaaaaagggcgagaguaccgcauuugacuauaucacaucacuaaaaaacgaagaaaaacuuaaucaguaucucgcaagaguagaaaacgcauacaaaaccaaaaauauauccccugcaaaauacaaaaaccucuuaaaaaaagccuccgaaauaggggacggguuuaucaauagagacuuaagagauacacaauacauugcaaaaaaggcaaaagaaauucuauuucaagugacuaaaaacguauuaaguacuucuggcucgauaaccgauagacugcgagaagauuggagucucguugacgucaugaaagaauuaaauaugccuaaguaucaaucacuaggacuaacagaagucgaagaaagaaaagacggaaacaaaguaacaguaaucaaggacuggacaaaaagaaacgaucaccgccaccaugccauggacgcacuaacaguggccuucaccaaacccucguauauacaguaucuaaaccauuuaaacgcacgaaaagacgaaaacaacaaaaacuacucaguaauacuagcuauagagaaaaaagagacaaucaaaguccccaccaacaacgggaaaaauaagcgaguauuuaucgaaccaauuccuaauuuuagacaagucgcaaaaaaacaucucgaagaaauauucauaucucacaaagcuaaaaacaaaguaguaacaaaaaauacaaauaaaccugcaggaacaaacaaacaacaaauaacucugacaccucgaggacaacuucacaaagaaacaauauacggaaaauaccaauacuacgucaacaaagaagaaaaagucggaguaaaauucgauaaagaaaccauugcaaaaguaagcaauccccuuuaccgcgaagcccuauuaaaaagacuacaggcaaacgauaacgacccaaaaaaagcauucacggguaaaaacgcucucucaaaaaaccccauauaccuagaugaggcuaagacaaagacccuaccagaaaaggucaaccugacguaucuagaagaagacuucagugucagaaagaaaauaguaccaaaaaacccaacgagcaaagaauucguacccaaccuuaaaagcauagaaaaaguaguagacgaaggaguaagaaacauauuaauagaaagacuaagaguuuacaauaaugaccccgaaaaagcguuuguagaccuagaaaaaaauccgauaugguuaaauaaggagaaagguauagcgauuaaaagaguuacaaucucagguguaaacaacgcgcaaccgcuccacauaggaaaagaucaucuaggaaaaacaacccuaaacaaagaaggaaaagagaucccaguagacuauguuucgacugguaauaaccaucacguagccauauacagagauaaagaagggaaucugcaagaacaaauaguaagcuuuuuugaagcaguaguuagaacacaacaaggccuaccuaucaucgacaaaaccuauaaacaggaagaaggauggcaauuccuauuuaccaugaaacaaaaugaaauguucguguuuccuaacgaagcaaccggcuucaaccccgcugagauagaccuauuagacccgaagaacaaaaaacagauaucuccuaaucuauucagaguucaaaaaauagcgacaaaggacuauuuuuuccgccaucauuuagaaacgaauguugaaacagacaauguccuuaaaaauacuacauggaagagagaaggauuaagugggcuaaaagauauuguaaaaguucgaauaaaccaucucggagacauaguuucuaucggcgaauauuga

SEQ ID NO: 5673 - RNA, 4302 nt, Artificial Sequence
  Cas9 variant
augaaaaagauuuuaggauuagacuuaggaacaacgagcauuggauacgcccaaguaaacgagucagaagauuucaaagauucgagcauagaaagaauagguguacggguaaauccauuaucagucgaugagcaaacuaacuucgaaaaaggaaaaccgauaaguauaaaugcugaucgcacccuaaaaagcggcgcacgccgcacacuagaccgcuaucaagaucgacgauccaaucuaauugacgcucuaguaaaaaguguaauaauaacugaagauacagugcuggcggaagacgguaaaaacacgacucacagcacauucgcacuacgagccaaauccgcgagugagaaaguagaaaaagcagaauuugcaagaauacuauuagcaauuaauaagaaacgaggauacaagucuucaagaaaaacaaacaacaaugaugacgaaggacaagcaaucgacggaauggcaauugcaaaaaaauuauacgaugaaaacuuaaccccaggacaacucgccuaccaauuacuaaaagaagggaaaaaauaucuaccagacuuuuacagaagugaucuacaagcagaauuugauaaaauauggacauuccaaaaacaauucuauccagagaucuuaacagaugaacuucaaaaagaacuggcagggaaaggccaacgagccacaagugccaucuuuuggaagaaauacgauuucaauacugccgaaaauaaaggaacgagagaagagaaaaaguuaaaagcauaugaauggagaaguaccucuguagauaaaaaguuacaaaaagaagaagucgcguaugugauaacagaaauuaacaauaaccucacaaacuccucgggauauuugggugcaauuagugaccggucaaaagaauuauacuucaauaaacaaacagugggucaauaucuauucaaacaaauucagaaaaacccacauacaaaacuaaaaaaucaaguuuuuuaccggcaagauuauuuugaugaauuugaaaucauuugggaaacacaagcuaaauuucauccugaacugacugaagaauuaaaaaacaaaaucagagacauaaucaucuuuuaccaaagaaaauuaaagucacaaaaaggguuaaucucauucugugaauucgaacgaaaagaaguagagauugaaaaaggcggaagacgaaugaaaaaaacuauaggguuaaaaguagcuccaaaaucaucuccucuauuucaagaauuuaaaaucuggcaaguccucaauaaugucuugauaagaaaaaaaggaucaaaaaaacgccgaguaaaagaaccugaccaacuuaauuuaguagaacaagaacaagaaguaauguucuucgacaugcaaaccaaacaaacacuuuuugaugaacuaaacguaaaaggaaaucuuaaagcaaaaagaauuauugaacucauaggacaagaugcaaaugacugggaaauaaauuacucugaaauagaagguaaucgaaccaacaaagcauuguacgacgcauauuuaaaaauacuagaucuggaaggauacgauacgaaagcguuguuagaugucaaaacgucaaaagacgaagucgaauuggaugacauuaacauuuccgguccagaaguaaaagaucuagucaaacgcauauuugaaagccucgaaaucgacacacaaauacuugaauuugaugcagaacuagacggcgaagucuucgagaaacaaucuucauacuuauuauggcaucuucuauacucauacgaaggagaugacagccccagcgggaacgaaaaacuauauaaauuauuaaaacaaaaauuuggguucaaaaaagaacacgcccaaauccuugccucaauaacacuuagcgaugacuacgguucuuuaagcgcaaaagcaaugagaaaaauauauccuuauaucagggaacaaaccuuugauaaagccgcuucacuagccggauauaggcacagugccucaaguuuaacgaaggaagaaaucgcaaacagaccacucaaagacaaacuggaauuaauaaaaaaaaacagcuuaagaaaccccguaguagaaaaaauacuaaaccaaguagugaauauugugaacagucuuauagaagcuaacucagaaaaagauagugacggaaacaucauaucauacuuuaaauuugacgaaauccgcauagaauuagcccgcgaccuuaaaaaaaacgcaaaagaacgagcggaaaugacacuaaacaucaaugcugcaaaaauaguacacgaaaagauuuucaaauuacuacaagcagaauucggaguaaaaaauccaacaagaaacgauauaauaagauacaagcuauacgaggaacuaaaaaacaacggauauaaagauuuauacacuaauaucuacauaccacgugaaauacucuuuucgaaacaaaucgacaucgaacacauuauaccacagucuaaaauguuugacgauucguucagcaauaaaacaauaguuuuuagaaaagauaaucuagauaaaggaaauucaacagcauucgacuauauugacucaagauucgguaaggacaaacuaacagacuuugaacaaaggauagaauuuuuauucgagcaaggaaaaaaaaacaaagaagaagguauaucaaaggcuaaauaccagaaauuacugaaaagggaagccgauaucggagacggauuuauagaaagagacuuacgagauacucaguauauagcaaagaaggccagaaaccuauuguacgaaauuugcagaauagucacucccacgacugguaguauuacagauagauugagagaagauugggaucuaguaaauauaaugcaagaauuaaauuuagacaaauuuaaaaaauuaggccuaacagaaaugguagaaaaaaaagacgguucuuucaaggaacgaauaguggacuggucgaaaagaaacgaccauaggcaucacgcuauggacgcguuaacaaucgcauuuaccaaacacagucacauacaauacuuaaacuaucucaaugcuagaaagaacgagaaccacaaacaacaccacaauauaaucggcauagaaaggaaagaaacagaauucguaauagaugaucuuggaaacaaaaagagaaaauuccacuuaccauuaccaaacuuuagagaggaagccaaaaaacaucuggaaaacguauuagucuccuucaaagcuaaaaacaaaguagugacaaaaaauaagaacaagaccgcaagcaguaagggagaaaaaauaaaaguagaacuaaccccccggggacaacuacauaaagaaaccguuuauggaaaauauaaauucuauguaucaaaagaagaaagaauuggcggaaaauuugaucaacgaacuauugaacggguugccaacaguacccacaaacgucucuuacuacaacgucuauuagagaaugacaacgaugcgaagaaagccuucacaggaaaaaacgcacuagcuaaaaaccccauauaccuugacgacacuaaaacccuaaccuuaccagagaucguaaaauuaaccuggcuagaagaagacuauaguauaagaaaagauauuacaccagagaauuucaaagauauaaaaguaaucgacaaaauacuagaugaaggaguaaaaaggauauuaaaagaaagauuagcuaaacacaacaauaacccaaaagaagcauuuuccgaccucgaaaaaaaccccauauggcugaacgagaaaaaaaguaucaguauaaaaaaaguaaaaauaagcgguauaaauaacgcagaagcucuacauuauaaaaaaaaucacuugggaauugagauacuggacgaugaaaaaaaaagaauaccaguagacuucguaaguacuggcaauaaccaucacguagcaauauauagagaugagaaaggcaaucuacaagaagaugugguaaguuucuuugaagcuguagcacgcguaaaccagaaccucccaauaauagacaaaacacucaaagcauaccugggguggaccuuccuauucacaaugaaacagaacgaguacuuuauauuccccaacaaacaaacgggauucaauccuacagaaauagauuuacuagauucaaugaacaacaaacuaauaucaccaaaccucuucagaguucaaaaauuuacaguuaaagacuacuucuuccgccaucaucuagaaacaaacgucgaagaugacaguaaacuaaaaaauacaaccuggaaacgugaaggacuaggcggaauagguaacaucgucaaaguacguaucaaucacauaggccaaauaguaaagauaggagaauacuga

SEQ ID NO: 5674 - RNA, 4305 nt, Artificial Sequence
  Cas9 variant
augaaaaacauccuaggccucgacuuaggcacaaacaguauugggugggcguacgugaaacaagcccaaaacgauucagaaaagagugaaauagcagaacuaggaguaagggucaacccacuuacaguggacgagaaaacaaacuuugaaaaaggcaaaccaauuaguacaaacgcagaucgcacccucaaaagaggagcacguaggaaucuccagagauacaaauugagaagacaagaacugauagagcuauuaaaagacuaccaaguuauaagcgauaaaacaauacuugcagaggauggcaaagaaaccacauucgaaacguuacgucuaagaguaaaaucugcaaaagaacaaguaucucuagaagaacuugcucggauacuccuaaugauaaauaagaaacgcggauacaaaaguucccgcaaagccaagaaugaggacgagggacaacuuauugauggaauggaaauagcccguagacucuaugacgaaaacuugacaacuggucagcuaucacuacaauuauuaaaagaagguaaaaagucacuaccagauuacuacagaucggacuuacaacaugagcucgacaaaguauggaauuuccaaaaacaauuucaucccgacauacuaacagaugaguucuacacgucuauucaagggaaagggcaaaaagcuacgagagaaaguuucucaaguaaauauggaauugacacagcagaaaauaaaggaagucgggaagaaaagaaacuccaagcauaccaauggagagcagacgcgacacauaaagaacuuacaaaagaagaacuagcauuuguaaucaccgagauaaacaauaacauaaacaacuccucaggguacuuaggagcgauauccgacagaucaaaagagcuaauuuuugcaaaugaaacaguaggugaauaucuuuggaaacaaauccaaaaugauccccauacaucccuaaagaaccaaguauucuauagacaagauuacuucgacgaguucgaacgcauuugggaaacacaaagcggcuuuuauccacaaauacuaacagagucauuaaagaacgaacuacgggauauucucauauuuuaccagagaaaacucaaaucucaaaaagcauugguauccauuugcgaauuugaaaguaaagaaauacccuuaaaagacaaacaaggcaacccaauaucuaaaaacgguauuccugucaccaaacuuguuggcccaaaaguugcacccaaaucgucuccucuguuccaagaguucaaaauauggcagaaucugaauaauguccuggucagacccaaaggaucacgcaaaagaaaaguaacgacuaaccaacaaagcacacuauuagaaggccaagaaccgguauuugaacucaaucuagaacaaaaagaacuauuauucgaagaacuaaaucuaaaagguaaccuuaaaacggacuauugccucgaauuaauaggcuacucagcuaaagaaugggaaaugaauuaccccacacuugaaggcaauaaaaccaauaaagcacuauacgaggcuuaccuaaaaaucaucgacucugagggauacgaugccaagaaacuccuaaaagucaaaacagacaaagaugauauaaacuuagaugacauaaaaguaagcgcauccgaaauaaaaacaaugaucucggacaucuucaacgaacugggcauaaauacgaaaauccucgauuucgacgcagaauuggaaaggaaacaauuugaagcccaagcauccuaucgauuauggcacuuacuauacaguuacgaaggagacgacaguaaaagugguaaugaacuucuauacagacuucuugaagacaaauucgguuuuaaaagggaacacagcaaaacccucgcaaaugucagucuccuuagugauuacgggaaucuaucaaccaaggcaauacgaacaauauacccuuacauuaaagaaaacaaauucuccacagccugcgaauuagcagguuacagacacucuaaacuaucaaucucaaaagaagagaacgagaauagaacucuaaaagacacccucgacguccucaaaaagaacucguuacgucaaccaguaguagagaaaauauuaaaucaaaugaucaacuuaauaaacgaacuaaucgaaaaacacagcgaaaaagaugaaaaaggaaacaucguuaaauauuucaaauuugaugaaauacauaucgaacuagcaagggaacucaagaaaaaugcagaggaaagacgagaauuagauaguaaagucagagaagguaaagauagaaacgagaaaauaauaacuauacuuaaaucugaauuugggcuaccauauccuacuaaaaacgacaucacaagauacagauuguacgaagaacugaaagauaauggauacaaagaucuauauacaaacacauauaucccaagagaaaaauuauucucaaaggaaauagacauagaacauauaaucccaaaaaguagauuauucaacgauaguuuuucaaauaagacaauauguuacaggcaagauaaucugaacaagggagaaagaacagcauacgauuacaucgaaggacuaggaaaaacacaguuagaugaauaucuaaacagagucgaaaauuuauacacgaauaaauuuauaaccaaagcaaaauaucguaaccuccuuaaaaaggaaagcgagauuggagacggauucauagaaagagacuuaagagagacacaauauauagcuaaaaaggcuaaagaaaugcucuuacaaauaaccaggcacgucguuucaacuacaggcaguauaacugacagacuccgagaugacugggagcuaguuaauguaaugcgagaacucaaccuucccaaauacaaaguacucgggcucacggaaauacaagaaagaaagaacggccaaaccguagaaguuaucacagacuggacaaaaagaaaugaccauagacaccaugcaauggacgcucuaacuguugcauuuacuaagcauagucauauucaguaccuaaacuuccuaaaugcacgaaaagacgaaaagcacaaggaauacaguaacauaaugggcauacaacaauuggaaacagagaaaacaacagacaaagacggaaaggaccgacgaguuuuuaaaaccccaauaccuaacuuucgacaaguagcaaaagaacacuuagaauccauccuaaucucgcauaaaacuaaaaauaaaguugucacaagagcaacgaauaaaauagcaggaucaaagaaacaacaagaaacacuaaguccucguggacaacuacacaaagagacugucuacgggaaauaucgcagguacguucaaaaagaagagaaaaucggaaguaaguucgauuuacaaaccaucgaacguguagcaaauccacucuauaagagacuucuaacgaaaaggcuugaagaaaacggaggugacccgaagaaagcauuuacaggcaaaaacgcauuagcaaaaucuccuauuuaccuugaugaaacacaaacacaacaacucccagaaaaaguaaaacucguuuggcuagaaacagauuuuucuauacguaaagauauaaccccagacaacuuuaaagaugaaaagucaauagacaaaguuuuggaugaaggaauaaaacgcauacuaaaagacagacuaaaaaguuucgacggugacgccaagagagcauucacagaccuugaacaaaacccuaucuggcuaaacaaagaaaaaggcaucgcaauaaaacgcguaacaaucagugguguaaguaacgcugaaccacugcauacaaagaaagaccaccugggaaaugaaaucuucgaugacaccggaaaacccauaccuguagacuauguuucaacugggaauaaccaucacauugcaaucuauagagacgaaaauggaaaccuacaagaaaaggcuguaucauuuuucgaagcaguaaccagagccaaccaaggccuccccacaguagauaaaacauauaaucaacacuuagguuggcaauuccuauuuacgaugaaacaaaaugaaauguuugucuuuccuaauaaagaaacaggguucgacccccaagaaauagaucuucuagauccgaaaaauaagaaauuaauaagcccaaauuuauucaggguucagaaaauaagcacuaaaaacuacuucuuuagacaccacuuagaaacaucaguagaaacacacaaugcacucaauggaguaacauacaaaucccaacuuggcuuaaacggaaucacagacauaaucaaaguaagaauaaaccacuuaggagauauaguacauaucggagaauacuga

SEQ ID NO: 5675 - RNA, 4308 nt, Artificial Sequence
  Cas9 variant
augcuuggaugcgaaaggaaaagaaaaagaagagaaaaagagaaaauggcgaaacccaaagauuauacaaucggacuagauauaggaacgaacuccguagguuggguaguaacagacgaucaaaauaacauacuaaggauaaaaggaaagaaagcuauuggcgcaaggcucuuuaccgaagguaaaguagccgcugaaagaagaucauuuaggaccacgaggaggagacugucacgaagaagauggcggauaaaaaugcuagaagaacuguuugaugaagagauagcuaaaguagaucccagcuuuuucgccagauuacacgaaaguuggauaagcccuaaggauaaacgaaaaagauauucagcaauaguguuuccaagcccugaagaagacaagaaauuccaugaaaguuacccaacuaucuaccauuuaagagacaaauuaaugaaagacgaucaaaaacacgacaucagagaaauauacauagcgguacaucagaugaucaaagcacguggaaacuuucuacacgacgaaucaguagaaacauacagaagcggaaugagcucauugggaggccggucugaaagaaauauacuaucaguucaaacuuuagaggaacucaaugaccuauucgccgaaaaugaaggaaccgaagaaguugaacuaaaugucgcaagcgcagaacaaauuaacgauauccuaacagguggacaccucaaugcugacucgcaaaaggaaauaucaaacuuauuauuaccuucgagcuuuccaucauuugaugauaaagccaaagaaaaacaaguuaagaaacuaauuaauaauguagcgaccaauaucaguaaagcguggcuaggauacaaagccgacuucucgacgauacucaauuuagcuaaaguagauaaagaucaaaagaaaauauucgcuuucgcccuacagggaggagaugaagaagauaaaguacaagaacuagaaucccuacucgaacaaagccagacggacaucguugaccgauuaaucgagauaagacacgcaauaguacugucagagauaguccccguaggaaugacauuaucagaagcaaugauagacaaauacgaucagcacaaagaggaccuaauuacgcuaaaagcaguaaucagaaauacgaaagacaaaaagaaagcugcaaaacuucaggccauuuaugaccuuuacgucaaaaauagacacgcagaucuagcaaaagcaaugaaacuaacuggaauuaagaaaagaagugaacucuuagauccagaagaacuuaagaaaggaauaucuagucuucuagaugacucaccagaagcgguagaaauaaaacaaagacuggaagagaaaacauuuuuacccuugcaacgauccaauaacaauggcguaauaccaaaucaacuacaccaaguagaguuagaugaaaucauaaagaaacaaaguaaauacuacccuuuucuugccgagaaaaacccggaugaaucagaagaggcccaaaagaaagccccaacaaaacuagaugcguuacuuacguuccgaguacccuauuauguagguccuaugaucacuaaagaagaacaagaggcacaaaauggacacucauucgcauggaugguucgacgugacccucaagaccaugaagcaauaacaccauggaauuucgaaaagaaagucgauaaaauggcaagugcaacacaauuuauaaaacggaugacaaccaaagauacuuaucuuuuaggcgaagacguauuaccagcuaguucauuaaaauaccaauuauucacaguacucaaugaguuaaauaauuuacgagugaauggaaagaaauuaacaagugacgaaaaagaacagguuauagaaggccuguucaagaaacagaaaacgguaaaagcagauaaauucguuaaauacuggcaagcaaaacauauaggggcggauaucaaaguaaaaggguuauccgacccaagcaaauucaacuccacaaugucaacuuacauagacuucaagaaaauuuucggagaucaacuaaaugaugucaacagacaaaacgauuucgagaaaaucauugaauauucaacaauauucgaagauagaaaaauauuagaagauaaacucagaguugacuuugcuuggcuuucagaagaacaaauaaaacaacuaugcagguuacgacuucaaggauggggaagacuaucagauaaauugcucacccgccucacagaugcggacggacaaaauguauuagaaagacuauggaauaguaaugacaauuuuguucaaauaguaucagauccuaauauaaaagcaaaaauugaacaagaaaaucagaaacuauuaagagauucccaaucagauaaugcaguagaaagcauacuugacgaugcauauacgagcccacagaacaagaaagcgauaagacaaguaaugcgaguaguacaugacauagugaaagccugugauggaaacguaccagcuaaauuugcaaucgaauuugcaagaucucaagaagaugacccaaaacguacuacagcaaggguuaaucaaaugcagaaaaucuacgaucaaaucucagaugaaguaguaucacaaggcgucaaagagcaacucaguggaaugaaaaguuuaaaagauagauacuacuuauacuuuaugcaagggggucgggaugcauacacaggugcaaaauuaaacaucgaucgauuaagugauuacgauguagaucauaucaugccacaaucauuuguaaaagacgacucacuggacaauagaguucuuguagcuagagcgguaaacaaccaaaaaucagacaaaguaccagcacuauuauuugggaauaagguaguagcugaucuagguaucacaguuagggaaaugugggacaaauggcaaaaauuaggaaugauuucaaaaagaaaacuuuccaaccuauuaacagauucagaugcacuaacugaguacagagcacaaggauuuaucagaaggcaauuaguugaaacuucacaagugauaaaauuaacggcaacuauauuacaaagcgaguucccggauucaaaaaucauagaaguucccgcaaaauauaauagcauagucagaaaacaguucgacuuauacaaaucaagagaaguaaacgacuuccaccaugcgaucgaugcuuaucuaagcacaaucguuggcaacuacuuguaccaaguauacccuaauuuaagaagaauguucgucuacggagaguucaagaaauuuaguucgaacgcugaagaaagcgcacaugauguagcacgaaggguaaaaucaaugaauuucuuagaugaccuauuaaggggaacacacggugauaauaucuacuguaggaguacaggugaaauaguauuuaauagaaaugauaucauaucaaaacucaaacaagcauacaguuucaagcaaauguuagucacacaagaaguuuucacgaagaaaucagcacuauuuaaccaaacagucuauccuagucccaaaagagacggauccaaacgaagcggucuuauaccaagaaaaagaggaauggacccggaaauauacgggggauaugcucauaaccaagacucauauuuugugcuggcgaaaauugaaaagguaaaagguuauacauuacaaauaguuggcguaccuauccgaagucuggaaaucauaaacaaggcugaagacuuuuccacggcgcuacucgacauaauaaaaaguaaagugauguauaaugagaaaacaggucaaccaaagcggggaaucaaaaauguugaaauacucgucaacaaauuaccauaucgccaacccauacuugaaaaggauguaucauacauguuaggcaguucugcuuacaaauauaacauaaaacagauaacacucucgcgccagucaaugaaguacauauuggauuauauagacgauccaaacuucacaaaacaugaaaugacaaugauagaugaacaaaaugaacgagaaugccuguuaagugucuaugaugaaauccuugaaaaaguagauaaauaucucccuuuguuugacggaaauaaauuuagagagaaacuccauucugcaagaaaagaguucguauccuugucuguugacgaugaggcauccgccauagagaaaaucuuaagaggacuucaugcgaauagcgaaaugcccuccuuagaaaaucucaaaauaaaaccugcauuaggauucuuucaaaugaaaaauggaauuacacuguccaacgacgcaguuuuacuuuaucaaucacccacuggauuauuugagagaaggguuaaagugucagacuuacuaaaguga

SEQ ID NO: 5676 - RNA, 4308 nt, Artificial Sequence
  Cas9 variant
augaaaaauauacugggauuagaccuugguacaacaucaauagguuuugcacacauagucgaagacgaaaacaaagagaaaagugaaauuaaagaacuaggaguucgcauagugccacuaacuacagacgaacaaagugacuucgaaaaaggaaaaucuauuacaacuaaugcaaaucgcacauuaaaacacggagcacguuuaaaucuugacagauaucaacaaagaagaaaauaccugauagaccuauuacaaaaagcuaauuuaauaacaucaaguucaauuuuagcagaaaauggcaaaaauacuacgcacucuaccuggcaauuaagagcuaaagcaguaacagaacggauagaaaaagaagaguucgcaaggguauuacuagcaauaaauaagaaaagaggauauaaaaguucuagaaaagcaaaaacugaagaugaaggacaagcuauugacgguauggccauagccaaacgcuuauacgacgaaaaucucaccacaggacaauuaucccuucagcuacuucaacagaacaagaaacucuuacccgacuuuuaucgcucagaccugcaaaaagaauuugauuuaguguggaauuuccaaaaacaauucuaucccgauauucuaaccgacucauuuuauaaagaauuacaaggaaaaggaaaagacgcuaccaguaaagcauucucuaaaagauaucacuucgacacagcugaaaauaaaggaucuaaagaaucaguacgcuuacaagcauaccaauggcgagucgaagcgauaucuaaacaauugaguaaagaagaagucgcauauguuuuaaccgaaauuaacaauaacuuaaacaaugccuccggauaucuuggggcaauaucagauagaagcaaagaacucuacuucaauagacaaacgguaggccaauacuuauacgcacaacuacaggaaaacagacacaacucucuuaaaaauaaaguauuuuaucgacaggacuauuuagacgaauuugaaagaauaugggaaacacaagcaucauuccauaaagaacugacggaagaguuaaagaaacaaauccgagacguagugauuuucuaucaacgaaaaccaaaaucccaaaaagguuuaauaaguuucugugaguucgaaucaaaagaaaucgaaauugaaaaagacggaaaaacgauaacgaaaacaaucggcgcacgagucgucccuaaaucaucuccucuauuucaagaauuuaaaauauggcaaauucugaacaacgugauauguaaacgaaaaggaaucaggaagaagaaaguaagcgccaaaacaacccaauuagauuuauuaaaugaaucaucgcaaaccauauuuagccuagacauggaauguaaacaauugcuauucgaggaacuuaaccuaaaaggggaucuaaaauccgacaaaguucuaaaacuucuugguuacucaccucaagagugggaaaucaauuauaaccaacuagaaggaaaccgaacgcaaaaagcccuauacgaggcuuaccuuaaaauaguugaaauggaagcucacgauguaaaagauauucuucaaauuaaauccgcaaaagaugacuggagccucgacgaaagcccuuuaucagcuagugagauuagagaaagcguaaaagccauauuccaggcccuaggaauuugcacuaaaauacuauauuucgauccguugcuuccuguaaaagaguuugaaaaacaagacaguuaucaacuauggcaucuauuauauucguacgaaucugaugacaguacaagcggaaacgagacacuauacagaauacuugagaagaaauacgccuucaaaagagaacacguacgaauuuuagcaaacguagcacuucaggaugacuauggaaguuuaagcaccaaagcgauacgcaaaaucuaucccaacauaaaagaaaaccaguacaguauagccugugaaauggcaggauacaaacacuccaaacuuagcuuaacuacagaggaacuugaagcccgagaacugaaaaauauaauaccgcuacuaaagaaaaacgcucuacgaaacccuguugucgagaaaauauuaaaccaaaugaucaaugucguaaaugcacuaauugagaaaaauagcgaacgagacgcagaaggaaaaauaacaaaauauuuccacuuugaugaaauaagaauagaacuagcuagagaauuaaagaaaaacgcacagaaaagauacgagaugacucaaaacauaaacaaagcuaaacuugaacaucagaaaauaagugagauacuucaaaaacaguuuggaaucaaaaauccaacaaaaagugacauaauaagauacagauuauaucaagaauuagaacauaauggauauaaagaacuauauacgaacgcauauauagcaccugacguccuauucagcaaaaauauagacauagagcauauuguucccaaagcaaggguauuugacgauagcuucaguaacaaaaccuuagcauuccgagaguucaacaucaagaaaggcgaaucaacagccuucgacuauaucaccagucuaaauucggaagaggaauuaaaccaauaccucacaagaguugaaaaugcuuauaaaacaaaaagcaucucaccaacaaaauacaaaaaccuguugaagaaagcaucagagauaggugacgacuucauuaaucgagacuuacgugacacacaauacauagccaagaaagcaaaagaaauauuauuucaaguaacgaaaaacguccuaaguacaucaggaagcauuacagaucguuuacgcgaagauuggggcuuaguagaugucaugaaagaacuaaacaugcccaaauaucaaucacuaggacucacagaaguggaagaaagaaaagauggaaauaaagugacaguaaucaaaaacuggacuaaaaggaacgaccacagacaucacgcuauggacgcauuaacaguagcauucaccaaaccaagcuacauacaauaucuuaaccacuuaaacgcacguaaagacgaaaauaauaaaaacuacuccgucauacuagcaauugaagaaaaagaaacaaucaaaguccguacgaauaauggcaaaaauaaaagggucuucauagaaccgauccccaacuucaggcaagucgccaagaaacaccuagaagaaauuuuuaucucacauaaaacuaaaaauaaaguaguaaccaaaaacguaaacaaaccagccgguaccgacaaacaacaaaucacgcuuacuccccggggacaauuacacaaagaaacaauauauggcaaauaucaauauuacguaaacaaagaagagaaaauagggguaaaauucgauaaagaaacaauagccaaagucucaaauccgcuauauagagaagcacuauugaaaagacuacaagcuaacgacaaugaucccaagaaagcauuuacaggcaaaaacgcauuaagcaagaaaccaaucuaccuagacgaaucgaaaacuaaaacucuaccagaaaaaguaaaucuuacguauuuagaagaagacuuuagcauuagaaaagacauuagcccggauaauuucaaagaccuaaaaucuauagaaaaaguuauagaucaaggcguaaaaagaauacuaaucaaacgucuccaagcauacgacaaugaucccaagaaagcauuugucgaccuagagaaaaauccaaucuggcucaauaaagaaaaaggcaucgcaauaaaaagaguuaccauauccggagugaacaaugcucagccgcuacacauaggaaaagaccaccuugguaaaacaacacucaacaaagaaggaaaagaaauaccagucgauuauguaagcacaggaaacaaccaccauguagcaauuuacagagacaaggagggcaacuugcaagagcaaauuguaucauucuuugaugcggugguaagagcccaacaggggcuuccaauaaucgacaaaacauauaaacaagcagaaggauggcaauucauguucacuaugaaacaaaaugaaauguucguuuucccaaaugaaacaaccggauucaauccggcugaaaucgauuuacuagauccaaagaauaagaaacuuauaucacccaaucuauuccgaguccaaacaauaucgguaguaaaauacggaaacucaguaguccgagacuucaaauuuagacaucaucucgaaacaacuuuacaagaugacaaaauacuacagggaauuacauuucaacaaauuaaaucacuagaaccauuacgaaacauuguaaaagucagaaucaaccaccuaggagauauaguaaguaucggcgaauauuga

SEQ ID NO: 5677 - RNA, 4308 nt, Artificial Sequence
  Cas9 variant
augaaaaacauacuuggauuagauuuaggaacuacaucaauaggauuugcacauauaguagaagaugaaaauaaagaaaaauccgaaauaaaagaacucggugugcguauaguaucauuagcaacagacgaacaauccgacuucgaaaaaggaaaaucuauaagcacaaaugcaaaccggacauuaaaacauggcgcaagauuaaacuuagauagauaucaacaaagacgaaaauuucuuauagaucuucuacaaaaagcgaaucuaauaacaagugcaagcauauuagcugaaaauggcaaaaauacaacgcauucaacuuggcaacuccgagcgaaagcuguaaccgaaagaauagaaaaagaagaauuugcaagaguucuauuagcgauaaauaagaaacgaggauacaaaaauagcagaaaaacuaaaacggaagaugaaggacaagcaaucgacggaauggcgaucgcaaaauguuuauacgaugaaaaccuuacaccaggccaacugagccuacaacuacuacaacaaaacaagaaacuacuaccagacuucuacagaucugacuuacaaaaagaguucgaucuaguuuggaaucuccaaaaacaauucuauccagauauauuaacggauuccuucuauaaagaacuccaaggaaaaggaaaagaugcaacaucuaaggcguuuaguaaaagauaucauuucgacacugcagaaaacaaagguaguaaagaaucaguucgacuacaagcauaccaauggcgagcagaagcaauaucgaaacagcuuaguaaagaagaaguagcguacgucuugacagaaaucaacaacaaccuuaacaacaguuccggcuaccuaggugcuauaucugauagaucgaaagaacucuacuuuaacaggcaaacaguuggacaauaccucuacgcucaacuucaagaaaauagacauaacagccuaaagaauaaaguauuuuaccgacaagauuaucuugaugaguucgaaagaauaugggaaacccaggcuucauuucauaaagaauuaacagaugaacugaaaaagcaaauuagagacgucgucaucuucuaucaacgaaaauuaaaaagccaaaaaggacuugucagcuucugcgaauuugaaagcaaagaaauagaaauagaaaaagaugguaaagccauaaccaaaagcauaggggcaagaguagucccaaaaucaucaccauuauuucaagaguucaagauauggcaaauacucaauaacgucacuugcaaaagaaaaggcauccgcaagaagaaaucaucggcaaaauccaccgaacuugaucuauuuaaugaaccuucacaauccauauuuagccuagauauggaauguaaacaguuacuauucgacgaacuaaaucugaaaggcgaccuaaaaucagacaaaguacuaaaacuacucgguuacucuccccaagagugggaaauuaacuauaaccagcuugaaggcaacagaacucaaaagagcuuauacgaggcuuaccuuaaaaucaucgaaaucgaagguuaugaaguaaaagacauacuccagaucaagucaacaaaagacgacuggaguuuagacgaauccccacuaucagcgucagaaauuagagagagaguaaaagucaucuuccaaacacuagggauuuguaccaaaauacuauacuuugacccccuacuaccagucaaagaauuugaacaacaguacucauaccaacuguggcaucugcucuacagcuacgaaagcgacgacaguacuagcgguaaugaaacucuuuaccgcauacuggagaagaaauacgcauuuaaacgagaacacgcaacuauacucgcaaacguagcauuacaagacgacuacggcagccuuagcaccaaagcaauaaggaaaauauauccauacauaaaagaaaaccaauauagcacggcaugcgaacuagcuggcuauaaacacaguaaacuaucacuaacuaccgaagaauuagaagccagagaacugaaaaauauaauaccauuacucaagaaaaaugcacuccgaaacccaguuguugagaaaauccuuaaccagaugauaaacguuguaaacgcauuaaucgagaaaaauuccgaaagggacgccgaaggaaaaauaaccaaauacuuucacuuugaugaaauacgcaucgaacuggccagagaacuuaagaaaaacgcccaagaacgauaugaaaugacacagaacauaaauaaggccaaacuagaacaccagaaaauuuccgaaaaauuacaaaaacaauuuggaaucaaaaauccuacaaaaagcgacaucauaagauacagauuauaucaagaacuggaacacaacggauacaaagagcuguacaccaauacauacaucgcaccagacgucuuauucaguaaaaauauagacaucgaacacauaguccccaaagcuaggguauuugacgacucauucagcaauaagacacuggccuuuaaagaguucaacauaaagaaaggggaaagcacagcuuuugauuacauaaccucacuaaauugcgagggugagcuaaaccaauaccuuacacgaguugaaaacgcauacaaaaccaaaucuauaagucuaacaaaauauaaaaaucuacucaagaaagcaagcgaaaucggggacgguuucauaaacagagaucuaagggacacccaauauauagccaagaaagcuaaagagauacucuuucaagucaccaaaaacguccuguccacuucuggcuccauaaccgaccgacuuagggaagauuggggacuuguagacguaaugaaagaacucaauaugccuaaauaccaaucauuaggauuaacagaaguagaagaaagaaaagacggaaauaaaguuacaguaauaaaggauuggacuaaaagaaaugaucacagacaccacgcaauggaugcguuaacaguagcauuuacaaaaccaagcuauauacaauaucuaaaccacuuaaaugcacgaaaagacgaaaacaacaaaaauuacagugucauacuagccauagaaaagaaagaaacaauaaaaguaccaauaaacaauggcaaaaacaaaagagucuuuaucgaaccuauacuaaacuuccgacaaguggccaagaaacaccuagaagagauauucauaucccauaaagccaaaaauaaaguaguuaccaaaaauauaaauaaaccugccggaaccgacaaacaacaaaucacccuaaccccucgagggcaacuucauaaagaaacaauauacggaaaauaccaauauuauguaaauaaagaggaaaaaguuggaguaaaauucgacgaaagaacuauaacaaagguaagcaacccauuauacagggaagcccuacugaaaagacuucaagccaaugauaaugaucccaagaaagcauuugccggcaaaaaugcguuaagcaaaaauccaaucuaccuugacgaagcaaagacaaaaacauuaccagagaaaguaaacuuaacauaucuagaagaagauuucaguauacgaaaggauauaucaccggacaacuucaaagaccuaaaaucaauagaaaaagucauagaccaaggaguuaaaagaauauuaauaaaacgcuuacaagcauacgauaaugaccccaagaaagccuuuguggaccucgaaaagaaccccaucuggcuaaacaaagaaaaaggcauagcaauuaagcgcguaaccauaaguggcguaucaaaugcgcaaccccuacauauagggaaagaccaccuaggaaaaacgaccuuaaauaaagaaggcaaagaaguacccguugauuacguaucgacaggaaauaaucaccaugucgcgauauauagagauaaggaagggaauuuacaagaacaaauagucagcuucuuugaagcaguuguccgcgcacaacaaggacuaccuauuauugacaaaaauuacaaacaggcugaaggauggcaauucauguuuacaaugaaacaaaacgaaauguucguauuccccaaugaagccaccggguucaauccagcggaaauagaucuacuugacccuaaaaacaagaaauuaauaucacccaaccuuuucagaguacaaacaaucuccauuguaaaauauggaaauagcgucgucagagacuuuaaauucagacaucacuuagaaacuaccuuacaagacgauaaaaucuuacaagguauuacauuucaacaaauaaaaucacuagaaccucuacgaaauauuguuaaaguccgaauaaaccauuuaggggauauagucaacauaggugaauauuga

SEQ ID NO: 5678 - RNA, 4311 nt, Artificial Sequence
  Cas9 variant
augaaaaggauuuuaggucuagauuugggaacaaacucaauaggaugggcgcuaguaaacgaggcagaaaacaaagaugaaagaucuucaauagucaaacuuggaguaaggguaaacccccuaaccguagacgaauuaacaaacuucgaaaaaggaaaaaguauaacaacuaacgccgaccgaacacucaaacgaggaaugagacgaaaucuccaacgauauaaguugcgccgugaaacccuaacugaaguauuaaaagaacacaaauuaauaaccgaagauaccauauuaagcgagaaugguaauaggaccacuuucgagaccuauagacugcgugcaaaagcaguaacggaggaaauaucauuagaagaguucgcgaggguauuacuaaugauaaacaagaaaagagguuacaaaucgucgagaaaagcaaaaggagucgaagaaggaacgcuaauugaugggauggauauagcuagagaacuguauaauaauaacuugacuccgggagaauuaugcuuacaauuacuugaugcagggaagaaauucuuaccagacuuuuaccgaagugacuuacaaaacgaauuagauagaauaugggaaaaacagaaagaauacuaucccgaaauccugacagacgucuuaaaagaggagcugagggggaagaaaagagacgcagucugggcaauaugcgcaaaauacuuugucuggaaagaaaauuauaccgaauggaacaaagagaaaggaaaaacagaacaacaagaaagagaacacaaauuagagggaauauacucuaaacggaaacgagacgaagccaaaagagagaaccuacaauggcgaguaaacggcuuaaaggaaaagcuaagccucgaacaacucgugauaguauuucaagaaaugaauacacaaauuaauaacucaagcggauauuuaggagcaauaucagacagaagcaaagaauuauacuuuaacaagcaaaccguuggacaauaucaaauggaaaugcuagacaaaaacccaaacgccucacuuagaaauaugguauuuuaccgacaagauuauuuggacgaguuuaauaugcuaugggaaaagcaggccguauaccauaaagaacuaaccgaggaacuaaagaaagaaauaagagacaucauaaucuucuaccaaaggagauuaaaaucucagaaaggucuuaucggcuucugugaguucgaaucacgccagauagaaguagacauagaugguaaaaagaaaauaaaaacagugggcaauagaguuauaucgcgaaguagcccauuauuucaagaguucaaaauauggcaaauuuuaaauaacauagaagucacaguuguaggaaagaaaagaaaaagaagaaagcuaaaggaaaacuacucugcauuauuugaggaacucaaugaugccgaacaacuugaacuaaauggaucaagacgucuaugccaagaagagaaagaauuauuagcgcaagaacuuuucgugagagauaagaugacaaaaucagaaguucucaaacuccuauucgauaauccccaagaacuggauuuaaacuuuaaaacgauagacggaaacaagacggguuaugcacucuuucaggcuuacagcaaaaugauagaaaugucaggacacgaacccgucgauuucaagaaaccaguugaaaaaguuguagaauacauuaaagcaguauucgaucucuuaaacuggaacaccgacauauuaggauuuaauucaaacgaagaauuagauaaucaaucguacuauaaacuauggcaucuauuguauucauucgaaggagacaacacgccaacaggcaacggcaggcuaauccagaaaaugacagaacuauaugguuucgaaaaagaauacgcgacuauacuagcaaaugucagcuuccaagacgacuauggaagucuaagcgcaaaagcaauucacaaaauacuuccccacuuaaaagaggguaacagauacgauguggccugcgucuacgcaggauaccgccacagcgaaucgaguuugacccgagaagaaauugcaaacaagguacuuaaagauagacuaaugcuccuucccaaaaauucacuccauaauccuguuguagagaaaauccucaaucaaaugguaaacguaauaaaugugauaauagauauuuacggaaaacccgacgaaauaagaguugaauuagcaagggaauuaaagaaaaaugcuaaagaacgagaagaacuaacaaaaagcauagcucaaacaacaaaagcacacgaggaauacaaaacacuacuacaaacugaguucggacuaacaaacguaucccgaacggacauauuacgcuauaaacuauauaaagaacuagaaagcugcggcuacaaaacauuauacagcaauacauacauaaguagagagaaacuauucucaaaagaguucgacauagaacacauuauaccgcaagcacgauuguuugacgauaguuucuccaauaaaaccuuagaagcuagaucaguaaacauugaaaaaggcaacaauacagcauaugacuuuguuaaagaaaaauuuggagaaucuggcgcugacaauucuuuagaacaauaccuaaacaauauagaagauuuauuuaaauccggaaaaaucuccaaaacaaaguacaauaaauuaaaaauggcagaacaagauauaccagaugguuuuauagagagagaucuaaggaacacccaauacaucgccaagaaagccuuaucaaugcuaaaugaaaucucccauagaguaguagccacaucaggaucaguaaccgauaaacuacgggaagauuggcaacuuauagauguaaugaaagaacuuaacugggagaaguauaaggcacuaggucuaguagaguauuuugaggauagagacggaagacaaaucgggagaauaaaagauuggacaaagagaaaugaccauagacaccacgcaauggaugcccugacuguagcauucaccaaagauguauuuauucaauacuucaauaauaaaaaugccagcuuagacccaaaugcaaacgaacacgcaauuaaaaacaaauauuuccaaaacggcagagcuauagcaccaaugccacuaagggaguuccgagcugaagcaaagaaacacuuagaaaauacuuuaauaucgauaaaagcuaaaaacaaaguaauaacuggaaacauaaauaaaacaaggaagaaaggaggaguaaauaaaaacaugcaacaaacuccaagaggacaauuacacuuagaaacaauuuauggaagcggaaaacaauaucuuacaaaagaagaaaaaguuaacgcauccuucgauaugagaaaaaucggcacaguaucuaaaagcgcauacagggacgcauuauuaaaaagacuauacgaaaaugacaaugacccgaaaaaggcguuugcuggcaaaaacagucuagacaaacaacccaucuggcuugacaaagaacaaaugcgcaaaguaccggagaaaguaaaaauaguaacuuuagaagcuauauacacgaucagaaaagaaauaaguccagauuuaaaaguagauaaaguaaucgacgucggaguaagaaaaauacuaauugaucgacucaacgaguauggaaacgaugcaaagaaagccuucucaaaccuagacgaaaacccuauauggcuuaacaaagagaaagguauaaguaucaaaaggguaacgauaaguggcaucucaaacgcacaaucauugcacguaaagaaagacaaagauggaaaaccaauacuagacgaaaauggcagaaacauucccguagacuucguuaauacagggaauaaccaccauguagcaguauacuaucgucccgucauagauaaacguggccaacuuguuguagaugaggcaggaaauccuaaauacgaacucgaagaggugguagugagcuucuucgaggcuguaacacgagcaaacuugggacaaccaauaauagauaaagacuacaaaacaacagaaggcuggcaauuccuauucaguaugaaacagaaugaauauuuuguauuuccaaaugagaaaacuggauuuaaccccaaagaaauugauuugcuagacguagaaaacuacggacuaauaaguccgaaccuauuuagaguccaaaaguucucacucaagaauuauguauuccgccaucaccuagaaacaacaauaaaagauacaaguucaauuuuaaggggaauaaccuggauagauuucagaagcuccaaaggacuagauacuauugugaaaguaagaguaaaccauauaggucaaaucgucuccguuggcgaguauuga

SEQ ID NO: 5679 - RNA, 4311 nt, Artificial Sequence
  Cas9 variant
augaagcgaauacuaggacuagacuuaggaacgaauaguauuggaugggcacuuguaaacgaagcagaaaauaaggaugagagaucgucgauaguaaaacucggaguacgaguaaauccccuaacaguagacgaauuaacgaacuucgaaaaaggaaaaucuauaaccacgaacgcagaccgaacccucaaaagaggaaugagaagaaaucugcaaagauauaagcuaagaagggagacauugacagaaguguuaaaagaacacaaacucauaaccgaagacaccauacugagugaaaaugguaacaggacuacuuucgagacauaucgacuuagagcaaaagcuguaacugaagaaauaaguuuagaggaguucgccagaguacuacuaaugauaaauaagaaaagagguuauaaaaguucaagaaaagccaaaggcguugaagaagguacgcuaaucgacgggauggacauagcaagagaauuauacaauaacaaccuaacccccggggaauugugucuacaacuacuagacgcaggaaagaaauuucuaccagacuuuuauagaagcgaucuucaaaaugaauuagacagaauaugggaaaaacaaaaagaauauuauccugaaauacuaacagauguuuugaaagaggaacuacgaggaaagaaacgagacgcaguaugggcaaucugcgcaaaauauuucguauggaaagaaaacuacaccgaauggaacaaagagaaaggaaaaaccgaacaacaagaacgagaacauaaauuggaggguauauauaguaaacggaaacgagaugaggcgaaacgagaaaacuuacaauggcgaguaaauggacugaaagaaaaacuuucacuggaacaguuagucauaguauuccaagaaaugaauacacaaaucaacaauaguucagguuacuugggagcgauaucagacaggaguaaagaacuuuauuuuaauaagcaaaccgucggacaauaucaaauggaaaugcucgacaaaaauccuaacgcuucucuuagaaacauggucuucuaucgacaagacuauuuagacgaauuuaacaugcucugggagaagcaagcaguauaucauaaagaauuaaccgaagaacuuaagaaagaaauuagggauaucauaauauuuuaccaaaggcgcuugaaaucacaaaaagggcuuauuggauucugugaauuugaaucuagacagaucgagguagacauugacggaaagaagaaaauaaaaacaguaggcaaccgcgucaucucccguucuucaccacuauuucaagaguucaaaaucuggcaaauauuaaacaauauagaaguuacuguaguaggaaagaaacgaaaaagaagaaaauuaaaagaaaauuauucugcacucuucgaagaauuaaacgaugccgagcaauuagaacuaaauggaucacgcagacucugccaagaagaaaaagaacuuuuagcacaagaacuguuuauaagagauaaaaugacaaaaagcgaaguauuaaaauuacuauucgacaauccacaagaguuagaccucaacuuuaaaacaauugauggaaauaaaacaggauacgcauuauuucaggcuuacagcaaaaugauugaaaugucaggacaugaaccaguagacuuuaagaaaccaguagaaaaaguaguagaauacauaaaagcaguuuucgaccucuugaacuggaauacugacauacucggauuuaacagcaacgaagaguuagauaaucaaccauacuauaaacuauggcaccuguuauacaguuuugaaggagacaauaccccgacaggaaacggcagacucauccagaaaaugacagaacuauacggguucgaaaaagaauaugcaaccauauuggcaaacguaaguuuucaagaugauuauggaucauuauccgcaaaagcaauucauaaaauucuaccacaccugaaagaaggaaacagguaugauguugcaugcguauacgcuggcuaucgucacagugagagcucucucacuagagaagaaaucgcaaauaaaguacuaaaagaucgauuaauguuauugccgaaaaacucccugcauaacccaguaguagagaaaauacuaaaucaaaugguaaauguaaucaaugugauaauugacauauaugguaaaccagaugaaaucagaguagaacucgcaagagaacuuaagaaaaaugcaaaagaacgggaagaacucaccaaaaguauagcacaaacaacgaaagcccacgaagaauauaaaacgcuucuacaaacagaguucggccuaacgaauguaaguagaacagacaucuuaagauacaaacuauauaaagaauuagaaucgugcggauacaaaacauuauauagcaacacauacauaucccgugaaaaacuguucucaaaagaauuugauauagaacacauaauaccucaagcacgcuuauuugacgacucauucucaaauaaaacacuugaagcaagaucgguaaacauagagaaaggaaauaaaacagccuaugauuucgucaaagaaaaauucggagaaucaggagcagauaauucccuagagcacuauuuaaauaacaucgaagaccuauuuaaaaguggaaaaauuucaaaaacaaaauauaauaaauuaaaaauggcagaacaagacauacccgacggauuuauagagagagaccuaagaaauacacaauauauugccaagaaagcccuguccaugcuaaaugaaauaucucauagaguaguugccacaucaggaagcguaacagacaaacugcgagaagauuggcaacuaauagauguaaugaaagaacuuaauugggaaaaauauaaggcccuuggacuuguugaauauuuugaggacagagaugguagacaaauaggaagaauaaaagacuggacaaaaagaaaugaccauaggcaucaugcaauggaugcacuaacugucgcuuucacgaaagauguuuuuauucaauauuuuaauaacaaaaaugcaagccucgacccaaacgcaaacgaacaugcaaucaaaaauaaauacuuucaaaauggcagagccaucgcaccuaugccgcuaagagaauuucgagcagaagcuaagaaacacuuagaaaacacuuugauuagcauaaaagcgaaaaauaaaguaauaacgggaaauauaaauaagacccgcaagaaaggaggaguuaacaaaaauaugcagcaaacacccagaggucaacuccaccuugaaacaauuuacggaagcgggaaacaauacuuaaccaaagaagaaaaaguaaaugcaucauucgacaugcgcaagauuggaacaguauccaaaagcgcauaucgugacgcauuauuaaaaagguuguacgagaaugacaaugacccaaagaaagccuucgcugguaaaaauagccucgauaagcaaccaaucuggcuagauaaagaacaaaugagaaaaguacccgaaaaagugaaaauaguaacccuugaagcaauauacacaauacgaaaagaaauuagcccggacuuaaaagucgacaaaguuauagauguaggcguaagaaaaauucuaaucgaccgacuaaacgaauauggaaaugacgcuaagaaagcguuuagcaacuuagacaaaaacccaauaugguuaaauaaagaaaaaggaauaucgauaaaaagaguaacaauuagcggcaucucuaaugcacaaucguuacacgucaagaaagacaaagacgggaaaccuauacuagaugaaaacggucgaaacauaccagucgacuucguaaacacagguaacaaucaccacguagcaguauauuaccgaccaguaaucgauaaaagaggacaauuaguagucgaugaagcuggaaacccgaaauacgaacuagaagagguuguuguaaguuucuuugaagccguaacuagagcaaaucugggucucccgauaauagacaaagacuauaaaacaacagaaggcuggcaguucuuguuuucuaugaaacaaaaugaguauuucgucuucccaaacgagaaaaccggauuuaauccaaaggaaauagaccuacuagacguagaaaacuauggucuaaucucgccaaaccuuuuccgaguccaaaaauuuucgcucaaaaacuauguguuucgacaucaccuagaaacgacaauuaaggacaccaguucuauacuaagagguauaacauggauagauuuccgaucaucaaaaggacuagacacaauaguaaaaguaagggucaaucauauaggccagaucguaagcguaggagaauacuga

SEQ ID NO: 5680 - RNA, 4311 nt, Artificial Sequence
  Cas9 variant
augaagaggauucuaggacuagauuuaggcacuaauucaauuggaugggcacucguuaacgaagcggaaaauaaagaugaaagaaguucaauaguuaaauugggcgugagaguuaacccacucacaguagacgagcuaacaaacuuugaaaaaggcaaaucaaucaccacaaaugcagaccgaacauuaaaacgcggcaugagaaggaaucugcaaagauacaaauuaaggagggaaacauugacagaaguauuaaaggagcacaagcuaaucacagaagauaccauauugagcgagaauggcaaucgaacuacauuugaaacauacagauuaagagcuaaagcagucacagaagaaauaagccucgaagaauuugccagaguguuauuaaugauaaacaagaaaagaggauacaaaucgagucgaaaagccaaaggaguagaagaagguacccugaucgacggaauggauaucgcuagagaguuauacaauaacaaucuaacgccuggagaauuaugucugcaauuacucgacgcaggcaagaaauucuuaccugacuucuauagaucggaucuacaaaaugaauuagacagaauuugggaaaaacaaaaagaauauuauccagaaauacuuacagaugucuuaaaagaggaacuacgaggcaagaaaagagaugcagucugggccauaugcgcaaaauacuucguuuggaaagagaacuauacggaguggaauaaagaaaaaggaaaaacagaacagcaggagcgagaacacaagcuagagggaauuuauagcaaaagaaagcgggacgaggcaaaacgagaaaauuuacaguggcgaguaaacggacuaaaagaaaaauugagucuggagcagcuaguuauuguauuccaagaaaugaacacccaaaucaacaacaguuccggauacuuaggagcaauaagugaucgaaguaaagaauuauauuucaauaaacaaacaguuggucaauaucaaauggaaaugcuagauaaaaauccuaacgcgagccuaagaaacaugguauuuuaucgacaagauuaucuggacgaguucaacauguuaugggaaaaacaagcagucuaccauaaagaauuaacagaagaacuuaagaaagaaauacgcgacaucauaauauucuaucaaagaagauuaaaaucacaaaaaggauuaaucggauucugcgaauuugaaucccgacaaauagaaguggacauagacggaaagaagaaaaucaaaaccguaggaaacagagucauaucacgguccucaccacuuuuccaagaauuuaaaauauggcaaauacuuaacaacauagaagucacaguaguaggaaagaaaagaaaaagacguaaacuaaaagaaaauuacagugcauuguuugaagaauuaaaugaugcagaacaauuggaacuaaauggcucaagacgccuaugucaagaagagaaagaacuauuagcacaagaauuguucauacgagauaaaaugacuaaaagcgaaguucuuaaacuacucuuugacaauccacaagagcucgauuugaacuucaaaacuauagacggaaauaaaacaggcuacgcauuauuucaggcuuacucgaaaaugauagagaugaguggacacgaaccaguugauuuuaagaaaccuguugaaaaaguuguagaauauauuaaagcggucuuugaucuguuaaauuggaauacggauauccuagguuuuaacucaaacgaagaacuagauaaccaaucauauuacaaacuauggcaucuacuguacuccuucgaaggagauaacacuccaaccggaaauggaagacucauacagaaaaugacagaacuauauggauucgaaaaggaauacgcgacaauauuagcgaaugucaguuuccaagacgacuacggaucacucucagcaaaagccauccacaaaauacuuccacacuuaaaagagggaaauagauacgacguagcaugcgucuacgcaggauaccggcauucggagucgucacuaacaagagaagagauagcaaacaaaguuuuaaaagauagauuaauguuauuaccuaaaaauucucugcauaauccaguaguagagaaaauccuaaaccaaaugguaaauguaauaaauguaauaaucgacauauacggaaaaccagaugaaauaaggguugaauuagcucgagaauugaagaaaaacgcgaaagaacgagaggaauugaccaaaucaauugcacaaacaaccaaagcccacgaagaauauaaaacauuacugcaaaccgaguucggcuuaacaaauguuucaaggacagacauuuuaagauacaaacucuacaaggaacuggaaagcugcggauacaaaacauuguauucaaacacauacauuaguagagaaaaacuguuuucuaaagaauuugauauugaacacauaauuccucaagcgagacuauuugacgauucauucucaaacaaaacauuagaagcaagaagcguaaauauagagaaaggaaauaaaacggccuacgacuuuguaaaagaaaaauucggagaaaguggagccgauaacucacuggagcacuaucuaaauaacauagaggaucuauuuaaaaguggcaaaaucucaaagacaaaauacaauaaacuaaaaauggcugaacaagacaucccggaugguuucaucgaaagagacuuaagaaacacccaauauauagccaaaaaggcguuaucaaugcuaaacgagauaucacaccgcguuguagcuacaucuggcucaguuacagauaaauuaagggaagauuggcaauuaauagacguaaugaaagaauuaaauugggaaaaauacaaagcauuaggauugguagaauauuuugaagacagagaugguaggcaaauagguagaauaaaggauuggaccaaaagaaacgaccaccgacaucaugcaauggaugcauuaacaguggcauuuacaaaagacguauuuauucaauauuucaauaacaagaacgccagcuuagacccgaaugccaacgaacacgcaaucaaaaacaaguacuuucaaaauggacgugccauagcgccaaugccauuaagagaguucagagcugaagcuaaaaagcaucuagaaaauacacuaauaagcauaaaagccaaaaauaaagucauaaccggaaacauuaauaaaacacgaaagaaaggugguguaaauaaaaauaugcaacaaacuccuagagggcaauugcaucucgaaacaauauacggcucgggaaaacaauacuuaacuaaagaagagaaagucaacgcaucauuugauaugagaaaaauagggacaguaucuaaauuagcauauagagacgcuuuacuuaaaagguuauaugaaaacgacaacgacccaaagaaagcauucgcaggcaaaaauucacuagauaaacaacccauauggcucgauaaagaacaaaugcgaaaaguacccgaaaaaguaaaaauaguaacauuagaagcuauauauacuauaagaaaagaaaucagcccggaucucaaagucgauaagguuauagacgucggaguuagaaaaauauuaauagacagacugaaugaauaugguaacgacgcuaaaaaggcauucaguaauuuggaugaaaacccaauaugguugaauaaagaaaaaggaaucaguauaaaacgaguaacaauaagcggaauaaguaacgcacaaucauuacacguaaagaaagauaaagauggaaaaccuauauuagacgaaaacggaagaaacauaccaguagauuucgucaauacaggcaauaaucaucacgucgcaguauauuacagaccaguuauugacaaaagaggacagcuagucguggaugaagcagguaacccaaaguaugaauuagaagaaguuguuguauccuuuuucgaggccgugacacgagcaaauuuaggucaaccaauaauagauaaggauuauaaaacuaccgaaggauggcaauuccuauuuagcaugaaacaaaaugaauacuuuguuuuuccaaacgagaaaacaggauucaauccgaaagaaauugaucugcuugacguggaaaauuacggauuaauaaguccuaauuuauuccgaguacaaaaauucucacuaaagaauuauguuuuccgacaucacuuagaaaccacaauaaaagauacaaguagcauacucagagggauuacuuggauagauuuuagaaguaguaaaggccuagauacaauaguaaaaguaagaguuaaucacauaggacaaauaguaagugugggggaauauuga

SEQ ID NO: 5681 - RNA, 4311 nt, Artificial Sequence
  Cas9 variant
augaaaagaauauugggacuagaucucggaacuaauucaauaggaugggcucuuguuaaugaagcagagaauaaagaugaacgaaguucaauagucaagcuagguguacggguaaauccacucacggucgaugaacuaacgaacuucgaaaaaggcaaaucaauaaccacaaaugcagaucggacacuaaaaagggggaugcgacgaaauuuacaacgguauaaacucagaagagaaacauuaacagaaguuuuaaaagaacacaaauuaaucacagaagacaccauacuaagcgagaacggcaacagaaccacuuucgaaacauauagauuaagagcaaaagcaguaacagaagaaauaagucuagaggaauuugccagaguuuuacugaugauuaauaagaaaagaggcuauaaaaguagccgaaaagcuaaaggaguugaagaagggaccuugauagacgggauggauauagcaagagaacuauacaacaacaacuuaacacccggagaacuuugucuccagcuuuuggaugcaggcaaaaaguucuuaccugacuuuuacagaagcgaccuccaaaacgaacucgaucgaauaugggaaaaacaaaaagaauauuacccugagauccuaacugauguucuuaaagaagaauuaagaggaaagaaaagagaugccguaugggccauaugugccaaguauuucguauggaaagaaacauacacagaauggaacaaagaaaaaggaaaaacagaacaacaggaaagagaacauaaacuagagggaauuuacagcaaaagaaaaagagaugaagcaaaacgagaaaauuuacaauggagaguuaacggacuaaaagaaaaacuaaguuuagaacagcuaguaauuguuuuucaagaaaugaacacacaaaucaauaauucaucaggauaucuaggggcaauuucagaucguucaaaagaacucuacuucaauaaacaaaccgucggacaauaccagauggaaauguuagacaaaaauccaaacgcaucacucagaaauaugguauuuuaucgucaagauuauuuagaugaguucaauaugcucugggaaaaacaggcaguuuaccacaaggaacuuacugaagaauuaaagaaagagauuagagauaucauaauauucuaucaaagaagauugaaaagucaaaaagggcuaauagguuucugcgaauuugaaaguaggcaaauagaaguagacaucgacggaaagaagaaaauaaaaacgguagguaacagaguaauaagcagauccaguccgcuauuucaggaguuuaaaaucuggcagauauuaaacaacauagaaguaaccgucguuggaaagaaaagaaaacgcagaaaauugaaagaaaauuacucagcgauauucgaagaacuaaaugaugccgaacaacuagaauuaaacggaagccgaagauuaugccaggaagaaaaagaacuauuagcacaagaacuauuuguacgagauaaaaugaccaaaagugaaguacuuaaacuauuauuugauaacccacaggaauuagaccuaaacuuuaaaacgaucgacgguaacaaaacagguuacgccuuauuucaagccuauucaaaaaugauagaaaugucaggacacgaaccagucgacuucaagaaaccagucgaaaaaguaguggaguauauaaaagcuguauuugaccuauuaaauuggaacacagauauacuaggauuuaacucaaacgaagaacuggacaaccaauccuauuacaaauuauggcacuuacucuacaguuuugaaggagauaauacuccaacagguaauggacguuuaauucagaaaaugacagaauuauacgguuucgaaaaagaauacgccacaauauuagccaaugugucauuucaagacgauuacggaagucuaucagccaaggcuauacacaagauauugccacaccugaaggaaggaaauagauaugacguagcuugcguauaugccgguuaccgccauucugaaagcucacuuacacgagaagaaaucgcgaauaagguuuuaaaagauagacucaugcuacuuccuaaaaauucgcuucauaauccaguagucgaaaagauauuaaaucaaauggucaaugucauuaacguaauaauagacauuuacggaaaaccagacgaaauacgcguugaauuagcacgagaguuaaagaaaaacgcaaaagagagagaagaguuaaccaaaaguauagcacaaacaacgaaagcuaaugaggaauauaagacacuacuacaaaccgaauuuggccucacaaacguaagccgaacugacauccuacguuauaaacuauauaaagaauuagaaagcugcgguuauaaaacguuauacucgaacacuuauauaucaagggaaaagcuauuuuccaaagaguucgacauugaacacauuaucccacaagcacgacuguucgaugacucguuuucaaauaaaacuuuggaagcccgaucaguaaauauagaaaaaggcaauaagacagcauacgacuucguaaaagaaaaauucggcgaaucuggagcugauaacagccuagaacauuaucuaaacaacauagaagaucuguucaaaucagguaaaauaaguaaaaccaaauauaauaaacuaaaaauggcaaaacaagauauaccagauggauuuauugagagagaucugaggaauacucaauauauagccaagaaggccuuaagcaugcucaacgaaauaucucacagggucguggcgacaucagguuccguaacagauaaauuaagagaggacuggcaauuaauugacguaaugaaggaacucaauugggaaaaauauaaagcauuggguuugguggaguacuucgaagauagagauggacgacaaaucggaagaaucaaagauuggacaaaaagaaaugaucaucgacaccaugcaauggacgcccuaacgguagcuuuuaccaaggauguuuuuauacaauacuucaauaauaaaaaugcgaguuuagacccaaaugcuaacgaacacgcuauuaaaaacaaauacuuucaaaauggacgugccauagcaccaaugccacugcgagaauuuagagcagaagcaaagaaacaccuagaaaacacucuaauaaguauaaaagcgaaaaauaaaguaauaacagguaacauaaacaaaacaaggaaaaagggagggguaaacaaaaacaugcaacaaacaccaaggggccaacugcaucucgaaacgauuuacgggucaggaaaacaauaccuaacaaaagaagaaagagucaacgccagcuucgauaugagaaaaaucgaaacuguuucgaaaagcgcauauagagacgcauuacugaaaagacuauaugagaaugacaaugaccccaagaaagcauuugcagguaaaaauagccuagauaaacaaccaauauggcuagauaaagaacaaaaacgaaaaguacccgaaaaaguuaaaauaguaacuuuagaggcaaucuauacaaucaggaaagaaauaagcccagacuugaaagucgauaaaguaauagaugugggaguuagaaaaauccuaauagacagacuuaaugaauaugggaaugaugcaaagaaagcauuuagcaauuuagaugaaaauccaaucuggcuaaacaaagaaaaagguauaaguauaaagcgagugacaauaaguggaauaucaaacgcacaaucccuacauguaaagaaagacaaagauggcaaacccauuuuggaugaaaacgguagaaacauaccgguugauuuuguaaauacugguaacaaccaucauguagcaguuuauuauaggcccguaaucgauaaacgagggcaacugguaguagacgaagcaggaaacccaaaauaugagcuagaagaagugguaguuaguuucuucgaagcagugacuagggcuaaucuggggcaaccaauaauugacaaagauuacaaaaccacagaaggauggcaauuucuuuucaguaugaaacaaaaugaauauuuuguauucccuaaugagaaaacuggauucaaccccaaagaaauagacuuauuggauguagaaaauuauggcuuaaucucuccaaauuuauucagaguucaaaaauucucacugaaaaauuauguuuuccgacaccaccucgaaacaacaauaaaagauaccaguucaauccuaagaggaaucaccuggauagauuuuagaucaaguaaaggcuuagacaccauaguuaaaguaagagucaaucacaucggacaaauagucagcguaggagaauacuga

SEQ ID NO: 5682 - RNA, 4311 nt, Artificial Sequence
  Cas9 variant
augaaacguauacuuggucuagaccugggaaccaacucuaucggaugggcgcuagugaacgaagcagaaaauaaagaugaacgaagcucaauaguuaaacugggaguaagaguaaacccacucacaguugaugaacuaacuaacuuugagaaaggaaaaagcauaaccacuaacgcagauaggacauugaaaaggggaaugaggagaaaucuacaaagguacaaacugagacgcgaaacccuaaccgaaguacuaaaagaacacaaauuaaucaccgaagacacaauucucucagaaaacgguaauagaacuacauucgaaacauaucgacuuagagcaaaagcgguaaccgaagaaaucucauuagaagaguucgcucguguuuuacugaugauuaauaagaaacgagguuauaaauccucaagaaaggcuaaaggcguggaagaaggaacacuuauagacggcauggauauagcgcgcgaacuauacaauaauaaccugacacccggagaacucugcuuacaacuuuuagacgcugguaagaaauuccuaccugacuuuuauaggagugauuugcaaaacgaacucgauagaauaugggaaaaacaaaaagaauauuauccagaaauauuaaccgauguucuuaaagaagaauuacggggaaagaagcgagacgcgguaugggcaauaugugccaaauacuuuguauggaaagagacuuauacagaauggaauaaagaaaaaggaaaaaccgagcaacaagaaaaagagcacaaauuagagggcauauacucaaaaagaaagcgagaugaagcaaaacgggaaaacuuacaauggcgagugaauggccucaaagaaaaacuaagucuagaacagcuaguaaucguauuccaagaaaugaacacccaaaucaacaacucaaguggauaccuaggugcgaucagugauaggaguaaagaacuauauuuuaauaagcaaacaguaggacaauaccaaauggagaugcuggauaagaauccaaacgcaucguuaaggaauaugguauucuacagacaagacuaccucgacgaguucaauaugcugugggaaaaacaagcaguauaccauaaagaacuaacagaagaacucaagaaagaaauucgagauauuaucauauuuuaccaaagaagacugaaaucacaaaaaggacuuauuggauucugugaauuugaaagucgucaaauagaaguagauaucgauggaaagaagaaaauaaaaacaguuggaaauagaguaauaaguagaucaucuccacuauuccaagaguucaaaaucuggcaaauauuaaauaauauagaaguuacagucguuggcaagaaacgaaaaagaagaaaacucaaagaaaacuauagugcacuuuucgaagaacuuaaugaugccgaacaacuugaacuaaacggaagcagaagacuaugucaagaagaaaaagaauuacucgcacaagaacuauucauacgagacaaaaugacgaaaagugaaguacuaaaauuauuauucgauaacccacaagaacuagaucuaaacuucaaaaccauagacggaaauaaaacuggguaugcgcuguuucaagcguauucuaaaaugauagaaaugucaggacaugaaccuguagauuuuaagaaacccgucgaaaaagugguugaauauaucaaggccguguucgacuuacuaaauuggaauacugacauauuaggauuuaacagcaacgaagaacuagacaaucagucguacuauaaacucuggcaucuauuauacagcuucgaaggagauaacacaccaacaggaaauggccgccucauccagaaaaugacagagcuauacggguucgaaaaagaguacgcaacaauucuagcgaacguuaguuuucaagaugauuacgguucucugucagcaaaagcaauacauaaaauauugccacaucuaaaagaaggaaaccgauaugacguagcaugcguuuacgccggauacaggcauucagaaaguucacuaacaagagaagaaauagccaauaaaguuuuaaaagacagauuaaugcuauuaccuaagaacucacuucauaauccaguuguggagaaaauauugaaucaaaugguaaacgucauuaauguaauuauagacauauacggcaaacccgaugaaauacgcgucgaauuagcaagggaacugaagaaaaacgcaaaagaaagggaagaauugaccaaaagcauugcccaaaccacaaaagcacaugaagaauacaaaacgcuauuacaaacugaguuuggacuaaccaacguuucgagaacggacauacuaagauacaaauuguauaaagaauuagaaaguugugguuauaaaacacuauacaguaacacuuacauaucaagagaaaaacuauucucaaaagaauuugauauagaacacauaauaccacaagcuagacuauucgaugacucauuuaguaauaaaacacuggaagcaagaaguguaaacauagagaaagggaauaaaacugcguacgacuucgugaaagaaaaauuuggagagagcggggcagacaauucucuugagcacuacuuaaacaauauagaagauuuauucaaaagcggaaaaauaucaaaaacaaaauauaacaaacuuaagauggcugaacaagauaucccugauggauucauugaaagagauuuaagaaauacgcaauacauagcaaagaaagcccuaucaauguuaaacgaaauaagccacagaguagucgcaacaaguggaucaguuacagauaaacuaagggaagauuggcaauuaauugacgugaugaaagaacucaacugggaaaaauauaaagccuuaggauuaguagaauacuucgaagaucgcgacgguagacaaauaggccgaauaaaagauuggaccaaaagaaaugaccaucgacaucacgcaauggacgcacuaaccguugcguucacaaaagacgucuucauacaauacuucaacaacaaaaacgcaagccuagacccuaacgcaaacgaacaugccauaaagaacaaauauuuucaaaacgguagagcgauagcacccaugccguuaagagaguuccgagcagaagcaaagaaacacuuggaaaacacucuaauaagcauaaaggccaaaaacaagguaauaacaggaaacauuaacaagacaaggaagaaaggaggcguaaacaaaaauaugcaacaaacccccaggggacaacuucaucucgaaacaauauauggcagugguaaacaauacuugacaaaagaagaaaaaguuaacgcauccuucgacaugcggaaaauagguacaguaagcaaauuagcauauagagacgcucuacugaaaagauuauacgagaaugacaacgauccaaagaaagcauucgcaggcaaaaacagcuuagacaaacaaccaauauggcuugauaaagagcaaaugagaaaaguaccagaaaaaguaaaaaucguaaccuuagaggcaauuuacacaauacguaaagaaauaucuccggaucucaaagucgauaaaguaauugacgugggaguaaggaaaauccugaucgauagacuaaacgaauacggaaacgacgcaaagaaggcauucucuaaccucgaugaaaacccuaucugguuaaauaaagaaaaaggaauuucaauaaaaagagugacaaucucuggaauaucaaacgcccaaucucuccauguuaaaaaggacaaagacggaaagccgauucucgaugagaaugguaggaauaucccaguagacuuuguaaauacugguaacaaccaucacguagcaguuuacuaccgcccaguaauagauaaacgaggacaauuaguaguagaugaagcaggaaauccaaaauaugaacuagaagaagucguaguaucauucuuugaagcagucacacgggccaaccuaggacaaccaauaauugacaaagacuauaaaacaaccgaaggauggcaauuucuauucagcaugaaacagaaugaauauuuugucuuccccaacgagaaaacgggcuucaaccccaaagaaaucgaccugcuggacgucgaaaauuacggccuuauaaguccaaaccuauucaggguacagaaauucucucucaagaauuacguauuccgacaccaucuagaaacuacaaucaaagauacaucuaguauauuacgcggaauaacauggauagauuuuagauccaguaaaggucucgauacgauagugaaagugagaguuaaccacauaggacagauuguaagugugggggaauacuga

SEQ ID NO: 5683 - RNA, 4311 nt, Artificial Sequence
  Cas9 variant
augaaaagaauacuugguuuagaccuagggacaaacaguauaggaugggcacucguaaacgaagcagagaauaaagacgaaagaagcucuauuguaaaacucgguguccgugucaacccacuaacuguagaugaauuaacaaacuucgaaaaaggaaagagcauaacaaccaaugcggaccguacacuaaaaagaggcaugcggagaaaccuacagagguauaaacuaagacgugagacauugacugaaguacuaaaagagcacaaauuaauuacagaagauacaauccucuccgaaaacggaaaucguacaacguucgaaacauaucgacuacgcgcaaaagcaguuacugaagaaauuagccucgaagaauuugcaagaguacuucuaaugauaaacaagaaaagagguuacaagucaucccgaaaagcaaagggaguagaagaaggaaccuuaauagacgguauggauauagcuagagaacuuuacaacaacaaccuuacuccaggugaacucugccuccaguuauuagaugcagggaagaaauuuuuaccggacuuuuacaggucagacuuacaaaaugaguuagauagaaucugggagaaacaaaaagaguauuauccagaaauuuuaacugacguacugaaagaggaacuuagaggaaagaaaagagaugcuguaugggcaauaugugcaaaauauuucguauggaaagaaaauuacacugaauggaauaaagaaaaaggaaaaacugaacaacaagagagggaacauaaacuugaaggaaucuauucuaaaagaaaaagagaugaagccaaaagagaaaauuugcaauggaggguuaacggccuaaaagaaaaacuaagccuagaacaacucgugauuguuuuucaagaaaugaacacacagauaaacaacuccucaggguaccuaggcgcuaucucagacagaaguaaagaacuuuauuuuaacaagcaaacaguaggacaauaccaaauggaaauguuagacaaaaacccuaacgcaucauuaaggaauaugguauuuuacagacaagauuaccuugacgaguucaauaugcuaugggaaaaacaagcaguuuaccauaaagaauuaacugaagaauuaaagaaagagauaagggacauaauaauuuucuaccaaagacguuugaaaucacaaaaaggacucauuggauucugugaauuugaaaguagacaaauagaaguagacauugacgguaaaaagaaaauaaaaacaguaggaaaccgaguaauaaguagaucaucacccuuauuucaagaguucaaaauuuggcaaauacucaacaacauagaaguaacaguaguuggaaagaaaaggaaacgccggaaacuuaaagaaaauuacagugcacuauuugaagaacuuaaugaugcagaacaacuugaacuaaauggaagcagaagauuaugucaagaagaaaaagaauuacuugcucaagaacuauuuauccgggacaaaaugaccaaaagcgaaguguuaaaauuacuguuugacaacccacaggaacuagacuuaaacuuuaaaacgauagaugguaacaaaacuggauacgcacuuuuccaagcguauucaaaaaugauagaaauguccggacacgaaccugucgacuuuaagaaaccaguagaaaaaguuguagaauacauuaaagcaguauucgaccuacuuaauuggaauacugauauacuuggcuucaauuccaaugaagaauuagacaaucaaccuuauuacaaauuguggcaucuauuauacaguuuugaaggugacaauacgcccacaggcaauggaagacugauacagaaaaugacagaacuuuacggauucgagaaagaauacgcaacaauauuagcaaauguuucauuccaagacgauuauggaucacucucagcuaaagcaauccauaaaauccuaccacaucuaaaagaagguaacagauaugauguagcaugcguauaugcaggauauagacacucggagucaucguuaacaagagaagaaauugcgaauaaaguuuugaaagacagacuaaugcuauuacccaaaaauucucuccauaauccgguugucgagaaaauacugaaccaaauggugaacguuauaaaugucauuaucgauauauauggaaaaccugacgaaauacgaguagaacuugcccgagaacugaagaaaaacgcaaaagaacgugaagaacuaacuaaaaguauugcccaaacaacaaaagcgcaugaagaauacaaaacucuauugcaaacagaguucggauugacuaauguauccagaaccgauauacuacgauauaaacuauauaaagaacucgagagcuguggauacaaaacacuauauaguaacacauacauaucccgagaaaaacucuuuuccaaagaguucgauaucgaacauaucauaccucaagcgagauuauuugaugauagcuuuucaaauaaaaccuuggaagcaagaucaguuaacauugagaaagggaauaagacagcauaugacuucguaaaagaaaaauuuggagaaucuggugcugauaacagccuagagcacuaucuaaauaauauagaagaucucuuuaaaucaggaaaaaucucaaaaaccaaauacaauaaacuaaagauggcagaacaagacauaccggacggauucauugaacgagaucuacgcaauacacaauacauugcuaagaaggcucuaagcauguuaaacgaaauaucacauaggguugucgccaccagugguucaguaacagauaaauuaagagaagacuggcaauuaauagauguuaugaaagaacuuaacugggagaaguacaaagcauuagggcuaguggaauauuuugaagaccgcgauggaagacaaauuggaaggauaaaagacuggacaaaacguaaugaccaccgccaucaugccauggaugcauuaacaguagcuuuuacuaaagacguauuuauacaauacuuuaacaauaaaaacgcaaguuuagauccaaacgcgaacgaacacgcaauuaaaaacaaauacuuucaaaauggacgcgccauagcaccaaugccacuccgugaguucagagcugaagcaaagaaacaucucgaaaacacccuaaucagcauaaaagccaaaaacaaaguuauaacaggcaauauuaacaaaacaagaaagaaaggaggcguuaauaaaaacaugcagcaaacaccaagaggacaacugcaccuggaaacuauuuaugguucaggaaaacaauacuuaacuaaagaagaaaaaguaaaugcauccuuugacaugagaaaaaucgggacggucagcaaaagugcuuaccgagaugcuuuacuaaaaagacuuuaugaaaaugauaaugacccaaagaaagcauucgcaggcaaaaauagucuagauaaacaaccaauaugguuagauaaagaacaaaugagaaaaguuccugaaaaaguaaaaauaguaacacuggaagcuaucuauacaauaagaaaagaaauaucaagcgauuuaaaaguagacaaagucauagaugucggaguacgaaaaauuuugauagauagauuaaaugaauauggaaacgaugcaaagaaagcguucucgaaucuagauaaaaacccaauaugguuaaacaaagagaaagguauuaguauaaaaagaguaaccauaucaggaaucuccaacgcacaaucuuuacauguaaagaaagacaaagacgguaaacccauacucgacgaaaacggacgaaauauaccuguagauuucgucaauacaggaaacaaccaucacguagcaguauacuauaggccaguaauugauaaaagaggacaacugguaguagaugaggcagguaacccgaaauaugaacuggaagaaguaguagucucguuuuucgaagcaguaacaagagccaaucuagggcuuccgaucauagauaaagacuacaagacgaccgaggguuggcaauucuuauuuucaaugaaacaaaaugaauacuuuguauuucccaacgagaaaacagguuuuaacccuaaagaaauugaucuuuuggauguggaaaacuacggucuuauuucgccaaaccuauuucguguacaaaaauucagccuuaaaaacuacguguuuagacaccaucuagaaacaacaauaaaggauacuucuucaauccuaaggggcauaaccuggauagauuuuagaaguucaaaaggcuuagauacuauaguaaaaguccgaguaaaccauauaggacaaauagugucagucggcgaauacuga

SEQ ID NO: 5684 - RNA, 4311 nt, Artificial Sequence
  Cas9 variant
augaaaagaauacuaggccucgacuuagggacgaacucaaucggaugggcucuaguuaacgaggcagaaaacaaagaugaacgaagcagcauagugaaacuaggaguaagaguaaauccuuuaacuguagaugagcuaacaaauuucgaaaaggguaaaucaauaacaaccaaugcagauagaacauuaaaaaggggaaugagacguaauuuacagagguauaaacucagacgcgaaacacuaacggaagucuuaaaggaacauaaauuaaucacagaagacacaauacugagcgaaaacggaaacagaacuacauucgagacauacaggcugagagcaaaagcuguaaccgaagaaauuucccucgaagaguucgcacgaguauugcuuaugauaaacaagaaaagaggauauaaaaguucuagaaaagcuaaaggugucgaagaagguacacuaauagaugguauggacaucgccagagaacuguacaacaauaacuuaacaccgggagaauuaugucuccaacuccuagaugcgggcaagaaauuucucccagacuuuuacagaucugacuuacaaaaugaacuggauaggauaugggaaaaacaaaaagaauauuacccggaaauucuaacugauguacuaaaagaagaacuaagaggaaagaaaagagacgcaguaugggccauaugugcaaaauacuucguuuggaaagaaaauuauacugaauggaacaaagaaaaaggaaaaaccgaacaacaggaacgagagcacaaauuagaaggaauauauaguaaaagaaaacgagaugaagcaaaacgugaaaauuuacaauggcgagugaauggacuaaaagagaaacuuucccuggaacagcuaguaauaguauuucaagaaaugaauacacaaaucaauaauucgaguggauaucuaggugccauuagcgauagaaguaaagaauuauacuucaacaaacaaacggugggacaaugccaaauggagaugcucgacaaaaauccaaaugcuaguuuacgaaauaugguguuuuauaggcaggauuauuuagaugaguucaacauguuaugggaaaaacaagcaguuuaucauaaagaacuaacagaagaauuaaagaaagaaauacgugacaucauaauauuuuaccaaagaaggcuaaaaucccaaaaaggucuaauaggcuuuugcgaguucgaaagucggcaaauagaaguagauauugacggaaagaagaaaauaaaaaccguaggaaauagaguaauaaguaggucaucaccacuauuucaagaauuuaaaauuuggcaaauauuaaacaacauagaaguuacuguggugggaaagaaacgaaaaagaagaaaacugaaagaaaacuauucugcacuauucgaagaacucaaugacgcagaacaacuugaacuuaauggaucaagaagacuuugucaagaagaaaaagaacuccuugcacaagaauuauuuauacgagacaagaugacaaaaagcgagguuuuaaaauuacuauuugauaacccucaggagcuggacuugaacuucaaaacaauugacggaaauaaaacaggauaugcacuuuuucaggcuuauucaaagaugauugaaaugucuggacacgaaccaguagauuucaagaaaccuguugaaaaaguuguagaguauauaaaagcaguauuugacuuacuaaacuggaauacggauauccuaggauucaauagcaaugaagaacuggacaaucaaccauauuauaaguuauggcacuuacuauacaguuucgaaggagacaacacaccaacuggcaauggaagguugauucagaaaaugacggaacuauacgguuuugaaaaagaauacgcuacuauacucgcuaauguaaguuuucaagacgacuacggcagcuugucagcuaaggcuauacauaaaauauuaccccauuuaaaagaaggaaacagguaugauguagcuuguguuuaugcuggauauagacauagugaaagcucgcuaaccagagaagaaauagcaaacaaagugcuaaaagacagacucaugcuccuaccuaaaaauucccuacacaauccaguaguggagaaaauacuaaaucaaauggucaauguuauaaauguaauaauagacauauacggaaaacccgaugaaauaagagucgaacuagcaagagaacuaaagaaaaacgcgaaagaaagagaagaauuaacaaaaaguaucgcgcaaaccacaaaagcacacgaagaauauaaaacacuacugcaaacagaguucggacugaccaacguuucgcgaacagacauucuaagguacaaauuauauaaagaacucgaaucaugcggcuacaaaacacuauacucgaauacauacauaucacgugaaaaacuauuuucaaaagaguucgacauagaacauauaauuccccaagccagauuauucgacgauaguuucuccaacaagaccuuggaagcaagaagcguaaacauagaaaagggaaauaaaacagcauaugacuucguaaaggaaaaauucggcgaaucuggagccgauaauucucuagaacauuaccucaauaauauagaagauuuauuuaaaaguggaaaaauaucgaagacuaaauacaacaaacugaaaauggcagaacaagauaucccugacggauucauagaacgagauuuaagaaacacgcaauacauugccaagaaggcucuaaguaugcuaaaugagauuagucaccguguaguugcaacuucuggaucuguaaccgacaaacuaagagaagauuggcagcuaaucgaugugaugaaagaauuaaacugggaaaaauacaaggcgcucggucuaguagaauacuucgaagaccgggacggaaggcaaaucggacgaauaaaagacuggacaaaaagaaacgaccacagacaucaugcuauggaugcuuuaacaguggccuucacaaaagacguauuuauucaauacuucaauaacaaaaaugccagccuagacccaaaugcgaaugaacaugcaaucaaaaauaaguauuuucaaaacggcagagcuauagcaccuaugccacugcgagaguucagagcagaagcuaagaaacauuuagaaaauacucugauaagcaucaaagcgaaaaacaaaguaauaaccggaaauauaaacaaaacacgaaagaaaggaggaguaaauaaaaacaugcaacaaacaccgagaggacaguuacacuuagaaacaauauauggaagcggaaaacaauacuuaaccaaagaagagaaagucaaugcaaguuucgacaugagaaaaauaggaacaguaagcaaaucagcauaccgggaugcacuucucaaaagauuauaugaaaacgauaaugauccaaagaaagcauucgccgggaaaaacucguuagacaaacaaccuauaugguuagacaaagaacaaaugagaaaaguaccagagaaaguaaaaaucguaacuuuggaagcuauauauacgaucaggaaagaaauuucacccgauuuaaaaguagacaaaguaauagacguagggguaagaaaaauauuaauagaucgguuaaacgaauacggaaaugacgcaaagaaagcauuuucaaaucuagacaaaaacccaauauggcuaaauaaagaaaaaggaauaucgauuaaacgcgucacgaucaguggaaucucgaaugcacaaagucugcacgugaagaaagauaaagauggaaaacccauacucgaugaaaacggaagaaauauacccguagacuuugucaauaccggaaacaaccaucauguugcagucuacuacagaccugugauagacaaacgaggacaauuaguaguagaugaggcaggaaauccaaaauacgaauuagaagaagugguagucucauuuuucgaagcgguaacaagagcuaauuuaggacuuccgauuauagauaaagauuacaaaacaacagaaggauggcaauucuuauucuccaugaaacagaacgaguacuucguuuuuccaaaugagaaaacgggauuuaauccaaaagaaauagaucugcucgauguugaaaauuacggccucaucuccccaaacuuguuuagaguucaaaaauucucauugaaaaauuacguguuccggcaccaccuugaaacaacaauaaaagauacgucgucaauacucagaggaauaacuuggauugacuucagaagcucaaaaggauuagacacuauagugaaaguacgaguaaaucacauaggucaaauaguaucaguaggcgaauauuga

SEQ ID NO: 5685 - RNA, 4311 nt, Artificial Sequence
  Cas9 variant
augaaaaggauauuaggccuagacuuaggcacuaauucaauaggcugggcccuaguaaacgaagcagaaaacaaagaugagagaaguucaauuguaaaacuugguguuaggguuaacccacuaaccguagaugaguuaacaaacuucgaaaaaggcaaaucaauaaccacaaaugcagaccguacacuaaaaagaggaaugcguagaaauuugcaaagguacaaacuaagaagggagacacuaacugaaguauugaaagaacacaaacuaaucaccgaagacaccauacuuuccgaaaauggcaaccgaaccacauuugaaacguaucgauuaagggcaaaagcaguuaccgaagaaauaucccuugaggaauuugcacgagugcucuuaaugaucaacaagaaaagggguuacaaauccagcagaaaagcuaaaggaguugaagaaggaacauuaauagaugguauggauaucgcuagagaauuauauaacaacaaucuaacaccaggagaacuaugcuuacaacuacuagacgcagguaagaaauuucuucccgauuucuauagaagcgaccugcaaaacgaacuagaucggauuugggaaaaacaaaaagaauauuauccagaaauauugacagaugucuuaaaagaagaacuaagaggaaagaaaagagaugcugugugggcaaucugugcaaaauacuucguauggaaagaaaccuauaccgaauggaacaaagagaaaggcaaaaccgaacaacaagagcgggaacacaaauuagaaggaauauacagcaaaagaaaaagggaugaggcgaaaagagaaaaucuacaauggagaguaaaugggcuaaaagaaaaacucagucuugaacagcuaguaauaguauuucaagagaugaacacgcaaauuaauaauucaucaggauaccucggagcgaucucagacaggucaaaagaacuauacuuuaauaaacaaacaguaggccaauaccagauggaaaugcuugauaaaaacccuaaugcaucccuccggaacaugguuuucuauagacaagacuacuuagaugaauuuaauaugcugugggaaaaacaagcagucuaccauaaagaacuaacugaggaacugaagaaagagaucagagauauuauaauuuucuaccaacguagacucaaaagccaaaaaggauuaauaggauuuugcgaguucgaaagucgacagauugaaguagacauagaugguaagaagaagauaaaaacaguaggaaauaggguaauaucgcgaucaucuccacuauuucaagaguucaaaauuuggcaaauuuuaaauaacauagaaguaaccguuguaggaaagaaaagaaaacgaagaaaacuuaaagaaaauuacucagcuaucuuugaagaacuaaaugaugcagaacaauuagaacuaaaugguucacggcgguuaugccaggaagaaaaagaacuacucgcgcaagaauuauucguuagagacaagaugacaaagagugaaguucuaaaguuacucuucgauaauccacaggaacuugaccuaaacuucaaaacuauugacggaaacaaaacaggauacgcacuauuccaagcauacucaaagaugauugaaaugucuggacaugaaccaguagacuuuaagaaacccguugaaaaaguuguggaauauauaaaagcaguuuuugaucuauugaacuggaauacagauauauuagguuuuaauucaaacgaagaacuugacaaccaaucguacuacaaacuuuggcaucugcuauacagcuucgaaggggauaauacgcccacaggaaaugguagacuaauccagaaaaugaccgaauuguauggauucgaaaaagaauaugcaacaauccuggcaaacguuagcuuccaggaugacuacggaaguuuaucagccaaagcuauccacaaaauacuaccacaccuaaaagaaggaaacagauacgauguugcuugugucuaugcuggauauagacauucagaaaguucccuuacaagggaagaaauugccaauaaaguauuaaaggacagacuaauguuacuacccaaaaacagccugcauaauccgguaguugaaaagauacucaaccaaaugguaaacguaaucaauguuauaauagauauauacggaaaaccugaugaaauuagaguagaauuagcgcgagaacugaagaaaaaugcaaaagaaagagaagaguugacaaaaucgauagcacaaacgacaaaggcaaacgaagaauacaaaacccuauuacaaacagaauuuggauugaccaauguaaguagaacugauauuuuacgauauaaguuauauaaagaauuggaaagcugugguuauaaaacacuauauagcaauacauacauuucacgagaaaaacuauuuaguaaagaguucgauauagaacauauaauaccgcaagcuagacuauuugaugauucuuucaguaacaaaacauuagaagcucgcucaguaaauauagaaaaaggaaauaaaaccgcauacgauuucgucaaagaaaaauuuggagaauccggcgccgauaacaguuuagagcacuaccuuaacaacauugaagaccuauucaaaucaggaaaaauaucgaaaacaaaauacaacaaguuaaaaauggcagagcaagauauaccagacggauuuaucgaacgagauuuacgaaacacacaauauauagccaaaaaggcacuaucaaugcucaaugaaauaagucaucgaguaguugcaacaucaggaaguguaacagauaaguuaagagaagauuggcaacuaauagauguaaugaaagaauuaaauugggaaaaauacaaagcacucgggcucguagaauacuucgaagacagggacggacgccaaauaggcagaaucaaagauuggacgaaaagaaaugaccaccgacaccacgccauggacgcucuaaccguggccuucacaaaagauguuuuuauucaauauuucaauaacaaaaaugcaagccuugacccaaacgcaaacgagcacgcgaucaaaaacaaauacuuccaaaacgguagagcaaucgcgccaaugccacuacgagaguuccgagcugaagcuaagaaacaucuagaaaacacucuaauaaguauaaaagccaaaaauaaagucauaacuggaaacauaaacaaaacaagaaagaaaggaggaguaaacaaaaacaugcaacaaaccccacgaggacaauuacauuuagaaacuauauauggaaguggaaaacaauaccuaacgaaagaagaaaaagucaacgccagcuuugauaugagaaaaauagaaacaguaaguaaaucagcauauagagacgcacucuugaaaagacuauaugaaaaugauaaugauccaaagaaagcauuugcggggaaaaacucacuagauaaacagccaauauggcuagauaaagagcagaugagaaaagucccugaaaaaguaaaaauagugacauuagaagccauauauacaauaagaaaagaaauaagccccgacuuaaaaguagacaaaguuauagauguagguguccgaaaaauccuaauagacagauugaaugaauacggaaacgacgcaaagaaagccuucaguaaucuugauaaaaacccaauauggcuaaauaaagaaaaaggcauaucaaucaaacgaguaacuauuucaggcauaagcaaugcacaaaguuuacacguaaagaaagacaaagauggaaaaccgauauuagaugaaaacggaagaaauauaccgguugauuucguaaacacaggaaauaaucaccacguugcaguguacuaucgaccaguuauagauaaacgaggccagcuagucgucgacgaagcggguaacccuaaauacgaauuagaggaaguaguuguaucauucuuugaagcaguaacacgagcaaaucuaggauuaccgaucaucgauaaagacuauaaaacaacugagggcuggcaauuucuguuuaguaugaaacaaaacgaauauuucgucuucccaaaugagaaaaucggcuuuaacccaaaagaaauagaucuacucgauguugaaaacuacggauuaaucucgccgaauuuauucagaguacaaaaauuuaguuuaaagaacuauguauuucgccaucaccuagaaacgacaauuaaagacacaucaucaauucuaagaggaauaacauggauugacuuccgaucaucgaaaggucucgauacaauaguaaaagugagggugaaucacauaggccaaaucguaagugucggcgaauauuga

SEQ ID NO: 5686 - RNA, 4311 nt, Artificial Sequence
  Cas9 variant
augaaaaggauauuaggacuagacuuaggcacuaauucaauuggcugggcauuggucgaugaagcagaaaauaaagacgaacgaaguaguauaguaaaacuaggaguuagaguaaauccacucacaguagacgaacuaacaaauuucgagaaaggaaaaaguauaacaacgaacgccgacagaacauuaaagagaggaaugagacgaaaccuucaacgauacaaacucagaagagaaacacuaauggaaguacucaaggaacacaaauuaauuacggaagacacuauucuguccgaaaaugguaaccgaacgacauuugagacuuauagacuaagagcaaaagccgcaacugaaaagauaucacucgaagaauuugccaggguacuacugaugauaaauaagaaaagaggguacaaaaguuguagaaaagccaagggugcagaagaaggcacauuaauugacggaauggacauugccagagaacuguauaacaauaacuuaacuccaggagaacuaugucuucaacuauuagaugcagguaaaaaguauuuaccagauuuuuaucgaagugaccugcaaaaugaacuagaccgaauuugggaaaaacaaaaggaauacuacccugagauauugaccgaaguacuaaaggaagaacuacgcgguaagaaaagagaugcagugugggcaauaugcgcaaaaucauucguuugggaagaauacuauaccgaauggaauaaagaaaaaggaaaaaccgaacaacaagaaagagaacauaaauuagaaggaauuuacagcaaacgcaaacgugacgaagcuaaacgcgaaaauuuacaauggagaguuaacggccuaaaagaaaaacucucuuuagaacaauuaguaauaguauuacaagaaaugaauauacagauaaacaacucuagcggauauuugggugccauaucugauagaucgaaagaauuauacuucaacaaacaaacuguaggacaauaucaaauggagauguuagacaaaaacccuaacgcaucauuaagaaauauggucuuuuaccgacaagacuacuuagacgaauuuaacacccuuugggaaaaacaagcagaauaccacaaagaauugacuggagaacuaaagaaagaaauuagagacauagucauauucuaccaaagaagacuaaaaucacaaaaaggguuaguaggguuuugcgaguuugaaucuagacaaauagaaguagagauagauggaaagaagaaaauaaaaacaguagggaaucgcguaauaccucgcucaaguccauuauuucaagaguucaaaauauggcaaauauuaaacaacauagaaguaaccgucguaggaaagaaaggaaaacgccguaaacaaaaagacaauucaccaacacuguuugauggguuagaugauacugaacaacuugaauugaacggauccagauaucuguaccaagaagagaaagaauuacucgcccaagaacuauucguaagagacaaaaugaccaaaagugacguuuuaaaacuacuauuugacaacccacaggaauuagacuuaaacuucaaaacaauagacgguaauaaaacaggcuacacacuauuucaagcauauucaaaaaugaucgagauguccggccaugaaccgguugacuuuaagaaaacaguagaaaaaguuguagaacauguaaaagccguauucgauuuacuuaauuggaacacggacauucuaggcuuuaacucuaacgaagaacuagacaaucagagcuacuacaaauuauggcaucuacuauacaguuucgaaggagacaacacgccuacaggaaaugcgcgccucguccagaaaauaacggaauuauacggauuugagaaagaauaugcgaucaucuuagcaaauguaacuuuucaagaugauuauggaucguugucugcuaaagccauucacaaaauauuaccacaucuaaaagaaggaaacagauacgacguagcaugcgcuuacgcaggauacaaacacagcgaaaguucauuaacaaaagaagaaauugcuaacaaagcacuaaaagaucgauuaacccuauuaccuaaaaacaaccuuagaaacccaguaguagaaaagauacuaaaucaaauggugaacguaauuaacgcuauaauagacacuuauggaaaaccagacgaaauacggguggaacucgcaagagaacuaaagaaaaacgcaaaagaaagagaagaacugacaaaauucauagcugagacaacacgaaaacaugaggaguucaaaauacuucuacaaagugaauuuggauuaacgaacguuucacgaacagacauucuuagauacaaacucuauaaagaacuugaaucuugugguuauaaaacauuauacagcaauacuuacauaccaagagagaaauuauucuccaaagaguucgacauugaacacaucauaccacaagcaagacuauucgaugacagcuucucaaacaaaacucuugaagcaagaucaaucaacuuggaaaaaggaaacaaaacggcauacgauuucguaaaagaaaaauucggagaaucuggcgcagacaauagcuuagaccauuaccucaauaacauagaagauuuauucaaaagugggaaaaucucgaaaacaaaauacaacaaauuaaaaauggcagaacaagacauaccagacggauuuauaaauagagacuuacggaacacacaauauauagccaagaaagcauuaucaauguuaaacgaaauaucaagacgaguaguagcaacaaguggaacaauuacagauaaacuucgacaagauuggcaauugguugauguaaugaaagaauugaacugggaaaaauauaaagcauugggccucguugaauacuuugaggauaaggauggaaggcaaauuggaaggauaaaagauuggacaaaacgaaacgaucaccgccaucacgcgauggacgcacugacagucgcauucacaaaagacauauuuauacaauacuuuaauaacaaaaaugcgucucucaacucuaacacgaacgaauaugcaaucaaaaauaaauacuuccaaaauggcagagcaauagcacccauaccauuaagagaguucagaguggaagcgaagaaacacuuagaaaacacucuaauaagcauaaaagcuaaaaacaaaguaguaacagggaacauaaacaaaacgaagaaacgaggaggagucaacaaauaccugcaacaaacaccgagaggucaacuacaucuggaaacuauauacggaucuggaaaacaauaucuaacaaaagaagaaaaagucaaugcauccuucgauaugaagaaaauagcaacaguuaguaaaucagcauaucgugacguacuacuuaaacgacuacaugagaaugauaaugauccaaagaaagcguucacuggcaaaaauucauuagauaaacaaccaauauggcuagacaaagagcaaacaagaaaaguaccggaaaaaguaaagaccguaacucuagaaacaauauacacaguacgcaaagaaaucucaccagacuuaaaaguagauaaaguaauugaugcaggaguaagaaaaauauuaacagggcgauuaaacgaguauggcaaugacgcaaagaaagcauuuucaaacuuggacgaaaacccgauaugguuaaacaaagagaaaggaauuagcauaaaaagaguaacuaucaguggaauauccaaugcucaaucucuacacgucaagaaagauaaagacggcaaacccaucuuagacgaagacagucgcaacauaccaguugacuuuguaaacacaggaaacaaccaccacguugcaguauauagacgaccaguaauagauaaacguggucagcuaguaauugaugaggcagggaacccuaaauaugaauuagaagaagugguaguaucauucuuugaagcaguaacaagggcgaaucuagggcaaccaauaauugacaaagauuauaaaacgucggaagguuggcaauuucuauucucuaugaaacagaaugaguacuucgucuuccccaacgagaaaacuggauucaaucccaaagaaauugaucuacucgaugcagaaaacuacggagucaucucaccaaacuuauuuagaguacaaaaauuugcucauaagaauuacguauuuagacaccauuuagaaacgaccauaaaagacacaucaaguauccucaaaggaauaacauggauagacuuuagauccucuaaaggucucgacgcaauaguaaaaguaaggguaaaucacauaggacaaauaguauccguaggggaauacuga

SEQ ID NO: 5687 - RNA, 4311 nt, Artificial Sequence
  Cas9 variant
augaaauauauaaaauacauauuaggguuagauauugggagcaauucaauaggaugggcacuuauucaauuagacuuacuccagaaaacaaaaagaauaauagcagcggguagcagaauaauacccauggaucaaaaaguacuuucagauuuuggaaaagguauaacaauaucaccaacagcccaacgaacgucauaucgcaacgcacgacacuguagagaacgacaccuucuaagaagagaaagauugcacagaguuuugcacauacugggcuuucuucccacucacuaugacaaacaaauugacuucuccaaaagauacggaaaauuuguagauaacacugaaccaaaaauagccuauaacgaagguaaauuucuauuuauggacagcuuucaagaaaugcuauccgauuucaaaagucaucaaccagaccuauuuuauaccaagaaaaacggagaagaaagcaaaauaccauaugauuggacaauuuacuaccuaagaaagaaagcacuaucacagaaaauauccaaagaagaauuagcauggauuauuuugaauuuuaaucaaaaacgagguuacuaccaauugagggaagaagaagguaacaaagaaaacgacuucgaaauaauuagcagcaaaauaauuucaguuaucaagaaagauaaagacaagaaauauaauaaauauugguacgacauuauucuagaaaacggccugguauaccaagcagcauucuauaacgacuucgucuauaauuggaucaaccaagaccgagaguucaucauagaacgaacaucacuaaagaacggugccgaaaaaguaaaauuaagcuauuuacccacauucgaugaaaucgauaaaauggacaagaaagaacaagauaaauacuacaagaaaauuaaaauaaaaacagagaacucaauagguaacaaaacaguagguuguuacauuuacgaccacauccuacaaaaccccaaugagaaaauaaaagguaaacugguaagaacuauagaaagaaaauauuauaaagaagaacucaaagcaauacucgaaaaacaaaucgcuuuacaacccgaauuauucacagaccaauuacuagcagacugcauucgagaauuguauaguaaaaaugaagcgcaacaaagaaacuuagcagcgcgagacuuuguccacuuacucguagaagacauaauuuucuaucaaagacccuuacggcgacagaaaagcacucuagcaaacugcucucuagaaucacgaaguuauauagacaaagacagucacaccagaaaagaagcaccauuaaaagucuguccaaaaaguaauccuuacuaccaagaauuucgaguccuacaaugguugcaaaacuuaaaaauauaugaaauagauagcgaucaagaaguaacacaccaauuuaucaaaacgcuagaagacaaacaacaauuauucgaauuuuuaauggcccaaaaagaaauagacugugaggaacuauuaaaauauuuccucaaccaaacauauccaaaugcaaaagaaaaagcacugaaaucagaacuaaagaaauggaaagacaccuacagauggaauuacguauacgacauaggcgaaaaaucaucaaagaaauaccccaugaaugaaacgcgguacgaacuaaaaagacaccuagaaaaaguugcaaauuugccagacgauuuucuuucaucagaaguugaauaucuucuauggcaccugauauacucuguaaaagauaaagucgcguacgagaaaggacuaaagaaauucgcgcaaaaacaccaucuagacaaagacuccuucguggagagcuuuaagaaauuuaacccauacccaucagaauaugggucauuuuccgaaaaagcaauaaggaaacuacucccccugaugcgcuuuggagcucauugggacuucaaccacauagauaagaacacccaaaaacgaauagaggauuuaauaacuggcgucgaaaacgaagaaauaagaacuauucucagagaaaaagcugaaaaauaccaauuagaaaaagaaacugauuuccaagaccuuccgcuauggcuagcccaauauauuguuuauaacagacacgccgaagcaucaucacucgaaaaauggacaucuguaaaugacuuagaaacauacuugaacgaauuuaaacaacacucauuaagaaauccaaucguagagcaaguaguaauggaaacgcuaagaguuguuagagacauauggcaacaauauggacaaggccaagcauccuucuuuaaugaaauccauauugaguuaggaagagaauuaaagaaaacagcaaaagaacgagaaaaauugaguaaacaaaaucagaaaaaugaagauauaaaucuaucgauaaaagaaaaauuaaaagaauuagaaaaguacaacacaagggccuacucaaucacacaccaagaaaaauacaaauuauggcuagagcaaaaacacauuucaccguacacgggacaaaucaucucacccgaaaaucuauucacagacaauuacgaaaucgaacauauuauuccgcaaagccgauucuucgaugauucauuaucaaacaaagucguaugcgaaaguauaguuaauaaagcuccauauaaagaucgacaacuuggcuuagaauuuauaaagaaccaaggaggccgaauaguuaaagaacuaucaaaagaaaacaaaacaauaaaaauauucacagaagaacaauacagaacauucauaaaagagcauuacucaaacaauccagaaaagaccaagaaauuacuauuagaagaaaucccugagaaaaugguagcacgucagaugaaugauacauguuauauaagcaaguucauuagugaaauauuaucgaaaauaguaagauccgacgaacaagaugagggaguccauagcaaaaaugucauauuauguacaggaaaaaucacuuccauacucaggcaagacuggggccuuaaugauauuugggacaaccucaucuuaccgagauuugaacgaaugaauaaucuauuacagaaagaaaaauucacuaucuacucaauagaaaaacagaagaaaauaccaguuguaccaaucaaugaucaauuuaaaaguuuccagaagaaacgcauugaucauagacaccaugcaauggacgccaucauaauagcauguacaacaagagaacacauuaacuauauaaauaaucagcaugcuuuggaaaaagaaaaagauaagaaagagaaacaagaagaaagagauaaacuaagagaaaaguuauguaucaagaaauauaauaaccgcucagaagguaauuacuccuggauauuuaagaaacccugggauacauuuacacaggaagugagagucgcacuagaagauauuguagucucauucaaacaaaauuuacgaguaauuaacaaagcaaccaacuacuaugaacgauggguagaagaaaaugggaaauacaucaagaaaaugguaaaacaagaaggcacuaauugggcuauacgaaaaccacuacaugaagaaacaauaucaggcaaaauuuaucuagaucgugaaaagaucaccaaaaacgacauacucacagccacgagaaaaacggucgacaguucauucgacgauaagagaaucaagaaaauaacugauacagguauacagaaaauccucuuaaauuaucuuaaguacaaaggcagucccgaaauugcuuucagcccagagggauuagaggaacuaaacaaaaaccuaucgauauacaacgauggaaagccacauaaaccaauauauaaaguaagaauuuaugaaaaaggaucuggaagauuugcauugggugaaaaaggccgaaaauauaaaaaguacguacaaggugcaagcaacuuauacuucggaauauaccaaggagcaaagaggagcuucgcaacgaucccauugaaugaaguaauagaaagacaaaagcaaggcuugccuaguguucccgaauacaacgaaaaaggggaucuacuacuuuucucccuaagcccuaaugaucuagucuacguaccaauagaaggagaaauuaucgaaaacauugauuucagaaauuuauccaaggaacaaaaagaacgaauauacaacgucaaugacuucaguucuacaugcuauuuuacuccaaaccgaauagcuaaagcaauuuucccuaaagaagucgacuuacaaagaaaaggagauaaacuaucagguaguuacgauacaaagaccgcgucauuagaaggaauacaaaucaaagaaguaugcauaaaacuaaagguagauagacucgguaacauaucaaaagcauga

SEQ ID NO: 5688 - RNA, 4314 nt, Artificial Sequence
  Cas9 variant
augaaauacauaaaauacauucuuggacucgauauaggaagcaacucgauaggaugggcauuaauacagcuagacuuguuacaaaagacaaagagaauaauagccacagggucgaggauaauacccauggaucagaaaguauuaucagauuucgggaaagggauaacuauaaguccaacugcacaacgaaccaguuacagaaacgcaagacauugccgugagcgacaccuauuacgacgcgaacgucuucacagaguacugcacauacuuggauuuuugccaacacacuacgacaaacagauagacuucucaaaacgauacgguaaauuuguagacaauacagaaccaaaaaucgcauauaaugaacgaaaauuccucuuuauggauagcuuccaggaaaugcucgcugauuuuaaaauacaccaaccugaucuauucuacaccaagaaaaauggagaggaaucaaaaauaccguaugauuggacuauauacuauuuaaggaagaaagcccucucaagaaaaaucagcaaagaagaacuagcauggaucauacuaaauuucaaucagaaaagagguuauuaucaacuaagagaggaagaagaagaaaauaaagagaaugacuuugaaauaauuagcagcaaaauaaucagugucaucaagaaagauaaagauaagaaauacaauaaauauugguaugacauaauacuagaaaacggccuagucuaccaagccgcauuuuauaacgacuuuguauacaauuggauaaaucaagaccgggaguucauaauagaaagaauaucauugaaaaauggaacggaaaaagugaaacuauccuacuuaccgacauucgaugaaauagacaaaauggacaagaaagaacaagauaaauacuacaagaaaauaaaaauaaaaacagaaaauaguauuggaaacaaaaccgucgguugcuauauuuaugaucacauacugcaaaaucccaaugagaaaaucaaaggaaaauuaguacgaacuauagaaagaaaauacuacaaagaagaauuaaaagcaauacuggaaaaacaaguagcauuacaacccgaacuauucacagaccaauuauuugcagacugcauaagagaacuauacagcaaaaaugaagcacaacaaagaaauuuagcagcacgagacuuugugcaucucuuuguugaagauaucauuuucuaccaacgcucguugcgaagacaaaaaucuacauuagcaaauugcuccuuagaaagccgaagcuauauagauaaagacagccacacccguaaagaagcuccccuaaaaguaugcccuaaaagcaaccccuauuaccaggaguuccgaguauuacaauggcuccagaauuuaaaaauuuaugaaauagacaccgaucaagaaguaacacaugaguucauaaaaacgcuugaagauaaacaacaauuuuucgauuucuuaaugaaccaaaaagaaauagauugcgaagaauuacucaaauacuuccuaaaccaaacauacccaaaugccagagaaaaagcccuaaaaagcgaacugaagaaauggaaagacacauaccgcuggaauuaugucuaugacaucggagaaaaaucauccaagaaauauccuaugaaugaaacacgcuacgaauugaaacgacaucucgaaaaaguagcuaaucuacccgaugacuucuuaucaucagaaguagaauauuuauuguggcauuuaauauacaguguaaaagauaaaguagcauacgagaaagguuuaaaaaccuuugcgcaaaaacaccaccuggacaaagauucauuuguggagagcuucaaaaaguuuaaaccuuacccaucagaauacggauccuuuucagaaaaagcgauaaggaaguuauuaccacuuaugagauucggaucauauugggauuucaaucacauagauaaaaacacucagaaaagaauugaagacuuaaucaccggcgucgaaaacgaagaaaucagaacaauacuacgagaaaaagcagaaaaguaccaguuggaaaaagaaacagacuuucaagaucuaccauuauggcuugcgcaauacauaguauacaauagacaugccgaagcaagcagccuagaaaaauggacgucaguuaacgacuuagaaacuuaccugaacgaguucaaacaauacagccuuagaaaucccauaguggaacaaguagucauggagacacuaagagucguccgagacauauggcaacaauacggccagggacaagccucguucuuugaugaaauacauauagaauuagguagagaacucaagaaaacugccaaagagagagaaaaacuuaguaaacaaaaccagaaaaacgaagauauaaaccugucaauuaaagaaaaacugaaagaauuagagaaauauaacaccagagcauacagcauaacacaccaagaaaaauauaaacucuggcucgaacaaaaacauauaucacccuacacaggacaaauaaucagucccgagaacuuauucacagacaacuacgaaaucgaacacauaauaccacaaucgcgauucuuugacgacucgcuaucaaauaaagucguaugugaaucaauaguaaacaaagcaccauacaaagacagacaauuaggacuagaguuuaucaaaaaucaaggcgguagaauugucaaggaacuaucuaccgaaaacaaaaccaucaaaauauuuacagaggaacaauauaggacauucaucaaggaacacuacucuaacaacccagagaaaacuaagaaacuuuuacuagaagaaaucccagagaaaaugguagcacggcaaaugaaugauaccugcuacauuagcaaauuuauaagugaaaucuuauccaaaauuguaagaucggacgaacaagaugaaggagugcauagcaaaaacguaauucuauguacaggaaaaaucacaagugcuuuaaaacaagauuggggaguaaacgacguauggaaugaucuaauacuaccucgguuugaacgaaugaaugaucuaacacaaucgaccuuauuuacaacauauaaugaaaaauaucaaaaauauuuaccaacuguccccauggaauacaguaacggcuuccaaaagaaaagaauagaucacagacaucacgcaauggacgcuaucauaauagcuugcgcaacacgugaacauauaaauuacauaaauaaccagcaugcccucgaaaaaggaaaagauaagaaagaaaaacaaaaagaacaugauaaauuaagggaaaaauugugcauaaagaaagauaacaaaggcagugaagaaaauuacucuuggaucuucaagaaaccaugggauacauuuacacaagaaguacaggcagcacuugaaggaauagucguaucauucaaacaaaauuuaagaguuaucaauaaagcaacuaacuauuacgaaagguggguagaagaaaauggaaaauauauuaagaaaauggucaaacaagaagggaccaacugggccauacgcaaaccgcuacacgaagaaacuauaucaggaaaaauauauuuggacagagaagaaauaaccaaaaaugauauccuuacagcaacgcguaaaaccguagauuccuccuucgacgaaaaacgaauaaagaaaauaaccgacaccgguauucagaaaauucuccucaauuaccucaaauauaaagggucaccagaaauagccuucaguccagaaggacuggaggaacuuaauaaaaaccugagcaucuauaacgacggaaaaccacauaaaccaauauacaaaguccgaauauaugaaaaaggaucaggaagauuugcucuuggagaaaaaggacgaaaauacaagaaauacguacaaggagcaccaaacuuauacuucggaauauaccaaggugcaaacaaaagaucauucgcgacuauaccacuaaacgaaguaauugaacgacaaaaacaaggccggccauccaucccggaauauaaugaaaaaggugauccccuauuauucucucucagcccaaaugaccuaguauacgugccaguagaaggcgaaauaauagaagacauagacuuucaaaauuuaucaaaagaacagaaagaaagaauauauaauguaaacgauuucucaagcacaugcuacuuuacaccaaaucgaauagcgaaggcaauauuccccaaggaaguagacuuacaaaggaaaggugauaaacuuccagguuccuacgauacaaaaaccgcuucacuagaaggaauccaaauaaaagaggucugcauaaaacuaaaaaucgauagauuaggaaauauaagcaaagccuga

SEQ ID NO: 5689 - RNA, 4317 nt, Artificial Sequence
  Cas9 variant
augaaaacuauuuuaggccuagaucuggguacaaacuccauagguugggcacugauuaaacaaaacuucgaaaauaaauacggcgaaauauuaggaaugggauccagaaucauucccaugucgcaagacauauuaggagaguucggaaaaggaaauucuguuucgcaaacugcggcccguacugauuacagagcuacaagaagguuaagagaacguuuucugcugcgaagagaacgauuacauaggguacucaauguuuuaaauuuccuuccagaacauuacgcuucucaaauagacuuugacaaacgguucggaaaauuuaaaguagaaacagaaccaaaacuugccuggaaaaacauugauggaaaauucucauucuuguuccaaacaaguuuuaacgaaaugcucgaagacuucaaagcacacggccaagaucuaaaaguaccauaugacuggacaauauauuaccuuaggaagaaagccuuaagucagaaaauagaaaaagaagaacuuguauggauacuacuaaauuuuaaccaaaaacguggauacuaccaacuaagaggugaagaagaagaagaaaacccaaauaaacuaaucgaauuuuauagucuaaaaauaauugacguacuagccgaugaaccccaaaaagggaaaucagacauaugguacucccugguacucgaaaacggauggauuuacagaagaucgucaaaaacaagucuacucgacuggaaagauaaaauuagagacuucaucguaaccaccgaccuaaacgaugauggaucaguuaaaacggacaaagaaggaaaugagaaaagaucauuuagagcuccaggagaaaacgacuggaccuuaguaaaaacaaaaacugaacaagaaaucgaccgaagucggaaaacagucggaaauuacaucuaugaaacacuccuacaaaaccccaaacagaaaaucaaaggaaaauuagugagaacuauagaacgcaaauuuuauaaagaagaacuaaaacguauucuagaaaaacaaaaagaauuucauagagaacuggaaucaaaugaccuauacaacgauuguauccgcgaacuauauaggaauaaugaagcacaucaauuaacauuaagcaagaaagacuucguccaucuguucauggaagauauaaucuucuaucaacgaccccucaaaagucaaaaaucaagcauaaguaacugcacucuagaauuucgaaaauauaaagacgaaaacggaauugaacacacacaauuccucaaagcuauaccuaaaucaaauccuuauuaccaagaguucagaauauggcaauggauauuuaauuuaaauauauauaagaaagacaacgaugauaaugucacaaaagaauuuuuaaauacaacucgcgacuuugaaaaucuauucgaauuucuaaauaaucguaaagaaauugaacaaaaaccacucuuaaaauuccuauuagaacagaaagaauuuaagggaaaacuacuaaacgccgaaacggaaaaauucagguggaacuacguugaagacaagaaauacccauguaaugaaacacgaacaaugauaucagaacgucucaagaaaguagaaaacauuucugacgacuuuuuaacaagagaaauggaacagaaaaucuggcacaucaucuacucagugaaugacaaaacugaauaugaaaaagcauuaaaaucauucgcagagaaaaacaaucucgacgaaaauagucuauuugaagcauucaagaaauugccuccauuuaaaucggaauacggaucauuuagugaaaaagcuaucaagaaacucuuaccucuaaugagacuuggcaaauauugguccuacgcgaaaauugaccucuacucuaaaaaccgaauacagaaaauaauaaccggggaauuugacgaaaauauuaaagacagaguuagggaaaaagcgaucagacuaacagcagaaaacgauuuccaaggacuacaacugugguuagcucaauauauuguguauggacgacacucagaggcuucaaugauaggaaaauggaacucugcugacgaccucgaagaguucuuaaaagaguucaaacaacacucauuacguaauccaauaguugaacaagucaucacggaaacccucagaauaguaaaagacauaugguuaaaauacggcaauggagcaaaagacuucuuuaaugaaauucauauagaacuaggacgagaaaugaaacaaacaaaagaugaacgagcaaaugcaacaaagacgauaacugagaaugagaauaccaauuugcgaaucaaagcauuauuagcagaaaugaugaaugaucauucuguagaaaauguacgaccauacagcccaaugcaacaagaaauacuuaaaauauacgaagauggaauauuaaaaagugauauugaaauagacgaugauauauuaaaaaucucaaaaaccgcacaaccuucaucaagugacuuaaagagauacaaacucuggcuugaacaaaaauauaaaaguccauauacaggucaaauuauaccccuaaacaaauuauuuacaccugaauacgaaauagaacauauaaucccccaaucaagauacuucgacgacucauucuccaacaaaaucauaugcgaaucagccguaaauaaacucaaagauaacuacaucggccuaggauucauaaaacaauucgguggcaccaucauugaaugcggauucggaaaacgaguaaaaguguuugaaguaggagaguacgaagaauuugucaagaaacacuaugccaacaauagaggaaaaagaaauaaacucuuauuggaagaaauaccagagaaaaugauagaaagacaaaugaacgauaccagacauaucucaaaauacauaagcggaauacuaucccacauugugcgggucgaagauggaacagacgaaggcgucaauucuaaaaacgucauacccgguaacggaaagauuacuacccaacuaagacaagauugggguuuaaaugacguguggaacgaacucauacuaccuagauucgaacguaugaaucaacuaaccaauucaacagacuuuaccucguggaaugaaaaccaccaaaaauaucuaccaacaguuccaguagaguucucuaagggauuuagcaagaaaagaauagaucaccgucaucaugcgcuugacgcauuagucauagcgugugccacaaaagaccacguaaauuugcuaaauaaucaaucagcgaaaagugcaacuaaacgauaugauuuaaagaagaaacuaaugaaauucgaaaagacaguauauaaagauccucaaacugagaaaagaauagaaagagaaguaccaaaacacuucuuaaaaccgugggaaacauuuacaguagacgcgaaaaauagacucgaaacaauaauagucagcuucaaacaaaacuuaaggguaauaaacaaagccacuaacuacuaugaaaaauacguagaaaaggacggcguaaugaugaaagaaagaguggaacaaacggguaccaauugggcaauaaggaaaccuaugcauaaggaaaccguaucaggaaagauagaccuucccugggucaaagugccaaagggaaaaauccugacagcaacgagaaagucccuagacacuagcuuugaucuaaaagcuaucgccagcaucacagacaccggaauccagaaaauccugaaaaauuaucuagaauuuaaggaaucaccugagcuagcauucucgcccgagggaauagaagacaugaauaaaaacauagaaaaauacaacgguggaagaccacaccaaccgauaagcaaaguacgcguauucgaauuaggaaguaaauuccaagucggucagacagguaauaagaaagacaaguauguagaagcagcaaaaggcacaaaccuuuucuuugcaauauaugaagauaagaaagguaaacgaaguuaugaaacaauuccauuaaaugaaguaauugaaagacaaaaacaaggccucagcgucguagaucuaaagaacguuaaugacuucuuuuuauguccaaaugaccuugucuauauuccaagcggagaugaguucgagaauagggguucaauagagaucgaaaacauaacaaaagagaaaagugaacgcuuuuacaaagucguauccuucaguggaagccaaauauucuuuguccggcacgauauugcgguaucaauagucaauaaaggagaauuuagcacgcuaaacaaaauggaaagagcaauagacgggucaaugguuaaagaaauauguauaaaacuuaaaauugauagauuaggagauguucuaaaagccuga

SEQ ID NO: 5690 - RNA, 4317 nt, Artificial Sequence
  Cas9 variant
augguaaaaaaaggcuauacuaucggccuggacauaggaacaacgucaguaggaugggcggucaccgacgacgacuucgaacuaguaaacaaaaagaugaguauaaaagacaagagcgguucuacaauuaaacgaguaaggaaaaauuuauggggaguaagguuauucgacgaagcaaaaacagcagaaaauacacgacgaacacguggaguacgaaggcgaauaaggagaagaaaagaacgacuaaacuaucuacaaggaauauucaguagcgaaauggcuaaaauggacgaaaacuucuuuaugcgacuagaagaaaguuuuuuuaaauuauccgacaaaucagaacagaauaaauuuccauaugcuuuauuuaaaaacgaaauagaggaaaaagcguauuaccgacaauucccuacaauauaucaccuaagaaaacacuuaauggaacaugaggaaagugaccuaagaaaaauauaucugggccuccaccauauacuaaaauacagagggcacuuuguacaagaaggucaaaaaauggauguagcaaacauagacauacaaggaaacuuaaaggaauuauucaaugcacuuaacgaaaacuucaguaacaaagaggacgacuucgaacaggaaagaaugaaagauggaguaaaaagagcaaaaguacuauuugacacugaaaagcucgccgcgguagaggaaauauuaaaagaaaaaauuucaaaaaguuggaaaguuaacaaaauaucuaaaggcauuuuagccgaaaaaaaagaucuaccuauauuuaaagcuauaguaggcaauaagauagaccuagcagguaucuucgacugcccagacuacgcagaaaaagucaaugaaucuauaaaagaacuaaaggacaaaguuuauuucaacaaagaagacuucgaagaaacuuucgaaaaacuaucacaacuacuuaaagaagaggaacuugaaauauuaauacuagccagaaaauguuaugaggcaguacuacuugcugauauaaugcaaggggaacaaagcuuaagcgaugcgaugguagcgaaauauaacgaccauaaaaaagacuugguaaucuucaagaaauucgugaucgacuacuuuagugaagacgucuauuucgacuuauucaaaaacacccaauuagccggaaauuaucauaguuacguuaaaggagaacgcaaaggcaacaaguucaaucacgcaucacuagaugacuuuuauaaauucguaaaaaaagagcuugacaaaaaagcagaggaacuaucagagcaucccguauacaaacaaauacuacaaaaaaucgaacuggaaacguuuuuaccaaaacaaagaauguucaaaaauggagcaaucccuuaccaaguacaccuacaugaauuacgagcaauaauaaaaaaacaagaaaaaagauuuccauuccuagcugaaaaaaucauaauaaaagacaaucaaaaggacaucagugaauauaaaauagaaacacuaaugaaauucagaauuccauauuacguaggaccuuuaauagaggcaagagaaggugagcuuggaaaaaaaaggacuaauuauucuagauucgcauggaugcagaaaucccccgaaucacaaaauauaggaauaacuccauggaauuuccacuccguaguagacaaagaugccucagcuucagaguucauugaacgaaugacaggauuuuguucauauuucccggaagaaccaguacuaccaaagaacucucuaauauaucaacaguucacaguuuuucaagaauuaaguauuguaggcuauuaugacgagcaaaacagaaaacacuaccuugauggcgaaacacguaggagaauauucgaagaucuauuuaaaaaaaaucguacaguaagugcaggacuccucagaaaguggcugguauguaaccaacgaacgagccaggaggaaaaggaaaucagauuauuuggcuuggaccuuaaaaaaaacgguuuaggaucugggaauuuuaacacuaaauauaccacguacuuagaucuaaaagacgcuggaauaacugaaaaacaacugaaacaacacaaagauuucuuugaaaaaauaguaaaauaccagacaauauucgaagauaaaaaaauauuaaaaagacgaauaauuuuauuaaacgaagaacaaccauuacuaagcgaagaacaaauaaaaaaccuggcgaagaaacacuacacaggauggggaaaccuaagccuuaaacuaauugauggcauacaagacaaaggcaaaacaauauuagacuauuuagaaacacaagauuauaaccaaaaccuaaugcaguuaaugaaugaugaaaacaaaucauuugaaaugcaaauugaacaagcaagggcagggaaaguucaauucgguaaaauagacuauuccuuuguggaacaguuagcgggaagcccagcaaucaagagaggaauuuggcaaucacuccagaucgucgaagaauuaguagcuuuucuuggcaaagaaaacaucaagaaaauuguaaucgaaauggcccgcgaaaaccaaucauccaaaagaacaaagucgcgacaaaaacaaauugaagcauuauaucagaaaguaaccggagaccuaaaaaacgaacaggaaaaaauagauguaaugcagaauuuugacaacgaaagaguauuccuuuacuauuuacaaaacggcaaauguaugcauucaggugaaaaacucgaacuuucccaguuauccgaauacgaaauagaucacauaauaccacaaacauacaucaaagaugacagcuucgauaacaaaguacuaguuacuaggaacgcuaaccaacaaaaagguggagacguacccucauaugauguaauugacaaaaugaaaucuuacugggaaaaacucaaggaaaacaaucucauaucagaaaaaaaauuugcaaaccuaaccaaagguaaauuugacgaccaacaacuauccggguuuauaaaccgacaguuaguagaaacaaggcagaucacaaaaaacgucgcgauuauauuagauaaaauauauaacgacgaagccaaaaacgaaaaagaaguagcaauaauaacauuaaaauccgccuuaacaagucaauaccgacaagguauuauauaugucccaaacgacgacuuugaugaacuuaaacucgugagcaaaacaaauaguagauuaaaagaaguaaaacuacacgacggguucuacaagguacgugaaaucaaugauuaccaucaugcgcaugacgccuauuugaauaaugugguagcuacauaucuauaugaggccaugcccgauuuaaggccccucuucguauauggagaacauucaagagaaauccauaaaagauuccucggaaaauacgcaacaacacgaaaaggccaauuuaaacaauuacuuguugauaugcaagacgaauacuggaugagaaaagacaaagaaggaaacuucauagauggggaaauucucuggagacgagaugaaguguuacaaauaguuaaaaaaguacuagacuaccgaaacauacaaauaacgaaaaaacucgaaaugaugguaaccggaggagaagaaaaaaguuucuaucaggacagucguugccgaaaagauaaaaccgcuauuccauacaaaaccaacugggauccuagcaaauauggcggauuuaaaagcccacgaacagcuuacgcaauaccgguaauuaagaaaaacaagcccaaauuagaacccguacuguuagugaauagaucaaaagucgaaacagauggacaauucgauugugagaaauuuaaagaacugaaccccacuuuaaaaauauuaggacagccaauuuggaaauaucaaucauucgaaauguucgacgguaccaagagauauauagcuuccgcaucagaaauacauaaaggaaaccaaauaaaauuuagccaagagcacaugaaauucauaucauguugccaaaaauaugaugaaguaaaaaauaaacuugcguuugauuucgucaaugaaucuaaacacuuauuucaggaaaucuuaacggcaauuaaagacaacauucacagauauagacuuauagccgaaggaauagaaguucaucgaaaauucucgaacauguuagagaacauagaaaaacuaucaacucaagagcuuguagacaaucuauuagacgccaucaacaucaccucaguaggaaccacuaacaaugcauucggaagaguaagauauaaagggagcuacuuaaaugaaauauggucagcgacucuaauacaccaaagcguaacaggacuuuaugagacgagagaaaaacuaauuuga

SEQ ID NO: 5691 - RNA, 4323 nt, Artificial Sequence
  Cas9 variant
augaaaacuauacuaggacuugacuuaggaacaaauucuauugguugggcccugguagaacaagacuucgaaaauaaacaaggacuuauuuuagguauggguucccgaauaauaccaauggaugcaggaauuauuggaaaauuugcagagggaucuuccauaucacaaacagcagaaagaacaggauaccggaguauucgcagacuacgugaacgccauuuacugaggagagaaagacuacacagagugcucaauauccuaaaauuccuuccugaacacuaugcagcagaaaucgauuucgagaaacgauuuggacaauuccuggcagaaacagaaccaaaacuagcauggaagaaaucagcagaaggaaaauucgaauuuuuauuucaacggaguuucgacgaaaugguagccgauuucaaagcaaacggacaagauaucaaaaucccauaugacuggacaauauacuaccuuagaaagaaagcgcuaacucagaaaauaucaccacaagaacuagcauggauuauacucaacuuuaaucagaaaagaggauacuaucaauuacgaggggaagaagaagaagaaaacccaaauaagaaagucgaauuuuacucauuaaaaauagucgauguaguagcagaugaacaaccgaauaagaaaggugauacaugguauucucuacaccuagaaaauggauggguauacagaagaucaagcaaaauaccccuauaugauuggaaagacaaaguccgagacuuuauagucacuaccgacauaaacgaagacggaagcgaaaaauuggauaaagacggagaagugaaacgaucauucagagccccaaaagaagacgacuggacacuuaucaaaaagaaaaccgaacaagagauugagcaauuuaaccaaacagugggaagcuauauauacgaggcuuuguuagauaacccuacccagaaaauacgcggcaagcuaguaagaaccaucgaacgcaaauucuauaaaucagaacuuaagaaaauacuagaaaaacaaauagaacuucaaccagaauuauuuacagaggaccuuuacaaugccugugcacgugaauuauaccgaucaaacguagcccaccaacaacaacucucaucuagagauuuugucuaucuauuuuuaaacgacauaaucuucuaccaacgaccccuaagaucacaaaaaucacuaauaucuaacugcucuuuagaauuuagaacuauuaaagacaaagacggaaauggucaaauaauauauuugaaagcuauuccuaaaucaaauccauacuaucaagaguucagaguauggcaaugguuguauaacuuaaaaauauucacuaaagaagacgauaaagauguaacuaaccaauuuauaaauaaaguagaagacuuagaagcauuauucgaguuccuaaugaaucaaaaagaaguuaaccauaccgacauacuaacauacuuaauugaaccaaucguaaaaucaaaauacccaaacgcaaaaggcaaagcauucaaagaugaauuaaagaaagaauuaaagaaauaccgguggaacuacguuuaugacgcagacaaagacgaaaguaaaucauacccuaugaaugaaacacguuaugaacuccgcaaaagauuggacaaaguggaaaacguacccgcggauuuuaugacaagaaaaauugagcaacacuuauggcacaucauauauuccguaacugauaaaauagaguucgagaaagcacuaaaaucauuugcaaacaaauaugaccuacaccaagagagcuuuguagaaaauuuuaaaagauucaaaccauucgauucugauuacggaaccuacucagaaaaagcuauaaagaaacuauuaccccugaugaggguagguaaauacuggucaugggaaggcauagauaacaauacuaagaaacgcauaggaaaaaucauaacgggagaauaugaugaaacuauuaaaaacaggguaagggaaaaagcuauagaccuaaccgaggaaaaccacuuccaaggauuacaauuguggcuugcgcaauauaucguuuacgacaggcauucagaagcagacauagccgguaaauggaacucagucgcagaucuagagcaauaucuaucagaguucaaacagcacagccuacguaacccuauaguugaacaaguaauaacagaaacauuaaggguaguaagggauauauggaaacaauacggaaaaggagcaaaagauuauuuugacgaaauacacauagaacuuggaagagaaaugaaaaauaccgccgaagaaagaaaaagacuaucgaguaucaucucugaaaaugaaacuacaaauuuaagaauacgcgcaauucuggaagaauugauguacgaugaaaacauggaaaauguccgcccauacuccccuaugcaacaagaagcacucaaaaucuacgaagauggaguccugucauccucgguggaaauuccagaagauauagagaaaauuaguaagaaaagugaaccuacgaaaucagagauacaaagauacaaauuauggcuggagcaaaaauaucgaagucccuauacuggacgcccaaucccauuaaguaaacuguucacuccagcuuaccagaucgaacauauaauaccacaagcacgauucuuugacgauggauuuagcaacaaaguaauuugugaaagcgaaguaaaugcucuaaaagauaaaaugcuaggcuuagaauuuauacaaaauuauuacggacaaaaaguaacaacuuccuuuggagaaguaacuauacuuacagaagacgcauauaaagcauuuguaaaagagcauuaugacaaaaacagaaguaaaagaaauaaacuacuuuuagaagaaauaccugaaaagaugauagaccgucaaaugaacgacacaagauauaucucaaaauacauaucaaaaguuuuaucaaaccugguaagaggagaaaaagaugaugaaggaguaaauagcaaaaacauuaucccagguaacggaaaaauaucagggacacuaaaacaagauugggguuuaaacgauguauggaaugaucuaauucuaccuagauucgaacgaaugaaccaacucaccaacucaacugacuuuacagcauggaacgaaaaacaucaaaaauuucuaccgaccaucccauuagaacuaagcaaaggauuucagaagaaaagaauagaccauaggcaucacgccuuagacgcacucauaauugcaugcgcaacgcgagaucacguaaaccuauuaaauaauaaacacgcuaaaaguaggaaugaacgcuaugaucuacagcacaaacuuagacacacuacaccauggcaggacaaagaaggcaaaguucgaacaaaauucaccgaguucaagaaaccaugggaaacguuuacacaagacacaaagaaagaauuagaaaagauaguuguauccuuuaaacaaaaccuaagagucauaaacaaagcaacaaacuauuacgagaaaauaguagauggcaagaaaguaauguuuaaacaagaggguguuaauugggcaauaagaaaaccaaugcacaaagaaaccguuucuggcaaaauugaccuaccaaggguuaaaguuagcaaagguaaaauauuaacggcaacaaggaaaucgcucgacacaaguuucaaugcaaaaacuauucucaguauaacugacacagguauacagaaaauacuucuuaauuauuugaaagccaagggaaauccagaauuagcauuuucccccgaaggaauagaagaaaugaaccaaaacauauccuuauacaacgacggaaaaccacaccaaccaauacucaaagugagaguuuucgagcaaggaucaaaauucccacuaggugaaacaggaaauaaaacaacgaaauacgucgaggcagcaaaaggaacaaacuuauucuuugggguauacgaaaacaaccaaggaaaaagaaguuauaauacgauaccauugaaucugguaauugaaagacaaaaacaaggucuaaauucaguaccugagacuaaugaaaaaggccaccgccuucuauuuagcuuaucgccgaacgaucuaguauaugucccaauagagggcgaagucuucgacaaaacaaacccagaugugaacagaauauauaaaauaguaucauuuagcggaucccaaauguuuugcgucagacaagacguugcaaccucaauuguuuacaaacuagaguuuaguagcuuaaacaaaauggaaagaacaaucgaugguauaaugauaaaagagauaugcaucaaauuaaaagucgaucgacuggguaauauaucaaaagcauga

SEQ ID NO: 5692 - RNA, 4323 nt, Artificial Sequence
  Cas9 variant
augaaaacuauuuugggauuagauuuaggaaccaauucaauaggaugggcccuaguagaacaagauuuugaaaacaaacaaggucuuauauuaggcauggguucacgaauuauccccauggacgcaggaauaauagguaaauuugcagaaggaucaucaauaucacaaaccgcugaaagaacagguuaucguaguauacgaaggcugagagaacggcaucuacuacggagagaaagauuacacaggguucuaaauauacuaaaauuccuucccgaacauuacgcagcagaaauagacuucgagaaaagguuuggucaauuuuuagccgaaacagaaccaaaacuagccuggaagaaaaaugcagaaggaaaauuugaauuuuuauuucaacgaucauuugaugaaaugguagcagacuucaaagcaaacggacaagacaucaaaauaccuuaugauuggacaaucuacuaccuuaggaagaaagcauugacacagaaaauaaguccucaagaacuagccuggauaauauuaaauuuuaaccagaaaaggggauacuaccaacuaagaggggaagaagaagaagaaaaucccaacaagaaaguggaguucuacaguuuaaaaaucgucgauguaguagcagaugaacaaccaaauaagaaaggugauaccugguacucauugcacuuggaaaauggcuggguuuacagaagaucauccaaaauaccacuauaugacuggaaagauaaaguacgagauuuuauaguaacuacugacauaaacgaagauggcagcgaaaaauuagauaaagauggagaagucaaaagaucauuccgagcacccaaagaagacgacuggacacuaaucaaaaagaaaacugaacaagaaauagaacaauucaaccaaacagucggcagcuacaucuacgaggcuuuauuagacaacccuacccagaaaauucgaggcaaauuaguacgaacaaucgaaagaaaauucuauaaaucugaauuaaagaaaauacuagaaaaacaaauagaauuacaaccagaacuguucacggaagaucucuauaacgcaugcgcaagagaacuauacaggagaaacguggcccaucaacaacaauugucaucaagagacuucguuuacuuauuuuuaaaugauauaauauuuuaccaaagaccccugcgaagccagaaaucacuaaucucaaauuguucccuagaguuccgaacuauuaaagauaaagaugguaauggucaaauaaucuaccucaaagcgaucccaaaaaguaacccuuacuaccaagaguucaggguguggcagugguuauauaaccuaaaaaucuuuacuaaagaagacgacaaagacguaacaaaccaauucauaaauaaaguagaagauuuagaagcccuuuucgaauuuuugaugaaucaaaaagaaguaaaccacacagacaucuugacauaccuaauagaaccaauaguaaaaaguaaguacccaaacgcgaaaggcaaagcauuuaaagacgaacugaagaaagaacucaagaaauauagauggaauuauguauaugaugcagauaaagaugaauccaaaucauauccuaugaacgaaacgagauacgaauuaagaaaaagacuagacaaaguagaaaaugugcccgcagacuucaugacacgcaaaauagaacaacaccucuggcauaucaucuauagugucaccgacaaaaucgaguucgaaaaagcccuuaaaucauucgcaaauaaguacgaccuacaccaggaaucauucguagaaaauuuuaaaagguucaaaccauucgacagcgacuacggaacguacucugaaaaagcaauaaagaaauuauuaccuuuaaugcgcguaggcaaauacuggucuugggauauaauagacgacaaaacgaaaaccagaauuggaaaaauaauaacaggagaauaugacgaaacaaucaaaaacagggucagagaaaaagccauagacuuaacagaagaaaaucacuuccagggccuacaacuauggcuugcacaauauauaguauacgauagacacagcgaagcagauaucgcuggaaaauggaacucagucgccgaccuagaacaauaccuaagugaauuuaaacaacacucucuaagaaauccuauaguagaacagguaauaacagaaacacuuagaguaguacgagacauuuggaaacaauauggcaaaggggcaaaagacuacuucgacgaaauacacauagaacuagguagagaaaugaaaaauacagccgaagaacguaaaagauuaaguucaauaauaucagaaaaugaaaccacuaaucuacgaauacgagcaauauuagaagaacuaauguacgaugaaaacauggaaaacguucgcccauauucuccuaugcaacaggaagcauuaaaaauuuacgaagacggcguacuaaguucaucgguugaaauaccagaagacaucgagaaaauaagcaagaaaucagagccaaccaaaucagaaauacaaagauauaaauuguggcuagagcaaaaauaucgaagucccuacaccggaaggccaauuccucuguccaaacuauucacucccgcauaccaaauagaacauauuauaccacaagcccguuucuucgacgauggcuucucaaauaaagucauaugcgaaagcgaaguaaacgcuuuaaaagauaaaauguuaggcuuagaguucauucaaaauuauuauggacaaaaagucacaacaucauuuggagaaguaacaauauuaacagaggacgcuuacaaagcauuuguaaaagaacauuaugauaaaaaucguuccaaaagaaacaaacuccuacuagaagaaauccccgagaaaaugauagaccgacaaaugaacgauacucguuacauauccaaauauaucucaaaaguacuuagcaaucugguuaggggcgaaaaagaugaugagggcguaaacagcaaaaacauuauuccgggcaauggaaaaauaaccggaauauuaaaacaagacuggggacugaaugauguauggaaugaucucauacuaccacgauucgaacguaugaaccaacuuacaaacucaacagacuuuacugccuggaaugaaaaacaccaaaaguuccuacccuccguaccccuggaacugucaaaaggcuuccagaagaaacggaucgaccacagacaucacgcacuugacgcacuuauaaucgcaugugcaaccagggaucacguaaauuuacuuaacaacaaacacgcaaaaucuagaaaugaaagguacgaucuacaacacaaauuacgacacaccacaccauggcaagacaaagagggaaaaguaaggacaaaauucacagaauuuaagaaaccaugggaaacauuuacacaagacacuaagaaagaauuagagaaaauaguugucaauuuuaaacaaaaccuaagaguaaucaacaaggcaacaaacuacuacgaaaagauuguggauggcaagaaagucauguuuaaacaagaagguguuaauugggcaauuagaaaaccaaugcacaaagaaacaguaucuggcaaaauugaccuuccacgugugaaaguaagcaaagguaagauacucacagcaacacggaaaucauuggacacuucauucaacgcaaaaacaauccuaagcauaacagauaccgguauacagaaaauacuacuaaacuaucuuaaagccaaaggcaauccggaauuagcauuuucaccugaaggaauagaagaaaugaaccagaacauuucuuuauacaacgacggaaagccgcaucaaccuauucugaaaguaagaguguucgaacaaggaucaaaauuuccuuuaggagaaacagguaauaaaacaaccaaauauguagaggcagcaaagggaacaaaccuauucuuuggugucuacgaagacaaucagggaaaaagguccuaugacacaauuccccucaacauaguaauugaaagacaaaagcaagguuugaacucaguaccagaaacaaaugaaaaagggcauaggcuauuauuuagucuaucucccaacgacuuaguuuauguccccauagaaggcgagguauuugacgaaaccaacccagauguaaauagaauauacaaaguaguaucauucagcggcucacaaauguuuugcguaagacaagacgucgcuaccucuaucguauauaaauuagaauuuucaucauuaaacaaaauggagcgaaccauagacggcauuaugauaaaagaaaucugcauaaagcucaaagucgaucgauuaggcaacauaucaaaagcauga

SEQ ID NO: 5693 - RNA, 4332 nt, Artificial Sequence
  Cas9 variant
augaucaaacuucuuuauuuagagaaacuaaaacaauacacuaugaaaaaaauacuaggacuggaucuaggaacaucaagcauagggugggcucuagugaacgaggcugaaaacagugaugagguaucgaguauuauaaaacucgguguaagggugaauccgcugacaguugacgaaaugcaaaacuucgaaaaagguaaaucaauaacaaccaaugcagacagaacguuaaagagaucaaugcgaagaaauuuacaaagauacaaauuaagacgagacgcacuaauugaauuacuaaagaaaguaggguuuaucacagauaaaaccauccuuuccgagcagggaaauagaacaacauuugaaacauacagguugagagcaaaggcggcugaagaagaaauaagccuaaaagaacuagcacgaguuuuacuuaugauaaacaagaagaggggcuauaaauccucuagaaaagcgaaaggugaagaagaaggagccuuaauagaugguauggaaaucgcuaaaaaguuauaugacgaagacuuaacacccggacagcuuugccuacaauuacuagaaagugguaagaaauuuuuucccgacuuuuaccguagcgaucuacaagaggaguucaacaaaauuugggauuuccaaaaacaauuuaacuuauucagcuuuugugacguagcaaaagaagaaguaaaaggaaaaaauaagagccaaacuugggccauacuagcaaaauacuucguggaaaccaagaaaguaaauguauggaacgaacacgaagcacaaaccgaaaaucgagaagaaguauauaaacuaguaggauuaaaaagaacaguaaaaggcgaagaacucaaaaaagaaaauuacagguggaggguucaagcucuuacugaacaacuugauuuagaaaaaauagcuguaguauugcaagaaauuaauggacaaauaagcgcaucaagugguuaucuaggggccauuagcgacagaaguaaaguccuauauuucaacagacagaccguuggacaauaccaaauggccgaauuaaauaaaaaucccaauaugucacugaggaacaugguguuuuauagacaagacuaucuugaugaauucaacgugauaugggaaaaacaagcagaauuucacaaagaacucacccccgaacuuaaaaaagaaauccgugacauuauaauuuuuuaccaacgaaggcuaaaaucacaaaaaggucuuauaucauucugcgaauucgagaauagagagguaguaguagaaaaagaaggaaaaaagcaaacaaaaauuauaggauguaaaguaaucccuagaagccauccccuauuucaagaauucaaaaucuggcaaacacuaaauaauauagaaguuuucguaggagaaaagaaagggaaaagaaaaaaaucaaauguaucaucagaucuauucggugauacagaagaugccuuaauaaccgaaggaagaagauucuuguaucaggaggaaaaaaaaauccucgccaaagaacuaagcaucaaaaaggggcugaccaaagcagaaauacuuagauuauuauuugaaaacccccaagaauuagauauaaacuucaaacaaauagauggaaaccaaacuggcuuugcuuuauucuccgccuacaguaacaugauagaaaaauauggauaugaaccucuagauuuuaaaaaacccgcagaagaucugaucagccaacuaaaaacagucuucacugaccuuggcuggaacacagacuugcuauucauagaucucgacaaagaaaacaaagagugggaaaaacaaccauacuuccgucuuuggcaucuacucuacucauuugaaggcgacaacacaccuacaggaaauggaaagcuuauugaaaaaauaaugcaauuauguggcauagaaaaagaauaugcaauagaacucgccaacgugucucuacaagacgauuaugggucccucucagcaaaagccaucaagaaaauucugcuuuaucucaaagaagggaaucaauacgauauggcaugugaauaugcugguuaccgucauagcaaaagcucucuaacaaaagaagaaauagaaaauaaaguuuugaaggauaaguuagaaauacuacccaaaaacagucuaagaaaccccguaguagaaaaaaucuuaaaccaaaugguuaacgucauaaacacuguaauggaagucuauggcaggccggaugaaauaagaguagaauuagcaagggaacuaaaaaaaagcgcaaaagaaagagaagaauugacaaaagccguggccaaaaacaccagagaacacgaagaaauccgaaaagugcuccaaucagaauucggcaugauuaauguuucucgaaaugacauuauaagauacaaacuuuacgaagagcugaaggacaacggauacaaaacacuguacuccaaucaauauaucccaagagagaaguuauucucaaaagagaucgacauagaacauauaauaccacaaaguagacucuucgaugacuccuuaagcaacaaaacacuugaauacaaaagcaucaacauagaaaaagguaauaaaacagcauacgacuucguuaaagaaaaauacggagaagaaggacuucaacaguacuugaauaggugugaaaacuuaugcaaagacaagaaagccaaacucagaaaauugaagauggaacugaaugaaauucccgacggauucauagaucgggaccucagaaacacacaguacaucgcgaaaaaagcauuaucaauguuaacagaaauuuguaggagaguaguagcaacuacagggucgauaacagacaaacuucgagaagacuggcaacucguggacgucaugaaagagcuaaaccuaccuaaauacgaagcacuuggacucguggaaguauacgaagacaaagacggaagaaagauaaaaagaauaaaggacuggaccaaaagaaaugaucaccgacaucacgcaauggacgcucuaacgguggcauuuacaaaagauguuuucauccaauacuucaauaacaaaaacgccgcaugggaaucagauucaaaagagcauacaaacauagugggaauaaaaacacgauauuucgaaucuggaaaagccguaccaccuauaccccugggucaguuuagagucgaagcaaaaugucaucucgaaaauuuguuagucuccauaaaagcuaagaauaagguaguaacaaccaaugucaauuguaucaaaaaaaaagggggaacauauaaaaacacacaacaaaccccuagaggacaacuacaucuggaaacaauuuauggaucucauaaccaauacguaacaaagauagaaaaggucaaugcaucauucgaugcaguaaaaaucgccacaguaucuaagcaggacuaucgcaaugcguuacuaaaacgccuagagguauuuggaaacgauccuaaaaaagcauucacuggaaaaaacaguuuagaaaaaaauccuauauaucuagauagggcucaaacaauccaaguaccagacaagguacaaacaguagaacuagagaccgcguacacaaucagaaaaccaguagauccaacauuaaaugucgacaaaguaguagacaagaagauaagacuuauacucgaacaaaggcuuaaagaauacggaggggaugcgaaaaaggcuuucgucaacuuggaugagaacccaauuuggcuuaacgaagaaaaaggcauaucaauaaagagagucacaauucggggaauaucuaaagcucaagcucuacaugacaaaaaagacaaagacggaaauuucauacuagacgaaacaggaaagaggaucccaguagauuuuguaaacaccggaaacaaucaccaugucgcaauauaccgaaagccaguauuggauaaaaaaggucagguaaucuuugacgacgaagguaacccgauguacgaguuagacgaagacguaguuccauucuucgaagcaguaacacgcgcaaacuugggaaucccaauaaucgauaaagauuauaagaagucagaaggauggcaauuucuauuuucaaugaagcagaaugaauauuuuguauucccaaacgaaaaaacaggauuuaauccaaaagagguagaccuacuagacccugauaacuacgcaaugauuagcccaaaccuauuuaggguacaaaaaauugggcuaaacgauuacaccuuuagacaucaucuagaaacaacuauccaaaaugauuuaaaauucaucaccuggauacguuguggcaagaguggaauaaaagacauuguaaaaguaagaaucaaccacauaggacaaauaguaagcgucggagaauauuga

SEQ ID NO: 5694 - RNA, 4332 nt, Artificial Sequence
  Cas9 variant
augaagaaaauccuuggucuagacuuaggcacagcauccauaggaagcgcuuacguauuagaagcggaaaaaucggcagaucaaacuaaaauaguuuaucugggcacacgaauaauacuuucuagugccgaugccgaaaacuucucaaaaggacuuucuugcagcccaacgacagacagaaccuuuaaaagaucaaugagacgucgacuacaaagauauaaacagaggcguaguagccuaauccaacaauuuaagaaaauaggaauaauaaccaacacagaacaaauaauuagagaaccaauaucugaaacacaugaacuucuaagaauaagaucaaaagcuguaagugaacauguuucccucgaagaguucgcacgaauacuacugacgauaaacaaacgucgaggauauaaaucaaacagaaaaacauccaaaagcacugaagaagacgguaaauuaguagacgccauggcaguuacaaaagaacuaauaaaacuaaagaaaacccccggacaauacauguucgaaagauucaaacggggaaaauaugcggaaauagacuucuaccccuucgaccuuauaaaugaauuaaaacaaauaugggaaguccagggccaaaaauaccccgauguccucacagaaggauugcucaguucucuacuaaaacagaaaacagguaaagcgaaagaauuaauauacucuaaaagcgaccuaaauccugcugaagucccaauagauuaccaaaaagguaagaaacuuagaaaaacaauauugaauaaauacuuugcauacgaaagcagaagccuagcuguaaccaacauuauaccaguagaacaagcaauaacagcaauagucgcuauauguaaacaaauaaacaauucauccggcuacuuaggggcaaucggcgauagaucgaggguccuauacgcuaacaaccaaaccauuggacaauaucuguacgaaagaauaaaagccaacccacaugacagaaucagaggagaagucuucuacagacaagacuacuuagaugaauuugacagaauuugggaaugucaacaaaacuacuacccagcgauacuaacuaaugaccguaaacaauacauacgcaauagaaucauauuuuaccaaagaccauuaaaauccaagaaaucagaauuagcauucugugaauuugaaucaagagaaguugaacauaacgggaagaaauauaccgaaggacugcauguugcaccaaaaucaagucccguauuucaacacuuccgauuauggcaaagguuaggucaaauugaaguaucuccauuacgaaaaugggauaaacagucaaaugaacuuuuugaacaacaaaauaaugcagacagagaaggcaucuuaaacacugaagccaaacaaaaauuauuuucauaccucaaucuccucgaucaucuaacagauaaugaaauccugaauauacuagguuauucaccugauaaauggaaaauaaacuucagagaaauaauaggaaauagaacuaauaaucuaaugaugaaagccuuuuucaguaugaaagaaaugacugauggcgaacaaauugauugggagaaaaaccuaacaaaaauaacaaauggacaaucccuaauaaguccagaacaaauaguugaccuuaucagacaguucuucgaaagagaagguauaacaacaagccugcucuacuuugauccagcaacagacaacuuucgcgaacaaucacauuauagucuuuggcacuuacucuacuccuacgaagacgauaacagcccgacuggcaccaccucguuauguaagacacucgcaaaaagauaugguauuccacaugaacucuguccacuacuugcaucccugacuuuugaacgucaauauggaagucucucaacaaaagcaaugcgcaaauuauugccauucaugcaagagaaaagauacgaugaggcuugcgaauuagccggauaucgccauucagccuggauaacaaaggaagaaaaugcgaaacgaacacucaaaaacaaauuaccuuuacucagaaaaggaucauuaagaaacccaguaguagagaaaauacucaaucaaaugacccaugucauaaacacucacauagcagaauauggaaauccagacgaaauccgaauagaaauggcccgagauaugcaggccaauaguaaacaaagaaaagcaaugacugcagcuauuacugaagcuacaaaacgaaacacacaguucauagaagaaauacaaaaagaauuuggcuucaauccaucuaaaaacgauuuaauaaaauacaaacuuuggaaagaauuagcaccacuagguaauaaaacauuauauucaaauauauacauacccaaagaagaauuauuuacugcaaaauucgaaauagaacauauaauuccacgagcacucuuuuacgaugacucauucucaaacaaaacguuagaacuaaacucagucaacaaacuuaaagggaacaagaccgcacuagauuaccuugauacauuaggccaggaaaaagcgaaugacuauauucuucgugucgaagaacuaaagaaaauaggagccauaacucaagccaaauauaagaaauuauugauacgagaaaaagaccucggagacgauuucacuaauagggaccucacgaacacaagauacauaauacgccacgcagccgaucgagaucuaacaaauacacgauacaucauuagacaugccgcagacauguuauuacagguaacucccuccauaguucacacuaacggaucaaucacagcaauacucagacgggacuggggacuucuagacauacugaaagaacucaaccuaccaacuuacgaauccauagacagaaagaucagugaucccgaagaaaaauuaacucaaucaguagaccggaaagacggacaagccaucaaaaugaucaaagacuggucaaaacgagaugaccacaggcaccaugcuauggacgcacucauaacagcacugacaacaagaaaacaugugcaauauuuaaacggcaacucaggugccgaagaaacagauaaagcccagaaacuggaacaauuaaaagcgcuaagaaaacaacuaauaggauccgacggacacuuuauuccaccaaugcacgacauccgugugcaagcaaaagaagcccuaucccguguaauuauaucaacuaaagucaaaggaaaaguaacaacccccaauacaaacauaauuugcucccgagauaaaacuacgggcagaaaaauauauguucggcaaacaacuuugacaccgagaggagcacuucaucuagacacaaaauauggcaucaauagauauuaucaagaaagagaagucagcauaggcucuaagcucacccaagaagaaauacgcuuaguaucuucaccccacauccaaucaauccuuuuagagcgacuccgugcuuucgauaauaauccuaaaagugcuuuuacagggcgaaauucaguagacaagaaaccguuagaagacaaaaauaaaaagcuaguauacacagauaagaaaguuaaacagaccauuuuagccaaucguuucgucaaaagagacaggguaaauagcaaacuggaccuagauaacguaauagauaccgguauaaaaaggauucucgaaagaaggcuuaaacaauauggaggcaaauaugaaaccgcauuuagugacuuagagaauaacccaauaugguuaaacgaggaaaaaggaaucgcaauaaaauccguuagaauacgugguaaaaauaacacuauaacgauaagacaaacuaacacuugucgaauaaaguauguagcaaacgacaacaaccaccaccuagcaguauacgcacuaccagacggaucuauaaaagaugauaucgugagcuucuucgacgcaguagaacggagccgaaaaagacuaccaauaauugacaaacacaaaaaccaaucgcuagguuggaaauaccuauucuccauaaaacaaaaugaauauuuucuuuuaccacaacaaguagagaaaauagauauugacacaggagaaauaaguaugcaaacaacauuuucucccaaagaucuaagccaugaguauaucaugaaccccgauaacuacgcagaacuagcgucucacaucuuucgcguacaaucaauuagcaaaacaccccaagguaacagagaugucagaauauaucuauuuaagcaacaauauauaucgggaagccaaaaagacuccuuacacuugaaaggaauuacucaucgccaaauaucaucagcaaaagauuuagcggagcuaguuaaaauaagaguaaaccaccuggggagaauuguaaguguuggagaaaaauga

SEQ ID NO: 5695 - RNA, 4341 nt, Artificial Sequence
  Cas9 variant
augguuaagaauauacuuggccuagaccuaggaacaaacucaguaggcugggcuuuaauuaaacaagauuucgaaaacaaacaaggggacauccuagguaugggaagccguaucauaccuaugagccaagauguacuaggagauuucggaaaaggaaacagcauuucacaaacggccgaaagaaccaaauauagaagcgucagaaggcuacgagaaagauuccuacuuagaagggaaaggcuacauaggguauuaaacguccuagacuucuuaccugaacacuacgcaucccaaauagauuuuaauaaaagauucggcaaauucaaagaagagacugaaccaaagcuugccuacaguaacgacggauucauuuucaaaaagaguuuugaagaaaugauaucugacuuuaagacacaccaacccgaauuauuagaaaauaacaaaaaagugccauacgacuggacaauauacuaccuaagaaacaaagcccuuucacacaagauagaaaaagaagaacuugccuggauacuccucaauuuuaaucaaaaaagaggauauuaucaacuaagaggagaagaagaagaagaaaacccuaacaaauuaauugaauucuauucacuaaaaauagucgacguacuagcugaugaaccucaaaaagguaaaagcgacauuugguauaguuuaauauuagaaaauggcuggauauauagacgaucaucaaaaaucccccuauuagauuggaaagguaaaacacgagacuucauaguaaccacugaccucaaugaugacggaucaguaaaaacagacaaagaaggaaacgaaaagcggucauuucgagcgccaggugaaaacgauuggacccucguaaaaaagaaaaccgaacaagaaauagacaacagugacaaaacaguaggcgccuacauuuaugaagcguuacuucaaaauccaaaacaaaaaauaaaagguaaacucguaaggacaauugaacguaaauucuauaaagccgaacuuaaacaaauuuuagaaaagcaaauggaauuccaccccgaacugaggcaagaugaucuauacagugauugugugcgagaacuuuauaaaaauaacgaagcgcaccagcuuacccucucaaaaaaggauuuuguacaucuauucauggaagacaucauauucuaucaaagaccauuaagaucacaaaaaucaaguaucucaaacuguacacuagaauuccgaaaauauaaagacgaaaaugggacagaacacauacaguaccuaaaagcccugccaaaauccaacccauauuaccaagaauuuagaauauggcaauggauguauaaccuuaacauauauaagaaggaagaugauacaaacguaacaaaagaauucuugaauucaaaagcagacuuugaaucccuuuuugaauuccuaaauaacaaaaaagaagucgaccaaaaagcacuccuuaaacacuuuaaaauaaacgacaaaacccaucguuggaaauacguagaagauaaaaaauacccuuguaacgaaacaaaaacgaugaucuccgaacguuuaaaaaaaguagaaaauauaagugacgacuuccuaacaagagaaauggagcaaaaaauuuggcauauuauuuacucgguaaaugauaaaguuaaauacgaaaaagcacugaaaucuuuugcagaaaagaacaaccuagacgaaaguucuuucuuugaagcauuuaaaaaauuuccaccauuuaaaucagaauacggugccuucucagaaaaagcgauaaaaaaacuacuuccauuaaugagauuggguaaauacugggaugacgaugaaauuuuaaaauauucugacauauacuuuaagaauauugaauaucugcucggcguacuaaaacaaaaagacaagaacauaagcgacgauaacagacaaaauuggaacaaaagcauuaauaauaaauuacgagaagaauuagaaauauuucaaaacgcagagauagaaucauuucaaggacuaagacuacacauagcacaauauauacuuuacggacgccauucagaagcagcuaugcuagguaaauggaacuccgcagaugaucuugaagaauuccuaaaagaauuuaagcaacacucauuacggaaucccauaguugaacaagucauuacagaaacacucagaguagugaaagauauauggguaaaauauggaaacggagcuaaagacuucuucaacgaaauacauaucgaacuaggaagagaaaugaaacuaccagcagaagaucgcaagaaaauaaccaaccaaauaagugaaaacgaaaacacaaacuuaaggaucaaagcccugcucgcggaaaugaugguagacucuucugucgaaaacguacgaccguucagcccuaugcaacaagaaauacucaaaauauacgaagacggaguacuuaauagugauauagaaaucgaggacgauauccuaaagauaaguaaaacagcucaaccaucaccauccgacuuaaaaagauauaagcuaugguuagaacaaaaauacaaaucucccuauacaggucaaauuauaccacucaauaagcuauucaccccagaauaugaaaucgaacauauuauuccccaaucccguuacuuugaugauucguuuucaaacaaaguaauaugugaggcagcaguaaacaaacuuaaagacaauuuuaucggucuaggguucauaaaacaguucggcggaacaauaguagaauguggaaacgguaaaagcguuacagucuuaaaagaagaccaguacgaagacuuuguuaaaaaacauuacgcaaacaaucgaucaaagcggaauaaacuacuauuagaagauaucccugaaaaaaugauagaacgucaaaugaacgacacacgcuauaucuccaaauauaucaguggcguauuauccaacauaguuagaacagaagacggcaccgacgauggaguaaauaguaaaaacauaguacccggaaacggaaagauaacaaauacuuugaaacaagacuggggacucaacgauaucuggaacgaucuaauccuaccgcgauuugaacgcaugaaccaauuaacaaacucaacagacuuuacggccuggaacgaaaaucaccagaaauuccuaccaacagucccaguagaauuuucaaaagguuuuagcaagaaacgaauagaccaucggcaccaugcucuagaugcauuagugauagccugugcaacuaaagaccauguuaaccuuuuaaauaaccaaucggcaaaaagugauaccaaacgacacgaccuaaaacguaaacucaugaaauuugaaaaggucgcauacaaucauccccaaacaggugaacgaaucgaaagagaaguucccaaacaauuuuuaaaaccaugggaaaccuucacagucgaggcaaaaaacgggcuggaaacaauaauagucagcuucaaacaaaacuuaagagucauaaauaaggcaacaaaccacuacgagaaauacguugagaaagacggagccaaaguaaagggaagaguugagcaagcagguaccaacugggcaauuagaaaaccaaugcauaaagaaacggucucuggaaaaauagauuugccacggaucaagguacccaaagguaagauacuaacugcaacaagaaaaaaucuagauacaagcuuugaccuaaaaacgauugguaguauaacagauacaggcauccaaaagauuuuaaagaauuaucuacaauacaaggacaauaacccagaauuagcuuucagucccgaagggauagaagauaugaacaaaaauauugaaaaauuuaaugacggaaaaguucaccaaccaaucaucaaaguacgaauauuugaacuuggcaguaaauucccuuuaggacaaucaggaaauaaaaaggauaaauauguagaggcagcaaaaggaacuaaucuuuuuuuugccguuuacgaagauaaaaacgggaaacguucauacgaaacaauaccacuaaacgaagugauagaacgacagaaacaaggccucacaguaguagaccucaaaggagucaaugauuuuuaccuaagccccaacgaucuaguuuauguacccucagaagacgaacuagagaauguguccaugauagauuauaacaaacucuccaaugaaaaaguuuacaaaguuguuaguuuuaccgggaaucaaauauuuuuugucagacaggacgucgcaacuucaauagucaauaaagccgaauucucaagccuaaauaaaauggaaagagccauaggcggcaccaugauaaaagagguauucguuaaaaucaagauagauagacuagguaauauauccaaaguauga

SEQ ID NO: 5696 - RNA, 4347 nt, Artificial Sequence
  Cas9 variant
augaaacacauauugggacucgaccugggaaccaauucuauaggaugggcaguaguaaaagaagcacagaacgauaacgaacaaagcgaaauaguagacgucggaguucggguaaacccauuaacuacagacgagaaaacaaauuuugaaaaaggaaaaccgauaucgacgaacgcagauagaacuuuaaaacguucagcaagacgaaauuuacaaagauauaaauuaaggcgaaaagaacuaauagaacuauuaaaagaacaccaauuaauaagugaaaauaccauccuaacagaaaauggaaaaggaacaacauuucaaacacuagaacuuagagcgaaaagugccaaagagaaaauaaguuugggagaauuggcaagaguauucuugacaaucaauaagaaacgaggauauaagaguaguagaaaagcgaaaaauggagacgaaggacagcuaaucgacggaauggaaauagcuaaaaggcuauaugaagaaaaucuaacaacgggccaguuaucacuacaacuccuuaaagaaggcaagaaaucgcuaccagacuauuacagaucagaucuacaauucgaauuagacaaagucuggaauuuccaaaaacaaucgcauuccgacauacucaccgacgaauuuuaugcccagcucaaaggcaaaggacaaagagcaacaucagcuuuauucuuagcaaaauaucagauauacaccgccgaaaacaaaggaagucgagaagauaagaaauuacaagcauaccaauggcgaguugaugcauuauccaaagaauuaacaagggaagaacuagcauuuguaauaacggaaaucaacaacaaccuaaacaacuccagcgguuaucugggggccauuagugaucgaucuaaagaauuauacuucaacaaugaaacuguuggggaauauuuauggaaacaaauagcugcaaacccucacaacucacucaaaaaucaagucuuuuacagacaagauuacuuggacgaguucgaacaaauauggaaaacacaaucugccuuuuacccggaaaucuugacagacgaauugaagaaagaauuaagggauguaguuauauucuaucaaagaaaauuaaaaucccagaaaagucuaguaucauuuugugaguucgaaaacaaagaaauagaaaucaaaaaugaagaugggacaacuaccaagaaaguaauuggcuuaaaaguugcaccaaaaucaaguccacuauuccaagaauuuaaaaucuggcaaaaucuaaauaacguguuaauucgcaagaaaggaucaaaaaccaagaaaguagccaaaaaccaacaagcaguacuauucgaagaagagaaaacaauuagugaacuggacuuagaagccaaacaagcccucuucaaugaauuaaauuuaaaaggaaaucuuaaagcagacuauugcuuggaaauacuaggauacagcccaaaagaaugggaaaugaacuauucaauccuugaaggcaacagaacaaacaaagcucuauacgaagccuauuuaaaaauaacagaccuugaaggcuaugaugcgaaaaaccaccuuaaaguaaaacugaauaaagaugaaguagaacucgaugaccuaaaaguaccagcaagcgaaauaaaagacaugguacaagcaauauucaaagaagcaggcaucaauacagacaucuuacauuucaacgccgaacucgaugguaaagauuuugaaaaucaagcaagcuaucaguuauggcaccuccuuuacuccuaugaaggcgacgauaguaaaucaggcaaugaacuacuauacaaacuccucgaaacaaaauuuggcuuuaagaaagaauaugcgcaaauccucgccaaugugucauuaagugacgauuaugggaacuuaagcaccaaagccaugagagaaauaaucacacaucuaaaacaaggcuuuccauucacaggucgaaaagaccgcccagacgaaccuucagcuugugaauuugcaggauacaaacacuccaaacacagucugacaaaagaagagaacgagaaacgcguacuaaaagacaguuuggagguccuaaagaaaaacucacuaagacaaccaguaguagagaaaauuuugaaucagaugauaaaucuaguuaacgcacuacuaaagaaauacagaacagaaaauccaaacuucaaauucgacgaaauucgaauagaacuagcaagagagcucaaaaagaaagcagaagagagagcgaacaugacagcuaauaucaacaaagcaaaaacagaacacgagaaaauaaucaaaauacucaaaaacgaauuugggcuaccgaauccaaccaggaaugacauaauuagauauagauuauacgaagaguuaaaagauaacggcuacaaagaucuauauaaaggugacuacaucccaagagaaaaacuuuucaguaaagaaauugauauagaacauauaaucccgaaagccagaguauucgaugauucauucucaaauaaaacgauuacuuaucgaaaaacaaaucucgaaaaaggcgaaagaacagcguacgauuacauagaaucucuaggcgaaaaacaauuagaagaguuccugucaagaauagaaaauuuauaugaaauagggaaaccaucaagacuacacaauagaagaaacccauuaaagaaaguagaagagaaagggauauccgacagcaaauauaaaaaguugcuaaagaaagaaucagaaauaggggacggauuugucgaaagagauuuaagggaaacccaauacauagcaaagaaagcuaaagaaauauuacuacagauaaccagaagugucuuaucaacaucaggcggaauuacagaccgauuacgugaagacugggaucucaucaauguuaugaaagaacuuaacuuaccgaaauaccgggcauuaggucugacaaaaauggaagacagaaaauacggucaacaaguugaaguaauuacagacuggacaaagcgaaaugacuugagacaucacgcuauggacgcacuaaccguggcauucacaaaacauaaccacauacaauaccuaaacuacuuaaaugcccguaaaaaugaaaaacacaaagaacauaauaauauaauggcaauacaacaacucgaaacgauuaaaguuacagacgaaaacggaaacgagaaaagaauauuuaaggcuccaaugccaaauuuuagacaaguagcaaaagcauuucucgaaaacguauuaauuagccauaaagcuaaaaauaaaguuguaaccaaaaacaaaaauaaaauauccggcaacaacaaaguccaagaagugcuuaccccaagagggcaacuacacaaagaaacgauauacggcaaguaucaauauuauguccaaaaagaagagaaaauugguggaaaauucgaccuggaaacaauugaaaaagucgcgaacccacucuaucagucacuacuuaaaaagagacucgaagaaaacggaggggaccccaagaaagccuuuaccggcaaaaauagccuagcgaaaaauccaauauaccuagacgaagcucaaacagaacaacuacccgaaaaaguaaaacuuguaugguuagaaaauuccuucaguauacgaaaagacauaacgccagaaaauuucaaagaugaaaaacugaucgacaagauacuagacgaggguguaaagcgaauacucaaagaacgauugcagucauucgguaaugacgccaagaaggcuuucucagacuuagagaaaaaucccaucuggcuuaauaaagaaaaaggaauagcaauaaaaagggucacgaucucaggaguagcaaaugcugaaccacuacacaccaagaaagaccaucucggcaaagaaauacuagacaaagaaggaaaaccuauuccgguagacuucauauccaccggaucgaaucaccacguagcaguauacagagacgaaaaaggaaaccuacaagaaaaggucguaucaguauucgaagccgugguuagggcgaaccaaggauuaccaaucaucgacaaaacguacaaccaauacuuagggugggaguuccucuuuuccaugaaacaaaaugaaauguucguguucccaaacgaaagcacgggauucaauccaaaugacauagaccugcuagauccgaaaaauaagaaaauuauuuccccuaaucuauuccgaguacaaaaacuagcgacaggggauuauugguucaggcaucauuuagaaacaacaguagaaacaaagagcgcaacaaaagacaugaccuacaaacguuuaucauuaaaccauaucaaaaacaucauuaaaguuagaauaaaccaucuuggugacauaguaaguguaggggaauauuga

SEQ ID NO: 5697 - RNA, 4353 nt, Artificial Sequence
  Cas9 variant
augaaacauauauuaggacucgauuuaggaucuaacuccauaggaugggcguuuguacaacaagauuuugaaaacaaacaaggaaaaauaauagcaacagguaguagaaucaucccgauggaucaaggcauucuuggagauuuugaaagaggaaacacuguaucucaaacugcagaaagaacuacauacaggaauacuagaagacuuagagaaaggcaccuacuaagaagggaacgacuucacagaguauugcacauacuagguuuucucccuccacauuaugacagucaaauagauuucacgaaacgauacggcaaauuuauugacaaugccgaaccaaaaaucgcuuacaauaaugguaacuucauauuuaugaacaguuuuaacgagaugauagaagacuuuaagaaauaccaaccucaacuauuuuacaagaaauccaauggagaagaaucaaaaauaccauacgacuggaccauauauuaucucagaaagaaagcacuaagccagaaaauaacacaacaagaacuggccuggcuaauuuuacauuuuaaccaaaaacgagguuauuaucaacuuagaggagaagaagaaacugaaaauccaaauaaagaaguggcauuucauucauuagaaguaguagauguagaagcggaagcaccgaauaagaaaggagaaauuugguacacgauaagacuagaaaauggauggaucuacagaagaaccucaaaaauuccucucgaugauuggaaaggcaaaacaagggacuucauuguuaccacagaucuaaaugacgacgguacaauuaaacuagauaaagaagggaaagagaaaagaucguuucgcgcuccagaugaaaacgacuggaaccuacucaaaaagaaaacagaacacgauauugauuucaguggcaaaacaguaggagcguacauauaugaucaccuacugcaaaauccaaaucagaaaauaaaaggaaaauuaguaagaacaauagaaagaaaauacuauaaagacgaacucaaagcaauauuagcaaaacaaauagcacuacaaccagaacucuuuacagaaacccuucuagcagacugcaucagagaacuuuacaggaaaaacgaaacacaacaacaaaauuuauuaagcaaagacuuuuuacacuuauuuguagaagacaucauauuuuaucagcgaccacuaagaucaaagaaaucuacuauagcuaauugcacauuagagaaaagaaguuacauagauaaagaaacaaaugagagaaaagacacaccaauaaaggucugugcuaaaagcaacccauacuaucaagaauuuagagucuuacaauggcuacagaaccuacgcauauacgaaauagaaacugacagagaagucacggcagaauuuaucgaaacagcacaggauaacgaggcacuuuucaacuucuuaaugagccaaaaagaaauagacaaugagucuuuacuaaaauacuucuuauucgcgaaaaacccccaaaucaaagauaaaguagcaaaaucagaauuaaagaaaugguuaacaacauauagauggaacuacguuuacgaugcagcagauaacagcagcaagaaauauccaaugaacgaaaccggauaugaauuacaacaauaccuacaaaaaguggagggauuaccagccaacuuucuaaccuucgacauaacauauagacucuggcacuuacuauauucaguaaaagacaaaguugaauuugaaaaagcccugaagaaauuugcacaagaauaccaacuugacgaagcaucauucguagauagcuuuaaaaacuucaaaccauauccaaacgaauacggaucuuucagcgaaaaagcaaucaagaaauuacuaccacuuaugagauucggaaaccacugggacuuuaaccguaucgacguaucaacccagaaaagaauagaugacuuaauuaacggggucgcaaaugacgagauccguacgauaauccgcgagaaagcagaaaaauaccaacuaaacagcgaaacauguuuucaaggacucccccuauggcuugcccaauauguagucuauaacagacacgccgaagcagcagacaucgaaaaauggaccagcguaaacgaccuagaagccuacuuagaagacuucaaacaacauuccuuacgaaauccaauugucgagcaagucauaacggaaacucugcgaguaguaagagauauauggcaaagauacggagguggucaagcaaacuucuucgacgaaauucacauagaauuaggucgcgaacuaaagaaaacugcagaagaacgaaagcaacucucaaaccgaaaccaggaaaacgaaaacaccaaccuacgaaucaaaaaguuacuagcggagcuaaaagaagacgcgucaauacaaaauguaagaccuuauagcccgguacaacaagaacuauuaaaaauuuaugaagaagguguauucucugcgacggaugaaguagaagaagacauacagaaaauuagaaagaaagccgaaccaacaaccccagaaauacagcguuacaaacuauggcuagaacaaaaauacaaaaguccauauacaggagaagugaucucccuuacaaaauuauuuacagaagaauacgaaauagagcauauaauuccccaaucgcguuauuaugacgauagucuuucaaauaaaguaauuugugaaucugcaguaaauaaacucaaaacaaaccaauuagggcuugaauuuauucaaaaucaucauggcgaaaaaguacguaucacagccaauaaagaaguaacuauauucacagaagaacaauauaaagaguucgucaagaaacauuaugccaauaacagcgcaaaacaacaaaaauugcugcuaaaugaaauuccagagaaaaugguagcaaggcaauuaaaugacacacgauauaucucaaaauauauaagcgaaauacuaucgaaaauaguuagaucagaugaaaaagaugagggugugaauagcaagaauaucauuccgugcaccggaaaaauaacgacagcccuuaagcaggauuggggucucaaugauguauggaacgaacuaauuuuacccagauucgaaagaaugaaucaauuaacacaaacucaauuauuuacaagcuacaacgacagguuccagaagaacuuaccaacugugccaauugaauacagccaaggauuccagaagaaacgaauagaucaccgucaucacgcaauggaugcucugguaaucgccugcgcaacaagagaacauauuaacuauaugaauaaucaacacgcccuagauaaaucaaaagauaagaaagaaaaacaacaaucacgaauagaucuucgcacaaucuuaugugagaagaaaaauaauaauuggcaauucaagaaaccuuggucaacauucacucaggaagcacaggaagcauuagaacauauuguaguaaguuucaaacaaaaccuccgcgucauaaacaaagcaacaaacuacuaugaaaaaugggaagagaaaaaugguguauuagucaaaaagaaaguaaaacaagaaggcacaaauugggcaauaaggaaaccguuacacaaagaaacugugagcgggaaaauaguauuggaccgaaaaauaggcaaggacaaaauucuuacagcaacccgaaaaucuguagauauaacuuuuaccgagaaaauuaucucaaguauaacagauacagguauccagaaaauucucuuaaauuaccuuaaguauaaaggcagcccggaaguggccuuuuccgccgaaggacuagaagaacuaaacaaaaauaucgcacaauauaaugauggaaagaaacaccagcccaucuacaaaguuagaauuuuugaagaaggaucaaaauuuccucuuggagaaacaggagcgaaagcaacaaaauauguagaagccgcaaaaggaacaaaccuauucuuuggcguauaucaaggcaaaggaaaaagaacauaugccaccaucccucugaacgaaguaauagaacgucaaaaacaaggauuaccaucagugccagaacguaacgaaaaaggagagcccuuacuauuuucauuaaguccuaaugaccuaguuuaugucccaauggagggagaaauagcugaaacaauagauuucaacaauuuaaguaaagaacaaaaagaacgcauuuauaaaacugucagcuucacaggaaaccaauguuucuucguacaagaagcaguagcuacaccaauuguaaauaagauagaauacagcccacuaaauaaaauggaaagagauauacugggcacaaugauaaaagaaguguguauuaagcuaaaaguugaucgacuaggaaauauuacuaaagcguga

SEQ ID NO: 5698 - RNA, 4353 nt, Artificial Sequence
  Cas9 variant
augaaacgcauacuaggacuagaccuggguucuaacucaauaggcugggcauucguagaacaagauuuugaaaauaaacagggaaaaauaauagcuacagguucuaggauaauaccuauggaccaaggaauauuaggugacuucgaaaaaggaaacacagugucacaaaccgcagaaaggacgacauacagaagcaugaggagauugagagaacgacauuuauuacgacgagaaagauuacacagagucuuacacauucuaggauuuuuaccaccacacuaugacgcucaaauagacuucacaaaacgguacggaaaauucauagacaaugcagaaccuaaaauagcauacaauaacggcaacuucauauuuaugaauagcuuuaacgaaaugaucgaagauuucaaaaaauaccaaccacaauuguuuuauaaaaaaucaaacggugaagaaaguaaaauaccuuaugacuggaccauauauuaccuaagaaaaaaagucuugucucagaaaauaacucaacaagagcuagcgugguuaauauuacacuucaaccaaaaaagaggauauuaccaacuaaggggcgaagaagaaacagagaacccuaauaaagaaguggcauuucacaguuuaaaaguaguagaugucgaggcugaagccccaaacaaaaaaggagaaaucugguacacuauaagauuagaaaacggauggauauaccgaagaacaucaaagauaccacucgacgauuggaagggcaaaacaagggauuucaucguaaccacagaccuaaacgaugacgggaccauaaaaguagauaaagaagggaaggaaaaacgcagcuucagagcacccgacgaaaacgacuggaaucuauuaaaaaaaaaaacagaacaugauauagauuucucaggaaaaaccguaggagcauauauauaugaucaccuauuacaaaacccaaaccaaaaaauaaagggaaagcuaguccgaacaauagaacgaaaauauuacaaagaugagcuaaaagccauauuagcaaaacaaaucgcacuacaaccagaauuauuuacugaaacccucuuagccgacugcauuagagaguuauacagaaaaaacgaaacacaacaacagaauuuacuuaguaaagauuuuuugcauuuauuuguggaagacauuauauucuaccaacguccuuuacgauccaaaaaaagcacuauagccaauugcacacuagagaaaaggucuuauauagacaaagaaacaaaugaacgaaaagauacuuucauuaaaguuugugcaaaaaguaacccauauuaccaagaauuuagaguacuacaauggcuacaaaauuuaagaaucuacgagaucgagacagaucgcgagguaacagcggaguuuaucgaaacugcagaagacuacgaagcguuauucaacuuccuaaugagucaaaaagaaauugacaacgaaggacuacuaaaguauuuccuauucgcaaaaaacccccaaaucaaagacaaagucgcaaaaucagaacuaaaaaaaugguuaacaaccuacagguggaauuacguguacgaugccgcggacaacaguagcaaaaaauaucccaugaaugaaaccggauacgaucuccaacguuaccuacagaaaguagaggggcuaccagcuaacuucuuaaccuucgacauaacauaccgccuauggcaccugcuguauucgguaaaagacaagguugaguuugaaaaagcacuaaaaaaauuugcacaagaauaccaauuggacgaagcaagcuuuguggacuccuucaaaaacuucaaaccauaucccaaugaauacggcagcuucucggaaaaagcaauaaaaaagcuuuuaccauugaugcguuuugggaaucauugggacuucaacagaauugauguuaguacccaaaaaagaauagaugaucuaauaaacggaguagccaacgaugaaauaagaaccauuauuagagaaaaagcagagaaauaccaacuuaacucagaauccugcuuccaaggacuaccucuauggcucgcccaauacguagucuacaaccgucaugcugaagcgaccgacauagaaaaauggacuucuguaucugacuuagaaacguaucuagaagacuuuaaacagcacagcuugagaaacccaauuguagagcaaguaguaacagaaacucuucgagucguacgggauauauggcagcaauauggugguggacaagccaauuucuuugacgaaauucacauugagcucgggagagaacuaaaaaaaaccgcagaggagcguaaacaauuauccaacagaaaccaagaaaacgaaaacacgaaccuucggaucaaaaaacuuuuagcagaacucaaagaggacgcaucgauccaaaauguucgaccuuauucaccagugcaacaagaauuauuaaaaauauacgaagaaggaguauucucauccacagaccaagucgaagaagauauacaaaaaauuagaaaaaaagcagaaccuaccacacccgaaauacaaagauacaaacuguggcuggaacagaaauauaagucaccauauacaggagaaguaauaucucuaacuaaacucuuuaccgaagaauaugagauagaacauauaaucccacagagucgauauuacgacgacaguuugagcaauaaaguuauaugcgaauccgcaguaaacaaauuaaaaaccaaccaacuaggccuagaauucauacaaaaccaccacggugaaaaaguacguauaacaggaaauaaagaaguaacuaucuuuacggaagaacaguauaaagaauuuguuaaaaaacauuaugccaacaacagugcaaaacaacagaaacuucucuuaaacgaaauacccgaaaaaaugguagcgcgacaacugaaugauacacgauacauaaguaaauacauauccgaaauccucaguaaaauaguaagaagcgaugagaaagacgaaggggugaauagcaaaaauguaaucccaugcacaggaaaaauaacaacggcacuaaaacaagauugggggcuaaacgacguuuggaacgaacuaaucuuaccaagauucgaaagaaugaaucaacuaacacaaacacaacuauuuacaucuuauaaugaccgguuucaaaaaaaucuaccaacagugccaauagaauauucucaaggcuuucaaaaaaaaagaauagaccacaggcaccaugcaauggaugcuuuggugauagcaugcgcgaccagggaacauauaaacuauaugaauaaucaacaugcacuagauaaaaauaaagauaagaaagaaaaacaacaaagcagaauagauuuacgaacaauauuaugugaaaaaaagaacaauaauuggcaauuuaaaaaaccauggucaaccuucacccaggaaacaaaagaagcuuuggagcauauagucguuagcuucaaacaaaauuuacgagugauaaauaaagccaccaacuacuacgaaaagugggaagaaaaaaauggaguccuuguaaaaaagaaagucaaacaagaaggcacaaacugggcaauaagaaaaccccuacacaaagaaacggucagugguaaaauagucuuagauagaaaaauagguaaagacaaaauacuuaccgcaacacguaaagagguagacaucacauucacagaaaaaauaauauccucaauuacagacaccgguauccaaaaaauauuacugaacuauuuaaauuacaaagguucccccgaagucgcuuucagcgcugaaggacucgaagaauuaaacaaaaacauugcgcaauauaaugacggaaaaaaacaucaaccuauauacaaggucagaaucuucgaagaaggaucaaaauuuccacuuggggaaaccggagcuaaagcuacuaaauucguagaagcagcaaaaggcacaaaucuuuucuuugggguauaucaagguaaagaaaagcgaucauaugcaacuaucccucuaaaugaaguaauagaaagacagaaacaaggauuaccuucaguaccugagcgaaacgaaaaaggggaaccacuccuuuucagucuaucaccaaacgaccucgucuacguacccauggaaggagagaucgcagagacaauagacuucaacaaucuaaguaaagaacaaaaagaaagaauauacaaaacggucucguucacaggaaaucaauguuuuuucguucaagaggcggucgcaacuccaauaguuaacaagauggaauauaguccauuaaacaagauggaaagagauauacugggaacgaugauaaaagaagucuguauaaaauuaaaaguagaucgucuaggcaacauaacaaaagccuga

SEQ ID NO: 5699 - RNA, 4353 nt, Artificial Sequence
  Cas9 variant
augaaacauauauuaggcuuagacuuaggaucaaacaguaucggaugggcauuuguacaacaagacuucgaaaacaagcaaggaaaaauaauagcugcuggcuccaggauaauuccaauggaccagaaaaugcuaucaaauuucgaagaaggcacaacaguaagccaaacugccgaaagaaccaccuaccgaucgaugagaagacuaagagaacgccaccuacuacggagagaacguuugcauagaguacuucacauucucggauuuuuacccccacauuacgacgcucaaauagacuucacaaaacgauacggaaaguuuauugauaacgccgaaccaaaaauugcguacaacaacggaaacuuuauauucaugaauucauuuaaugaaaugauagaagauuucaaagaacaccagccccaacuauucuauaaaaaaagcaacggagaagaaucgaagauaccauacgauuggacaauauacuacuuacguaaaaaagcccuaagucaaaaaauuacacagcaagaacuugcuuggcuaauacuacacuucaaccaaaaaaggggauacuaucaauuaagaggcgaagaagaaaccgaaaauccaaauaaagagguagcauuucauucauuaaaaguaguagacguagaagccgaagcccccaacaaaaagggagagauaugguauacaauaaggcuugaaaaugguuggauauauagaagaacaagcaaaauaccgcucgacgauuggaaaggaaaaacacgcgauuuuaucguuacaacagauuuaaacgacgacggaacaauaaaacuggauaaagaaggcaaagaaaaacgcaguuuuagagcaccugaugagaaugauuggaaucuauugaagaaaaaaacagaacaugacauagauuuuagugggaagccuguuggaaccuacauuuacgaccaccugcuacaaaacccaaaccaaaaaauaaaaggcaaauuaguacguacaaucgaacgcaaauauuauaaagacgaauuaaaagcaauucuagcaaaacaaauagcccuacagccugaacuuuuuacagaaacauugcuagcagauuguauaagggaacuauaucguaaaaaugaaacccaacaacagaacuuacuaagcaaagauuuucuacaucuauuuguagaagacauaauauucuaccaaagaccccuccgcagcaaaaaaagcacaaucgcuaacuguacccuggaaaaaagaagcuauauagacaaggaaacaaacgaacgaaaagacaccccaauuaaaguauguucaaaaucaaacccguauuaucaagaauuuagaguuuuacaauggcuccaaaaucuccgaauauaugaaauagaaacugacagagaagugacugccgaauuuauagaaaccgcacaagacuaugaagcucuauuuaacuuccuaaugucacagaaagaaauagauaaugaaucucugcuuaaauacuuccuauuugccaagaacccccaaaucaaagacaagacugcaaaaauagagcucaaaaaauggaucacaacauauagauggaauuacgucuacgacgucgcugacaacucauccaagaaauacccaaugaacgaaacaggauacgacuuacaacguuauaugcaaaaaguugaaggcuuacccacaaacuucuuaacguuugauacaacauaucgacuguggcacuuacucuauucaguuaaagauaaagucgaauucgaaaaagcacuuaagaaauuugcaaaaaaaaaacaacuggauaaaacaucauuugucgacuccuuuaagaauuuuaaacccuauccaaaugaauacggcuccuucagugaaaaagcaaucaaaaaauuacuaccuuuaaugcgauuuggaaaucauugggauuucaauagaauugacguaucaacgcaaaaaagaauagacgauuuaauaaacggaguagcgaacgaagauauccgaacaauaauucgcgaaaaagccgaaaaauaucaacugaacucggaaacaugcuuucaagauuuaccacuauggcuugcccaauaugucguauauaauagacacgccgaagcuacugacaucgaaaaauggacaucaguaagcgaucuagaagccuauuuagaagauuucaaacaacauagccuaagaaacccuaucgucgaacaaguaguaaccgaaacgcuucgcguaguuagggacauauggcagcaauauggugggggacaagcaaauuuuuuugaugaaauacacauugaguuaggcagagaauugaaaaaaacugcggaagaaagaaaacagcuauccgacaaaaaucaagaaaacgagaacacgaaucuaagaauaaaaaaacuccuugccgaacuaaaagaagacgcaaguauucaaaacgucagaccauacucacuaguacaacaagaauugcuuaaaauauaugaagaggguguauuuaguucaacagaugaaauugaagaagauauacaaaaaauacguaaaaaaguagaaccuacaacaccagaaauucaaagauauaaacuauggcuugaacaaaaauauaaaucaccauauaccggagaagugauaucauuaacaaaacucuucacagaagaauacgaaauagaacauauaauaccacaaagcagguauuacgaugauaguuuaucuaauaaaguuaucugcgaaagugcaguaaauaaacugaaaacuaaucaauuaggacuugaauucauacaaaaccaucacggcgaaaaaguacgcauaacagccaauaaagaagucacaauauucacugaagaacaauauaaagaauuuguaaaaaagcacuaugcuaacaacucagcaaaacaacaaaaauuacuauugaaugaaauaccagaaaagauggucgcgcgacaacuaaaugauacacgauacauaucaaaauauaucuccgagauacuaagcaaaaucguaaggucugacgaaaaagaugaggggguaaacagcaaaaauauuauucccugcacgggcaagaucacaacugcacuaaaacaagacuggggacuuaacgauguauggaacgaauuaauccuacccagauucgaaagaaugaaucaauugacacaaacacaacuuuucacaucuuauaaugaucgauuacaaaaaaauuugcccacagucccgauagaauacucgcaaggcuuccaaaaaaaacgaaucgaccaccggcaucacgcgauggaugcccuggucauagcaugcgcaacuagagaacacauaaacuacaugaauaaccaacaugcauuagacaagucgaaagauaaaaaagaaaaacaacagagcagaaucgaccuaagaaccaucuuaugugaaaaaaaaaacaacaacuggcaauucaaaaaaccauggaggacauucacacaagaagcaaaagaagcguuggaacacauaguaguaaguuuuaaacaaaacuuaagaguuauaaacaaagcaacaaacuacuacgaaaagugggaagaaaaaaaugguguucugguaaaaaaaaagguaaaacaagaagggacaaauugggcaauacgaaagccgcuacacgaagaaacauucucaggaaaaaucucacugaaucgggagaaagucggaaaagguaacaucuuaacugccaccagaaaagcaguugauucaagcuuugacguuaaaaaaauaagcaaaauaaccgauacggggauacaaaaaauauuacucaauuauuuaaaauacaaagguuccccagaaguagccuuuucugcugagggacuggaagaacucaacaaaaauauugcgcaauacaacaacggaaaaaaacaccaacccauauauaaaguacgaauuuacgaaaagggcucaggaagauucguccuaggagaaaaagggacaaagucaaaaaaauacguccaaggggcaccuaaccuauauuuuggcguauaucaaggaaaagaaaaaaggaccuacgcgaccauuccgcuaaaugaaguaaucgaaaggcaaaaacaaggacuacccagcguuccagaacggaacgaaaaaggggaacccuuauuauucucgcuaucucccaacgaccuaguauauguaccaauggaaggagaagcuacggaaacaaucaauuucaauaaccuaaauaaagaacagaaagaaagaauauauaaaaccguauccuuuacaggcaaucaauguuuuuuuguacaagaagcagucgcaagcccuauaguaaauaaaauggaauauucuccauuaaauaagauggagagguccauagugggaauaaugauaaaagaagucuguauaaaacuaaaaguagacagacuugguaauauuacaaaagccuga

SEQ ID NO: 5700 - RNA, 4362 nt, Artificial Sequence
  Cas9 variant
augaaaacaguacuaggucuggauuuagggacgaauaguauuggaugggcacuuauacaacacgauuuugauaguaagaaaggagaaauacucgguaugggaagucguauaauaccuaugucacaagacauacuaggcgaguucggcaaaggaaauuccguaucacaaacagcugacaggacaaaauucagaucagcacgcagacuuagagaaaggcacuuauuacgcagagagcgccuacacagaguucuuaauauacuuggauuccuuccacgccauuacgcagccgacauagacuuugaaaaacgacuaggacaauucuucgaaggaaaagaaccaaaauuggccuaugauaauaaucaauucauauucacaaaaaguuucgguaaaauguuagcagacuuucgccaacaucaaccagauuuucuaaaagacgaaaaaucaaaugaucuguuaauaccauacgacugguccaucuacuaccuccgaaaagaagcccuuacuaagaaaauugaaaaagaagaacuagcauggauaauucuaaacuuuaaucagaaaagggguuauuaucaauuacgaggagaagaagaagaagaaaaccuuaauaagcuaguggaauuucacucccuaaaaauuauugauguaguagcagacgaaaaacuaaauaauaaaggagaaaccugguacucacuccuccuagaaaauggauggacauauagacgaucuagcaaaguaccauuauucgacuggaaagaaaaaguaagagauuuuauuguaacaacagacauaaaugacgacgguucugucaaaacagacaaagaaggaaaugaaaaacggucguucagagcacccucagaugaugauuggacacuucucaaaaagaaaacggaacaagacauugacaaaucacgaaaaccuauaggugcguauauauacgaugcuauauugaaaaaucccaaacagaaaauuaacggaaaacucguucgaacaguugaaagaaaauuuuacaaagaagaacuaaaauuaaucuugcaaaaacaaaaagaauuucacccagaacuccaaucuacagacuuauacaacgaauguauucgggaacuauacaaaaacaacgacgcacaccaacuccaauuaaauaagaaagacuucguccaccuauucuuagaagauauaauauuuuaccaacggccacuucggucucagaaaucaucuguuggcaacugucccuuagaguuccgcaaauuuaaagacucugaaggaauugaaaaaguagaauaccuuaaaacaauuccaaaaagcaacccauacuuucaagaguuccguauauggcaauggauguacaaucucucuauauacaagaaagacgaugacgaaaacguaacaagagauuuccuaaaaacaauagaagacugggaagauuuauuugaauuucuuaaccauagaaaagauauagaacaagaaacacucuuaaaauuucuacuagguaaaaacggcguuaaagguaaagccuugaaaguagaagcaggaaaauucagauggaacuacguaucagauaaaauauacccuuguaacgaaacuaaagcacuuauaauuucgaaacuagaaaaaguaaaaggcgucgaagaaaaauuuuuaacugaagaaauagaauauaaauuauggcaucuaauauacucagugacagacaaagucgaauaugaaaaagcucuuaaagcauuugcuggaaaacaaaaauuggauuuaguaucauuuguagacagcuuuaaacgauucccacccuucaaaaacgaauacggugcauacagcgaaaaggccauaaagaaaauauuaccacugcucagaacaggaaaaucauggaacuggauggccauugauaguaaaguucgagacagaauaaauaaaauuauaacaggagaauuugaugaagaaaucaaaaacaaaguaagagaaaaagcggaaaaacacucccugaagaaagaaaaugacuuccaaggauuaccccuaugguuagcacaauacgucguauauggucggcacucugaagcaucauucucugggaaauggaacucaguagaugaucuuaagaaauaucuagaagaguucaaacaacacucacuucgcaaucccauuguagaacaaguucuaacagaaacacuucgaguaguagcagauaucuggcaauucuacggaaaaggugaaaaagacuuuuucucagaaauccauauagaacuaggcagggaaaugaaaaacacugcagaagaucgaaaagaaaugagugcuauuauacaagcgaacgaaacgacaaaccuaagaauuaaagccuuacuaaaugaacugcuacaagacaagaaagucgaaaauguaaggccauacucccccucacaacaagaaauacugaaaauauacgaagacggagugcuaucaucagauaucgagauaccugacgacauucagaaaauaucgaaagcugcucaaccgacaaaaucagaauuacaaagauacaaacuauggcucgaacaaaaauaucgaucaccauacacaggagcaaugauaccacucgggaaauuauuuacaagugaguaugaaauagaacacauaauuccacaaucccuauauuucgacgacucauuuucuaauaaaguuaucugcgaauccgccguaaauaaauuaaaagauucgaggcuaggaauggaguucauaaaagaaugccauggaaugguuguggaaacaggauuuggaaaaucaguaacaguuuuugaagaagaaacguacagagacuuuguuguccaaaacuacagcaaaaaucacucgaagaaaucaaaacuccuccuagaagaaauaccugagaaaaugaucgaacgucaaaugaaugauacaagguacauaagcaaauucaucaguucuguccuaucuaacauaguacgagaagaaguaaacgaugauggcguaaacuccaaaaacauagucccuggaaacgggaaaauaacgacgcaauuaaaacaagacuggggacugaacgauauauggaacgaacugaucuugccucgcuucgaacgcuuaaauguacuaacagacucaaaacauuuuacagccuggucagaaaaucaccaaagauugcuuccgacgguuccuauaggauuaagcaaaggauucagcaagaaaagaauugaccacaggcaccaugcauuagaugccuuaguaauagcuugugcaucacguaaccauaucaauuuccuaaacaaugcacacgcuauagacaaaaagaaaaacagugaggaaaaacaaaaauuuagacacgaucuaaaagccauucuaugcgauaagaaauacagugauaaaucagaaaagaacuaucgauggauauuuaagaaaccaugggacaacuucacgauagauagcaaaaacgcucuagacaaaauaauagucagcuucaaacaaaauuugagaauaauaaacaaagcaacaaauagauacgaaaaauggguagacagagaugguauaaaaguaaaagaauggcauaaacaagaaggcauaaacugggccacucguaaaccacuacauaaagacacaguaaguggaaaaguagauuuaaaacgaguaacgguaccagaaggaaaaauacucacagcaacaagaaaauccuuagauacauccuucgacuuaaaggucaucgaaucaauaacugacacagguauccagaaaauacuaaagaacuauuuaacaucaaaauccaacaacccagaacuggcuuucagcagugaaggcguagaggauaugaauaaaaauauaagaaaauacaacgacggaaaacugcaccaacccauuuauaaaguacgaaucuuugaacugggcucaaaauuuccacuagggcaauucggaaacaagaaauucaaauauguugaaacagcuaaaggaacaaaucuauucuuugcaguauacgaggacgaaaauaaaaaccgaaauuaugaaacuauaccacuaaacguagucauagaacgccaaaaacaaggucuauccuccguacccauuaagagcgaaaaaggacauaaacucuuauuuuacuugucuccaaaugacauuguguacguaccuggcuccaaugaagaauuuaguauagacagauuauacagauuuaccgacagcagcgacaaaacagcuaauuuuauuccauuaucaguuucuucucuaauauuuucaucuaauaaaaacgaacaaaagaaaauaggaauuagcuauccgauacaagacgaguucggauuagguuccccgcaaagcaaaaaucaaaaaucaauagauggaaucaugauaaaagaaaagugcguaaaaguaaauauugacagauuaggaagaguaucauucuga

SEQ ID NO: 5701 - RNA, 4368 nt, Artificial Sequence
  Cas9 variant
auggcaaaaauucucgguuuagaccuaggcacuaauaguaucgguugggcuguaguagaagaccaaaauaacaaaaccaccuuaauagacaaaggaguuagaaucuucuccgaaggagugaaaauagaaaaaggcauagaaaagucuaaagcagcugaaagaacugauuucagaagugcacgcaaaaucaaauucagacguaggcuaaggaaacaagagacccuaaaaguccuaauagaaaacaacauguguccccucacaauugaagaauggaccaaauggaaaaaagacaaaaaagaguauccgaaaaacccugacuuuauuaacuggcuaaaaacagaugagcuuaaaaacauaaaucccuauuuuuucagagacaaggcuaguagaacagaauuaccucuaaugcaaacagguagggcacuauaccauuuggcccagagacgcggauuucuaucaaauagacuagaccaagggagcgauggauuuacggagcaaaucagauuagaucuaauaaaaaagauagaaugugaaaccgauaaaacagaauuacuaacaucaguacaaucuauaauagauaccuauucagaagaagaagacaaagacgcaaagaaacugcuaaaaggcguugagaaauuaugcaaaauaaacaaugaacuaccaauaaccgaauuuaaggaaaagcuuaucaacuaucuaaauaaagccgacaauuuaggugcuguaaaaaaaggaauagcggaugugaguaaaaaaaucacagaaaccgguugcgaaacuuuaggucaauacuuuuacaaguuguaccaaaaccaaucaaaaauuaggaaaguuuauacagcaagaaccgaacacuauuaucacgaauuccuaaaaauaugugagacacaaaauaucugugaccaacugaaacauaaacuagauaaagccauuuuuuaccaacgaccacucaaaagccaaaaaggacuuauaggcaaaugcgucuuugaaaaaaacaaaacacgaugugccguaucacacccugcauacgaagaauacagagcauuacaauucauaaauaguauaaaagucagcgaaacaaaagacggaaaaaaagacuuucuuucuuuugacgaaagaaaaaaaauauggcccaaguucauuagaaaaucaaaaccaaauuucgacuucaaagaaauagcggaaacacuagacaaaaaaggauuaagucguuauuauaauuacacaggacacaccucaguaucgggcugcccaacaauugcacaauuaacaaauauauucggggaaaauuggcaagaaacacuuuucgaaaaauacacuaauaagcaaaacacaaaggguuuaaaaaccaucgacgaggucguaacggauauauggcaugucuuauucacauuugauaaagacgaaaaaauaauagaauucggaaaacaaaaauugggacuaaacgagguauuagcaaaaaaauucggagcuauaaaccuaaaaaaagacuaugcaaguuuaucacuaaaagcaauaaauaaaauauuaccauaccuacgagaaggacugauauacucuuacgcuguauuucucgcaaauauagagaaugugguuggagaagaaauauggaaaaaugacgaaaacaaaaaucuuauaaagaaggaacuacauuuacuaaucgauaacuucaacgaaauaaaaggacuggaagcaguaguaaaugacuuuauagccgacuucaaaaaagaauacaacaacgcacacaaggauuacguauuagacgagcaagacaaaaaaauacuccuagaaaaaauagagucaaauuauggaaaaaauaaauuugaaagcuuagaacccgacaagaaaacggaaauaauaaacaguaccgaaaaaaugguagccgaacaacucagaaaacaaagaggagaauucauaaaaccaaaacgucuagaugaaaaaauaagugaauuccucauaaauaauuucaacguaaccaaaaaaagcauagcaagauuauaucauccgagugauguagaaaucuucaaaacggccucacgaaauagugaaggacuucugcuccuaggcagcccaauaguuucuucaauuaaaaacccuauggcuaugagagcgaugcaccaacuacgaaaacuaguaaauacucuaauaaaagaaaacauaauugaugaagaaacaaaaauaaauaucgaauuagccagagaauuaaacgacgcaaacaagagagccgcaauaaaaaaauggcaagacgaaaggcaaaaagcacgagaagaauacaaaaaaucuauaaaagaguuauucaaggcagagugcgguaaagacauagaaccuuccgacagugaaauucucaaauacgaacuaugggaagaacaacaacauaucugcauuuauacaggaaaaacaauaaauauaugugacuuuauaggagcaaacccaaauuuugauauagaacauacaauaccaaaaucacucugcuuugauaacaguaacgaaaacuuaacucuaugcgauauccaauauaaccgugacguaaaaaggaacaaaaucccuaccgaauuauccgauuauaauagcauaaaaccaagauuggacaaguggcuaguauuuaucgaugacuacgaaaaauuauauaauacacgaaaaaaggcaaagggaaucgaaacaaaagaacaaaaagacaaaagaauaaaagagaaacacuacuacaaacugcacuuagauuauuggaagggaaaauacaaacgauuuauuaugguugacguucccucuggauuuaagaauagucaaauaguagacacuggcauaaucacgaaguaugcuauaucauauaugaaaucgauauuucccaaaguauacucuguaaaaggaaacauaguagcagaguucagaaaaauaugggguuuacagaaugacuaugaaaaaaaggaaagaguuaaucacguacaucauugcauugaugcaaucacuauagcaugcaugucuaaacaaaaauaugacacacuggcgaaaauauaccacgaagaugaagcuggauuccauaaaauaaaaaaagaaacacaacuaguaaguaagccuuggacaucauucacaauggauguccuaaacaucgaaaaagaaaucuuugugucacaccacacucccgacaauaugaaaaaacaaucaaaaaagguaguucgugaacgagguauaauagcaccaaaagugauuuacgaaacagacgcuaacaauaacacccuacgagauaaauauggcaaaaaaauagucaaagaauauauacuucuaaaagacguaaauggaaacuuaaucccuaucaaagggaaaagauuaaccccaagcgauauuauuaacaaaguugauggaauugauuacuucaguuugauaaucaacgacaaaauacaauauuaugaauucgccaaaucaaaaaaaacagguaagauaauauacaagaaagaaccaaucuauuuacaaggugauacggugagaggaucccuacacuuagauacauucuacggcgcuaucgcuaaggauaucaacggcaacauaaucacgaacaccaacggaaaaaucgcuccaaauuacgucauaagaaaagagcuuaguaaauuaaaagaaacugacauagagaacauaguagaucccguaguaagaggcaaaaucauagaggcaaagaaaaauaaacugaucacauucaacaaaucaggugcaguaaucaaaacaaccauuuggaugaaagaaaaucagauucccauaaacaaagucagaguguauucauccuuaaagaacccauuacccgacuuuaagaagcauagggacuuaagucaccuuacguauaaacaacaguauaauguaucaaaugaagaaaacuacugucuggcgauuuacgaaggaaaaaauaagaaagguaauguuugcagaacgugugaauuaguaaauaugaucgaugccggcaacuauuaccgucucuccaauaaaaacuggaaacaacaauauccaauaguaccugaaaaagacucaguaacaaacuacagccucaaaacaaucauaacaaaaggauuaauggucuugcuauaugagaaaaguccagaagaaauaugggaacuaaccuauaaucaacaaauggagcgacuauacgaaauaacccaacucgacacugaaaagucagcggaaauaaaacuacuuuuucaccaagaagcacgagaaaaaaaagucauaaccgaauauaugggccuaaaaacaggcaugaaaggaggcaaaaacaucgguaaacacaaggaauuuccguggaucaaagugggaccaaacucuuuugaugcacucaucgaagguauugauuuuaagcuaacaccuacaggaaaaauaauaaaacuauga

SEQ ID NO: 5702 - RNA, 4374 nt, Artificial Sequence
  Cas9 variant
augaaaacaauccuggggcucgacuuaggcacaaacucuaucggaugggcaaaaguuagcguagacgauuaugguaauuaccuacaugauauaaaacuuggaucaagaauuauaccuaugagucaagacguguuaggaaauuuugacucaggcgucacaguuucacaaacagcccaacgcacugaguuucguucaaaacgaagauuaguucaaaggaacuuacaaagaagagagcgcuugcauagaguacuccacguacuagacuuccuuccagcacauuaugaugcagcaaucggaugggaccgaacagaagcaguuaccuacggcaaguuccuaaaccaugccgaaccuaaauuagcaugggaagaguuaggaaaugggaaaagaagauucuuauucauggauaguuuccacgaaaugguagcagacuuugcaagaugccaaccagcauuaguggcugacggaaagaaaaucccauuagauuggacgauuuacuacuuaagaaaaaaagcacuaacccaagcaauaacgaaggaggagcuugcuuggauacuacucaacuucaaccaaaaaagaggcuauuaccaauuaagaggagaagaagaagaagaaaauccaaccaaacaagaagaguacuaugaauuaaaaguuguaaguguagaagccacugauagucgaaaaggaaacgauacaugguauaauguucaccuggaaaauggauggaucuauaggcguaguucgaaaauuucauuagaugauuggguaggaaagguuaaacaauucauaguuaccaccgaguacgagaaagauggagcgacuuuaaaaacagacaaagaaggauauguaaaaagaaguuucagagcaccaaaugaaaaugauuggggauuaagaaaaaaaagaaccgaaaccuuauuagaaaugucaggaaaaaccgugggagcauuuauauacgaucaucuuuuacaagaacccgccgauaaaauaagagguaacuuuaucaggacaauugaaagacauuauuacaaagcggaacuugaggcaaucuuagcagaacaaugcaaauaucacauugaacuacgugauaaagaaaugcuagaagcgugugcacgagaacuauauuugaauaaucuaccacaucaaagaucucuaaugaaaaaagauaugacauauuuacuauuauaugaucucaucuuuuaccaaagaccacuaaagucaaagaaagcacuaauagcaaacuguccauaugaauauuacgaauacguagacaaagagaccggagaaauaaaacggcaaaauaucaaauguauagcaaaaucaaauccauauuuccaagaguuuagacuauggcaauuuguucuuaacuuacgccuauuugaccgagucgaagacaaagaaguaacagcaaacuaucuaccaacagcagacgaucacgcacgguuauuuaccuaccuaaacgauagaaaagagauaaaccaggaaacauuauuaaaagacuauuuuaagcuaaaaaaagugaagauuggaaacgaaaaagaauacccgauacgauggaauuacaucgaagacaaagaaaagaaauaccccugcaaugaaacaagauaugaacuacuaauggcauuagauagggcaggaauugagcacaaaugguuagacgauaauaaucuagaauacagacuuuggcauuuacuauacaguguggaaguuaaaucagaaagugaaacagcacucagaaaauuaaaaaaugaugaugccuuugugaauucauucuuaaaaguaaaaccuuucaagaaagaauacggugcauauucagaaaaggcaauuaaaaggcuauuagcaguaaugaggaaaggauuccuauggaaugaacaagauauaugcgacgaaacuagaaaaagaauagaaauaaucauuaaaggagaugucgaugaaaaaguaaaagagagaaugggucaugcagcuuacucauuugaccgagucucagacuuccaaggauugccagaaugguuagccugcuacguaguauauggacgucauucagaggcuauggacauacagcauugggacucucccgaaagacuaauggcuuauauaaauaacuuuaaacaauauagccuacgaaaccccauaguagagcaauguauacuagaaacccuucgaacagugcacgauauauggaaagaaacaggucagauagacgaaauacaugucgaauuaggaagggaaaugaaaucgacaucagaagaaagagcacgacgaacccaaaaugucuuaagaaacgagaauacgaaccugcgaauuaaaaguuuacuuauagaacuuaagaacgauacagacaucugcaauguacacccauauucaccaaugcaacaagaaauccuaaggauauaugaagaaggagcucuucaggaauuaaauagagaagaugaggacuucgaagaaauuucgaagauaucacaaaugucccaaccaucagguaaagaacuaaacagauauaaacugugguuagaacaaaaauauaggucaccauauacaggaaaagcgauaucauuagccaaauuauuuaccccagcauaucaaaucgaacacguaaucccacagaguagauauuuugaugacucauucacaaauaaaguaauaugcgaagcugagguaaacacacuuaaauccaaucucuuaggcuacgaauucauuaaaaaacauggaggcgaaauaauacacugcacaacucuaggugauguacgaauuuuuuccgaaucagaauauaaggccuuuguaauggaucauuaugcuaauaauaaaagcaaaaaagauaaauuauuaauggaagacauaccccaagaauuucuaagccgacaaaugaaugacagcagguauauaucuaaagucgugaagacauuauuaagcaauaucguacgaauggcugacgaaagugaagcaaccucgaaguccguaauaguauguacuggagguguaacagacagauuaaaaaaagacuggggucuuaacgauguauggaacagcauuguauauuccagguucgaaagguugaaucgacucacggggaccgaagcauucggacacugggaaaauaaagauggcaagagaguauuccagacaucgaugccacuagaacuacaacgaggauuccguaaaaaacgaauagaccacagacaccaugcuauggacgcuuuaguuauugcaugugcgucucgcaauaucguaaacuauuugaauaaugaauccgcgaauaacccaaagaaaagggaagaccucagacgccaauuaugugauaaaaacagagugauccgaaaacccugggaaacuuucacccaagacgcauauaacgcguuagaaaacguaguagucuccuuuaaaaauuacgugcggguuaucaacaaagcaacaaauagauacgaacacuacgacgagaacgguaaaaaacgcuuuguucagcagaaaggaagugagcuaugggccauucgaaaacccaugcauaaagaaaccuauuauggacauguaaauuuacgaagaaaagaacuugucacccuucaaaaagcauuagacgauaucccaucgauuugcgauaaaaaacuacgagauuauauuuccgcacuugucgaaaaacauuuuaacaagagacaguuauuggcucauuucaaaagcaccgacuacuauuggcagaagcaauacguuaacaaagucuacguauggacauucagcgaugauauaaaaccccuagucgcuacccgaaaacuuuuagauacgaguuuugacgcaaagagaauuggaacaauaacagacacagguauucaaaaaauacucagaaacuauuuggaagcaaagggaggaaacgcaacacuggcauuuacaccagaaggaauagcugaaaugaaucaaaauauaagcaaauacaaugacgggaaaccccaccaaccaauauuaaaaguucgcauaaccgaaccaaugggagcaaaguacagaguaggacaaacaggcaauaaaauggcuaaauauguagaagcccaaagcggaacaaaccucuauuucgcaauuuacgaagauucugaaggaaaaagauccuacacaacaguacccuuagacgaaguagcagaaagauuaaagcaaagauuaucaccuguaccagaaaaagaugaaaacgauguaccacugaaauuuuaccuuucaccaaaugaccucguauacguaccgacugaagaggaauuacaacuccgggagugcaaauugaacaaggaucgaauuuacaaaauggugucaucaacaggaaaugaaugccacuucaucccauauuacguagcaaacguaauauacaacaaaggaggcuucaauaugcaaaugcacaggccacagucauga

SEQ ID NO: 5703 - RNA, 4374 nt, Artificial Sequence
  Cas9 variant
auggccaaaauacuaggucuagaucugggaacaaacuccauaggaugggcuaucguagaaaagaauaacagcgauuucacacuaauugacaaaggaguacgaauauuuagcgaaggugugaaaacugaaaaaggaauagagcgaagcagagccgccgaaagaacaggauauagaagcgcaaggaaaauaaaauauagaagaaaacuaagaaaauacgaaacacuaaaaguauuauccaaaaaucggauguguccccuacaaauagaagacguagaagcauggaaaaaaagcggauuuaaagauuauccacuaauuccagaauuccuucaauggcuuaggaccaaugaucacgagaauguaaacccguauuuuuuucgagauaaagcaagcagagcaaaaguaagucucugggaauuaggaagggcauucuaucauaucgcucaacgaagagguuuucuaagcaacaggcuugaccaaucaucagaaggaguacuugaagaacacaauccacagauacaaucucucauagaagacuuagaagagacuaguaccauccuaaaugaaguccgcgacuauuacauuaaccuuggauuguuagacggaguaaaaggagauuucaaaaaagaguuagaugaaggugaaaaaaaacuuaaaagcuuauacaacacacuaauagcaauaauaaaaaaaaacgaaaacgacguucaaaaaugcaaagacgaaaucaucaagagacucaacaaaaaagaagaucuaggcaaaguaaaggguaaaauaaaagacauaucgcaagcaaugcuagacggaaacuuuaaaacauugggacaauauuucuacucccuauauaacaagggaaaaauaaggaaccaauauacauccagagaggagcauuauuuacaagaauucauuacaaucuguaagguacaaggaauaaauggaauuaaugacgaggagauauuaccagaaaaaaaauuuaccggacuagcuaaggaucuauacaaagcuauauucuuccaacgaccacucaagucacaaaaaggguuaaucggaaaaugcagcuucgaaaaaaauaaaagccgaugugcaauaucucauccagacuucgaggaauaucggauguggaauuaccuuaauacaauaaaauucggcacacagagugauaaaaaauuaagauuucuuacacaagaggaaaaacugaaauuaaucccaaaguuuuacaggaaaaacgacuuuaauuuugaaguacuagcuaaagaauuaaucgacaaaggagcuacuuucggauucuauaagucaucacgaaaaaacgaguuucucuauugguuuaauuacaaaccgacggauacagucucagcgugucaauuuagugcaucacuaaaaaaugcaauaggagaagauuggcaaaccaaaguuuucacauauaagacacuaaauagcgaaaaaaaagaaguaauacgaacaguggacuaccgggaucucuggcaccuacuaagcgcaagcacaucagacauauaucucuaugaguacgcaaaagaaaaacuaggacuagaagacaagucagcaaaaacuuucucaaaaauuaaacugaaaaaagacuuugcaucccuaucucuuagcgcaauaaacaaaauacuuccauacauaaaagaagggcuacuguauagucacgcaguauuuauggcaaacauugaaaaagugguagaugaacacauauggaaagaugucaaagaaagaaccauaauucaaaaugaaauaagcaaaauaauaaaaagugacguauuugaaagagaagucauaaacauaaucaauggacuuauaaaaaauagcaaaacugagggggaaaauuacgcugaagaaucaaaaaauauauucaaaacagaauuugacaacgcaauagcuaaaauauucgaaaaaaacaaugauauagaauucaaucaaccauuucuggaugacacguacuuaaaguacguagaagaauuaaaaaaauucgacaaagcaaggaguuucuugccuguaccgcgccuagaugaaaaaguuauccaguuccuccuagggaacaacaaagacgggauggucuacugcagugauaaaaauaaaacaaaaaaacuauaucacccuucggauauagaaauauucaaaaaaaaaauaauaaaagaugaauucgguaaugaaaaaaugguauuaggaagcccacuaacgacuaguauaaaaaacccaauggcuaugagagcauuacaccagcuaagaaaaguccuaaacacccuaauccuagaagagcaaauugacgagaauacacgaauacacaucgagauggcaagagagcuaaacgacgccaacaaaagaaaaggcauucaagacuaccagaaugagaacaaaaaguuuagagaagaugcgauaaaagaaauaaaaaaauuauacuucgaggaaugcaaaaaagaagucgaacccacagaagaagauguacuaagauaccagcuauggaucgaacaagauaagaaggaaauauaugaacaaggaaaauccauaagaauaucagauauaauaggaucuaacccagcauaugacaucgaacacaccguaccacgaucaaucagucagaacaacucauuaaugaauaaaacacuaugcacgccacguuuuaauagagaaauaaaaaaacaaaagaugccaauagaauuaucaaauuaugaagaaauauuaccacguaucgagcacuggaagaaggaagcugaagaccuaacacgucagauugaaucgauaagcaaaucgauuaaaagcgccagcaccaaggaagcaaaggacaaaaauauaagaagaagacacuaucuuacacugaaacgagacuauuuaaaagguaaguacgauagauuuauaugggaagaaccaaaaguaggauucaaaaacucgcaaauaccugauacuggaauaauaacuaaauaugcacaggcauaucuaaaaucauauuuuaaaaggguagaaaguguuaaaggaggaaugguugcugaauuccgcaaacaauggggcauccaggaaaguuauauugacgagaacggguuuaaacacuauaaagagaaagaucgaagcaaacacacacaccacacaaucgaugccauuacuauugccugcaugacaaaggacaaauaugacguucuugcacaagcguggacaucagaagacgaacaagauaaacaaaaagcgaaaacgcucauguccgaggcaaaacccuggaaaacauuuaaagaagacauugaaaaaauagaggaggagauacuagugucccacuuuacacuggacaacgucaaaaaacagucaaaaaaaauaguuagaguuagaggaaaaaaacaauacguagcagaaauagaaagagaugucaaugguaaggcaauggccaaaaaagaugcuaaugggaaaaucaucuacaaauuaaaugagaaaggggaaaaaauaccaagguuacaacaaggagauacuauaagaggcagccuacaucaagacucaaucuacggcgcgauuaaaaauccacuaaaccaagaagaaauaaaauacgucauuagaaaagaucucgaaagucuaaaggcaaaugaugucgacaacaucguggacgaaacaguaaaacaaaaaguuaaggaagccauugaaaacaaaauauuacuacuaucaucaaacgcacaacaaaaaaauaaauuggucgacgauguauggcuaaacaaagaaaaacagguaccuauaaaaaagguacgaauauacgcgaauaguguaaaaaauccucuugagauuaaagagcagaguuuacucuccaaaagcagaaaagaacacaaacaaaaagucuacggacaaaacgacgaaaauuaugccauggcaauauaugaguuagacggcaaacgagaauucgaacuaauaaacaauuucaaucuagcaaaacuaauaaaacaaaaagaaggauuuuauccccugaauaaagagaaagaagugaaaggcaaaaaaguacuguaucccaucgcuaaaagcaacuacagggauguuguucuaaaacgaggucaacaaguaguuuuuuacgacaaagaaguggaaaauccgaaagauauauccgaaguaauagauuucaaggggcguauauauauuauagaaggacuaucaauacaaagaaucguuagacccucggggaagaucgacgaguauggagugaucauguuaaaauacuucaaagaggcacgaaaagccgaugagauaaagaaagacaauuauaaacccgauggaguauucaagcuaggcgaaaaccggccuacaagaaaaaugaaucacucccaauuuacugcauucguugaaggaauagacuucaagguucugccgacaggaaaauuugauaaaauauga

SEQ ID NO: 5704 - RNA, 4377 nt, Artificial Sequence
  Cas9 variant
augacaaaaaccauacuagggcuagaccucggaacaaacagcaucggaugggccuugauaaaucaagacuucgacaauaagaagggagaaauauuaggaaugggcagcaggauaaucccuaugacacaggauauaaaggacgaguuuggaaaaggcaauaguauaucacaaacagcugaacgcacucgauuacgaggaguucgccgauuaauucaccgaacccuuuugaggagagaaagacuccaucgaguguuaaacauaauaggcuuucuaccagaacacuacgcaaaccaaauagacuucgagaaaagauucggaaaauucaaaccagaaucagaacccaaaauuucauucgacggaaacgacguuuuucuguuugaaaaaucauaucaagaaaugcuuguugacuuuaaaauucaucaaccacagcuaguuucaaauggcaagaaaauaccucaugacuggacuauuuacuacuuaagaaagaaagcucucaguaagaaaaucgaaaaagaagaacucgcauggauccuauuaaacuuuaaccagaaacgcggauacuaccaacuaagaggagaagaagaagaagaaacucccaacaaacucguagaguuccauagccuaaaaauuguagaagugaaugcagacgaaccacaaaagggaaaaccagaaauaugguacucauuaguacuagaaaauggguggguauacagacgugcauccaagacgccauuguucgacuggaaagauaaaauuagggaauuuauuguaaccacagaaaucaauaaugacggaacuguaaaaacggacaaggaaggaacagaaaaacgaucguucagagcccccaagccagaagauuggacccuccagaaaaagaaaacagaguucgaauuaucaaaaagugguaaugaagucggugcauucauauaugaaucaauccuacaaaaaccaaaccagaaaauaagaggaaaguuaauaagcaccauagaaagaaaauucuauaaagaagaacuaaaaacaauucuaaaaacacaacuauuuuuccauaaggaacucaaagaugaaaagcuauauaacgcaugcaucgaggaguuauauaaaaacaacgaagcucaucgaucgcuacuaucaaacaaaggcuuugaacauuuauuuauaaaugauauacuauuuuaccaacgcccucucagaucgaagaaaucacaaaucucaaauuguccacuagagaaaaggacuuauaagaaagaaggaauagaaauuaccgaaggaauaaaagucauauccaaaaguaaccccauauaucaagaauuuagacuguggcaauggauaaguaaccuaucacuguauuguaucgaaccaacagaaacuaacguuacaagcacauuuuuaaacucuauagaagacuacgaaaaucuauucgaauuuuuaaacaacagaaaagaaauagaacaaaaacaccuauuaaaauacuuacuugaaaaccaaggauucaaaggaaaacuauugacaaaugaacuagaaaaauuuagauggaacuuugucgcugacaaaaaguacccgugcaaugaaacagguucacuauugcauacccggcuaaguaaaguaaagaacauaucaccagacuucuuaacaaaagaaauagaacaucaacuauggcauauaauauacucaguuacagacaaaaucgaauacgaacaagcauuaaaaacguuugcucguaaaaauaauuuagauguugacucauuuuucgaacacuucaagaaaauaccuccauucgaaucuacauauggagcauauucugaaaaagcaaucaagaaacuguuaccgcuaauuagauuaggaaaauacuggaauugggaagcaauagacucaauuaguaaagacagaauaagcaaaauacuaucaggugaauaugacgaaaauaucaaaaaucgcgucagagaaaaagcgguccaccugacaagugaaaauaacuuccaaggauuacaggagugguuagccaaauacauaguuuacgaccgacauagcgaggguaaugaccuagggaaauggaccucgguaagugaucuagaaaccuaccuaaaagaguuuaaacagcacagucuacguaacccgaucguugaacaagucauaacagaaacacucagaguuguaaaagacauauggaucaaacacggaaaagggaccgaaaacuuuuucgaugaaauccacguagagcuaggaagggaaaugaaaaauaauagcgaagauagaaaacgacuuaccaauacgauaacagaaaacgaaaacacaaaccuacgcaucaaagcacuacuaauggagaugaugaaugacaacgacguugaaaacguacgacccuacucaccaucucagcaagaaauauugaaaaucuaugaggauggagcauuaaauagcaacauugaacuagacgaugaaaucguaaaaauauccaagaaagcagaaccuaccaaaucagaacuacagagguacaaauuauggcucgaacaaaaauauagaucaccuuacacgggccaaguaauuccacuaaacaaacuauuuacauccgaguacgaaauugaacauguaguaccacaauccagauuuuucgacgacucuuucaguaauaaaguaauuugcgaaucagcaguaaauaaaagaaaagacaaccaacucgggcuacaauucaucaaaaaucauucgggugaaaaaguugaguuaggguucggaaaaguugugcaaguuuuuacagaagaacaauaucuagacuucguaaaagaacacuacaguaaaaacagaucaaaacauaauaaauuacuacucgaagagauaccggagaaaaugauagaaagacaauuaaacgacacaagauauauaucaaaauuuguaucaucuauacuaucaaauaucgugagauccgaaaaagacgacgacgggcuaaauucgaaaaacauauuaccaggaaauggcaaaauaacaacagaacuuaaacgcgauuggggauugaaugauguauggaacgaccuaauacuccccagauucgaaagaaugaacacaaucacaaacucugaccuuuucacuaccuacaacgauaaauaucaaaaacaucucccaacaguuccauuugaauauucaaaaggauuucaaaagaaacgaauagaccauagacaccaugcaauggacgcucuaguaaucgcaugcgcaacccgugaucaccuaaaccucaugaauaaccaauccgcaaaaucagaauuaaaaagguacgaucugcaaaauaaacucagaaagaaagaaccauacuucaaucaaaaagaaaacaaacaaaaagaagcauuuaaagauuuuauaaaaccaugggguacauuuacggaagauaguaaaaaugcacuagagaaaauaauuaucuccuuuaaacaaaaccuacgagucauaaauaaagcuaccaauaguuacgaauccuacaaagaugaagacggaaaccuacgaauuggcaaagacggaaaaccagaaaaaggccuaauaaagcaaaaaggacuaaacugggcaauacgaaagccucuacacaaagauacaguuagcggacaaauaaaucucuccaggauaaaguuacccaauggcaagauuuuaacagcaacacggaaaaaucucgacacaucauucgacuuaaaaaccauagaaaacucaauuaccgacaccggaauacagaaaauauuaaagaacuaucuacuuucuaaagaaucacccgaacuagcauucucaccagaaggucuggaagaaaugaauaacgaaauagaaaaauacaacaacgggaaguuccaucacccaauaaacaaggcgagaauauaugaauuaggaucaaaauucaauguuggacaaacaggaaacagacgagacaaauucgucgaagcagcaaaagguacgaauuuauucuucgccauuuaccaagacgaaaauaaaaauagauccuacgaaaccauaccauuaaaugaaguuauugaacaucaaaaauggagagcaagccuaccaaaagaagaacaagagaaaaucccauuaguuccagucaacaaacuaaaaggaacguucauauuuaguuuauccccaaaugaccugguguaugucccuucaaacgaugagcuagaaagauccgcaucuauagauuucucuaaauuaaagaaagagcaaaucaacagacuuuauaaaauggucucauccagugguucacagugcuuuuucguaaaaagugaaguagcaaccaguguugugaauaaaauggaauauucaucuuugaauaaaauggaaaaaucaauugacaaccucaugguuaaagagauauguauaaaacuuaaaauagauaggcuaggaaacauaucaaaagcuuga

SEQ ID NO: 5705 - RNA, 4377 nt, Artificial Sequence
  Cas9 variant
augaaaaaaauacuaggauuagaucuaggcacaaauagcauaggaugggcguuaauagaacaagacuuugaaucaaaagcgggaaaaauuagcggagcugguucuaggauaauaccaaugagccaagacauacuggggacauucgaaaccggacaauccuacagccaaacagcagauagaacucauuaccgaagcauacgacgacuauaccaaagaacaaaauuaagaagagagagacuucaucgaaguuuaaauguacuugguuuccugccggaacacuacaaaaaugaaauagacuuugaacaaagaaaaggacaauucuacccaaauaaagaaccaaaaauugcauauuauccugaacaagucgcuaguaaagugaaauaccaauuucuguuuaaaagcagcuucuuagaaaugguggaagauuuuaaacgucgcggauauaacggagcaauaccauaugacuggacaaucuauuauuuacguaaaaaagcguuagagaaaaaaauugagaaggaagaacuugcaugguuauuacuaaauuucaaucagaaaagggguuauuaccagcuccggggagaagaggaggacacaaacucaaauaaaaaggaagaauucuaugaacugaaaguuaguucagucgaacaaacacacgacacaagcccaagcggaacaugguauaauguacaccuccagaacggauggguauaucgaagaaaaaguaaagacagucugaaagacugggaaggauuaaacaaaaaauuuauaguaacaacacaucucaacgcugacggaagcgaaaaacuugauaaagacggcaauguaucacguucauuccgagcaccaaaagaagacgacuggggauuagucaaaaaaagaacagaaucaguucuagaaaaauccggauuacacgucggugaguucauauacgaaagucuucuagaaaaccccgaacaaaaaauacgaggaucacuaaucaaaaccaucgagagaaaauacuauaagaaagagcucgaagcaauauuagacaaacaaacaucauuucaucgagaauuacgaaacgacgcucuauauaaagaagcaacgcucgaacuauauccgaaaaauucugcacauagaucaaacauuaaacaacgaggauuuaaauaucucuucauagaagacaucauauuuuaccaacgaccacugaaaucgcagaaacacuuaaucgcacauugucaauaugaaaaaagaacguauaaaaauaaugguggugaaacaauagaaguuucacuacaaggugcuccaaaaagucauccuucauuucaggaauuuagaauauggcaguucaucucaaaucuacgcuuuuaugacaaagaagaaauaguagaaggacaagaagugucaauaacagaaaaacuccucaaaagugacuccgacuucgcugagcuguaccacuggcuuucgcaucagcgcgaagucgaccaaaauaaaacacuaaaauauuucacacaaaaaaaauuaauaccaaaacaaaaaaaagacaauccaacaauuagauggaauuucccagaagacaaaaaguacgaaaugggagaauuuaaggcacaacuacugagccgauuggaaaaaguacgaaacugucaaccagauaaguucuuaacccagaaaaaugaacuagaccuauggcacauaaucuacagcguaacugacaaaacugaauucgaaaaagcacuggucacauuugcagaaaaaagagaauuagacagugaaucauuuguggaaaacuuuaaaaaguuccccccguucaagaacgacuacgcuucauacucccuaaaagcaauaaaaaaaauacuaccguuaaugcgacgagguaaauauuggaaagcagagaaucucgguccacaaacgcuccaaagaauugaaaagauaguuaauggggaagcagacgauaaaauuucaauaagagcaagaaaacuugcacuccauuuaaacgauacuaaaaguuuccaagguuuacccacuucauuagccugcuacguagcauacaauaggcacagcgaaaaugaggaaaaucaaaaauggcaaacuccuuccgauauagauaaguaccuuaaagacuucaaacagcauucacucagaaauccuauuguugaacaacucauaacugaagcauuaagggucguacgagauauauggaaacacuauggacagggccaaaaagacuuuuuugaugaaauacacgucgaacuagguagagaaaugaaaaaucccgcaauaaaaaggaagaaacuaagccaaaaaauacaagagaacgaaaacacaaauuacagaauaaaagaaguauuaagaaaucuuaaagaaaacaauauugaugcaaagccauacagccccagucaccaagaaauacucaaaauauaugaagaaggcguauaucaaucaaucgaaaauguugaagacgaaaucgaaaaaauaagaaaaaauaauacucccucuucgaaagauaucaauagauacagauuaugguuagaacaagguuacauaagucccuacacaggcgaaguaauuccccuaagucaacucuucagcaaucaauacgaaauagagcacauaaucccaagaaguagauucuucgaugauagcuuagcuaacaaagucaucugcgaaucuagcguuaaugcguugaaagacaacaaaacagcucuagaauucauaaccaaucacggaaaugaaaaaguagaauucgcaggcaaaacuguugaaaucuuauccagcgauaaauauacggaacauuguaaaagguacuuuaagagaaauagaacaaaacuuaaaaaccuccuuucguaugacguacccgaaggauucaucaaccgccaacuaaacgacucgcgguuuaucaguaaauacguaagaaauuuauuguccaacauagucagagaggaagaagaaagagaagcaauaaguaaacacauacuaacaauaccaggaagcauaacgucccaacuaaaacaggacuggggguugaacgagaaauggaaugaaguaguuacgcacagauuugaaaggcucaauaaccuaacaggcacuacagacuuuggcuuuugggacaauaaaauaaacgcuuucagaauaacgguaccuaaagaauuaucaaagggguuuaacaaaaaacguaucgaccauagacaucauacccuggaugcacuagugauagcagcaugcacaaaagaucauguaaauuauauuacaucccuuaauacagaaagaaacaaccauagucuaguuucaaaauuacgaaauaccaaaaaaguacuuaucaaugguaaggaaagaagaauagcaaaagcuuacaaacuuccuuggucauccuuuccccuagacgcuaaacaccaacucgaaacaacaguaauuucguucaaacagaauuuacgagucauaaauaaaucaucaaauaagaccuggcaauggagaaaugugaacggagaacaaaaaaaaaagcuuaucccacagacaaaaggcgacucaugggccauacgcaaaagcaugcacaaagcaacaguaucagcuaaagucgaaaguguaggaaaaggcaagauaaagacgaccaauaggacaccacucggcgagauaaaaggugaaaaacacguagaaaaaauauaugacgcucguauacgagaagucauuaucccaaaucaucugaacaaauauuuagaugagaagggcaaaccaaacuacgaagcagccuucucacaaagcggaauaaagcaacuaaacgagaauauagagguuuugaaugaaggaaaaccacacgccccuauauauaaaguaccucuguuugaagugggcaguaaauucccaguaucagaagacgcaaagucuccaaaaaaccaaaaauaugucgaagcagauaaggguacaaaccucuucuuugcaguuuacuggaaugaagaaaaacaaaaacgaaauuucgaaacaguuccucuacaccaggucauaguacaucaaaaacaaguagcaagucuacccacggaacaaagaaccaguguaccuauaaaaccagaauuaggacuauuccucuucucacuaucaccaaaugaccuaguuuaugucccaacagaagaagaaauugaaaacccucaccuaguagaccuaaagaaccuaucuaaggaucaaacaaaccgcauauacaaaaugguaucaucuaccggaaacgaaugccauuucauaccacaucauauuucacguuuaauaaugaaauacaacgcaaaacaaaaaguaggagaauucggaagccucaauaaagcagaaaaagcuaucaccggagaaacaauuaaagagaaaugucuaaaaauccaaauaaauucacuaggaaaauuaaaaaccgagagaauagccuga

SEQ ID NO: 5706 - RNA, 4380 nt, Artificial Sequence
  Cas9 variant
augaaauuuaacuuaggucuggacaucggaacaaacucgauaggaugggcucuaguaaacgaagacuaugaaaacaaaaaaggaaagauaauagcagcagguagccgaauaauuccaaugacccaagauauacuggacaaauucggcuccggugcaauaacagaaacacaaacagcacuuagaacagauuauaggucaaaaaggaaauuaauacaaagauucuuauuacggagagagagauuacauagaguccugaacguacuggacuuccuacccaagcacuaugccgaaagcaucgacuucgaaaaauacuucggaaaauuuuugccaaacaccgaacccaaacuggcuuacaaccaaaaucaauucaucuuucaaaauagcuuccucgagauguuaaaagaguuucaagaaaaacaccccgaauugcucacaaauaauaaaaaaauucccuaugacuggacuauuuauuaccuccgaaaaaaagcccuaaaucaaagaaucgaaaaagaagaauuagccuggcuacuucuacaauuuaaucaaaaaagaggguacaaccaauuaagagaugaagaagaggaaucgguaccaaacaaacaaguggaauucuauucacugaaaauaauagauguaguagcggaucaacccaaagaaggccgggauaaaaggugguacucaauaaaucuagaaaauggauggaccuacaggagagaaucgaaaaccccacuuuucaauugggaaggcaaaaccaaagauuuuauaguaaccaccgauuuaaaucaggacggcucaauaaagaaagauaaagaaggaaaagaaaaacguaguuuccgagccccaagugaaggagacuggacucuacuaaaaaaaaaaacagaaaaggaaauauacgaaagcggaaaaacauuaggaacauauauauaugaugccuuacuuaacacaccagaucuaaaaauaaaaggagacuuuauccgaacaaucgaucguucaauauauaaagaagaacuccagcaaaucauuaacaaacaaaaagaauaucacuuagaacucaacagcucuaaacuauauaaagcaugcuuagaagaacuauacccaaaaaaugaaauuuacaaaucugccuuaaaaaacaaagauauagccuacuuauucauaaacgacauuuuauacuaccaaagaccccuaaaagcgccaaaauacaauauaggaaaauguaccuacgaaucacgcacguucaaaaaagaagacaaaaaaauacgugaauauauccccgcaguggccaaaagccacccacuauuccaagaauuucgacuauggcaguggaucaaaaauuuaaaaauuuaugaaaaacucucgagugauaacugcacagacuuuuuccuaacaaaugaacaagacuuugaaaaccuauucgaguuccuuuggaauaaaaaagaaauugaucauaaaggcauccuagaauacuuaguaaagacaaaguucccagaccuaaaaccaaaacaaguaaaaaccaaaguuaaagaguauagauggaauuauguauaugaccacgaaaaagacgaaagcaaaacuuacccaugcggcgaaacauauuuucuuuuaaaaaauaaacuugacaaaauuuauaacgcucaagacgacuuuuuagauaaagaaagauuguauaaccuguggcauauaaucuauucugucacagauaaaaagcaauacgaaaaagccuuagcaaaauucgcauuaaaaaaccaccuagacaccaagucauuuguaaauacguucaaaagaauaccaccuuuuaaaaacgacuacgccaucuauucauuaaaagcaaucaagaaacuacuaccccuaaugagaguaggaaaauacuggaacuaugacgauauugaucccauaacaaaacaaaaaauucagugcauaauaacgggagaagaaaaugauacaauaagcacacucguucgagaaaaaacaaaccacuucuccaaugaaaacgacuucaaaaaccucccacuauggcucgcuggauauaucgucuacaauucacacaacgaaaguucagaaaucgaaaaauggaaguccccacaggauauagauacauuuuugaagaaauucaaacaacacgcccuacgaaaccccauagucgaacaaguugugaccgaaacacuuagaguaguuagagauaucugguccaaaaaagggcaagguaaaaaagauuucuuuaacgaaauccacauagaacuuggaaaagaccuuaaaaauccaguagauaaacgaaggaaauuaucuagcacgaacaccaaaaacgaaagcacaaacacccguauaaaagcguuauugaucgaacuuuucacacaagguguagaaaacguaaaaccuaacucaccgaaacaccaagaaauacuuaagauauuugaagaaggcgcacucaauucagguauagaaauagaagaggauauaaucaaaauaucuaauacagaucagcccacaaaaaaacaauuagaauuauacauccuaugguuggaacauaaguacaaaucacccuauaccggacaaagcauaccacuuucgaagcuauucacaccaaauuacgaaauugaacacauaauaccuagaucaaaauauuacgacgauaaccuuagcaacaaaguaauaugugagacagagauaaauagauuaaaaaauaaccagcucgguuacgaauuuauaaacaaccacgaaaucagagaagugacucucgaagaaggaaaaacuauaagacuucuaucgccagaacaauacuggaacuucguuacuacauacuacgcaaaaaauaaggcaaaaagggagaauuuacuacuuaaagaauuaccuguacaaaugguugagaaacaacucaacgauacccgauacgugucuaaauacguaaugcaacucuuauccaagauaguuagaaaagaagacggaacagauaauggcaucaauucuacaaauauacuaucgaucucugguaaaaugaccagagccuuaaaaaacgacugggaccuaaacgacguauggaaugaccuuuuauuguaccgcuucgaacgauuaaacaccauaacaaaaacaaaucuuuucaccacauauucagaacaaaaacaaaaaagaaugccuauaguuccagaccaauacgcaaaagguuuccauaaaaaaagacuugaccacaggcaucaugcguuagacgcaauaguuauugcuuguauaacaagaaaucauauaaacuauaugaauaaccagaacauccaaggugaaaaacuuaagaaaaacgcgauagaaaaggaaaacuaccgagagauauuacaaaaaucccgacuagauauccgagcacaauuaugugaaaagaaauauaacgauaacgacccgacaaaauacaacuggguguucauaaaacccugggcagacuuuacggaaaacacaaaggacauuuuagaaagcaucauucccaguuuuaaacaaaaccuuagaaucauaaacaaaaccgucaacuacuacgaaaaauacaacgaaaauggaaaaaaagugaaaguacgucaaauuaaaggagauaauugggcuauuagaaaaccccuccacaaagaaaccauaagugguaaaguucacuuauccuauaaaacaccagcaaaaggaaaaauccucacagcaacaagaaaaguacuggauuccagcauggauuucaaaaguauagaaaagauaacagacacaggaauacaaaagauccucaaaaacuaccuagaauauaaaaaaucaccggaacuagcauucaguccagaagguaucgaagaacuaaacgcaacaauaacaaaguauaauaaugguuuccaccauaaacccauuuauaaaguucgaauauacgaagaagggguaaaauucccucuaggaaauaaaggcaacaaaaaaagcaaauauguagaagcagaaaaaggaacaaaucuuuuuuucgcuauauauaaggaucaagaaaacaauagauauuucgagacuauaccauuuaaugaugugcuugaaaccuuaaaaaaaggcaugucagcagucccagaaaaaaaccaagaagaaaacacuuuaguuuucgcuuuaucuccacaagaucuaguauucguuccuacucucgaugaaauugaaaacccagacaucguagacuuuaaaaaccucacgaaagaucaaacaaacagaauauacaaaauggucuccucauccggcaaacaaugcuuuuucauaaaggcugaaguggcuacgucaaucguuaacaaaauggaauuuuccacuuccaacaaaauggaaaacucuauagaaggaauccaaauuaagucaaacuguuggaaacucaaacuagaccgacugggaacaaucacucgaguaauaaaguga

SEQ ID NO: 5707 - RNA, 4383 nt, Artificial Sequence
  Cas9 variant
augacaaaguucaaccuggggcuagauauaggaaccaacucuaucggcugggccuuaguaaaugaggacugcgaaaacaaaaagggaaagauucuggcagcagguucaaggauuauacccaugacacaagauauacucgauaaauuuggcucaggcgcagccacagaaacucaaacagcccuaaggacagacuaccgcucaaaaaggaagcuaauacaaagauuccuacuaagacgagaacgacuucauagagugcuaaacguauuagauuuccuacccaaacauuacgcggaaucaauagacuucgaaaaauaccucgguaaauuccuaccaaacacugaaccaaagcuaguauacaaccaaaaucaguuuaucuuccaaaauucauucuuugaaaugcuaaaagaauuccaagagaaacaccccgaauuguuuuuaaacaaccaaaaaauccccuaugacuggacaauauauuaccuaaggaagaaagcuuuaucacaaaaaauagaaaaagaagaacuugcauggcuccuacuacaauuuaaucaaaaacgaggauauaaucaacuaagggaugaagaagaagaaaacaccccagauaaauuaguagaauucuacagucuaaagauaauaaaaguuacggccgacgaggccaaagaaggcauaaacaagcgaugguauucgaucaaccuagaaaacggauggauauaccgaagagaaucaaagaccccacuguuuaacugggaaggcaaaacaaaaaacuucauagucacuacagaucuaaaucaagacggaucaauaaaaaaagacaaagagggaaaagaaaaaagaaguuuucgagcgccuucagaaggcgacuggacauuacuuaaaaaaaaaacggagaaagaaauuuaugagucaggaaagacauugggaaccuacaucuaugaugcacuuuuaaauaacccagaucuaaaaauaaaaggcgcccuuauaaaaacuauagaucgcucaauauauaaagaggaacuacaacaaauuaucaauaaacaaaaggaauaccacuccgaguuaaacaacagcaaauuauauaaagcaugcuuggaagaguuauauccaaaaaacgaaaucuauaaaaaugaauuaaaaaauaaagauauugccuaucuauucauaaacgauauuuuauauuaccaacgacccuugaaagcuccaaaauacaauaucgguaaauguuccuaugaaucuaggacauucaaaaaggaagacaaaaaaauaacggaauucauuccugcagucgcaaaaagccacccucucuuucaagaauuuagauuauggcaauggauaaaaaaccuuaaaaucuacgaaaaacucacaaaugacaauuacacagauuucuuucuaacgaacgaacgcgauauagaaaaacuuuucgauuucuuauggaacaaaaaagagauagaccacaaaggcaucuuggaauacuuaauuaaaacaaaauuuccggaccuaaaaccgaaacagguaaaaagcaaagugaaagaguaucgcuggaacuauauauacgaccaugaaaaggaugaauccaagaauuacccguguggugaaaccuauuuccugcucaaaaacaaauuagacaaaauaaccucaauacaagaugacuuccucaacaaaaaaagacucgaaaaccuauggcacauaauauacucagugacagacaaaaagcaauaugaaaaagcucuagcaaaguucgccuuaaaaaaucaauuagauacaaaaaguuucguaaacacuuucaagagaauuccagcuuuuaaaaacgacuacgcaauauacucucuaaaagccauaaaaaaacuacuaccucugaugcgcguaggaaaauauuggaacuacgacgacauagacccuauuacaaaacaaaaaauacaaugcauaauaacaggagaagaaaaugauacaauuucaacuuuaguccgagaaaaaacgaaccacuuuuccaaugaaaaugauuucaaaaacuuaucucuauggcucgcgggcuacaucgucuacaauucacacaacgaaucuagugaaauagaaaaauggaaaucaccacaagacaucgacacauuucuaaaaaaauucaaacaacacgcacuccgcaacccaauugucgaacaaguuguaacugaaacacuaagaguaguccgagacaucuggcuaaaaaaaggucaaggcaaaaaagacuucuuuaacgaaauccauaucgaacugggaaaagaucuuaaaaaucccguagacaaaagacgaaaaaucucaucaacaaacagcaaaaacgaaacaacaaauauucguauaaaagcuuuauuaaaagaauuacuaaaagaaggaauugaaaacauuaaaccaaacucaccaaaacaacaagaaauacuaaaaaucuucgaagagggcauccuaaacucagguauagauauagaggaagaaauaaucaaaauuucucaaauugcacaaccuacaaaaaaacagcuacaauacuaccgaaacuggcuugaacaaaaguacauaucaccauauacuggacaauucauuccccuaucgaaacucuucacaucuaaauacgaaauugaacacauuauaccaagaucgaaauacuaugaugacucgcugucaaacaaagucauaugcgaaacagaaauaaauagauuaaaaaauaaccaauuaggauaugaauuuauaaauaaucacgagauuagagaaauaacacuugaggaagggaaaacaauacgacuacuaagccccaagcaauaccucgacuucguaacuacguacuauggaaaaaauaaagccaaaagagagaaucuacuuuuaaaagaaauacccauucaaaugaucgaaaaucaacuaaaugacacuagauacguaaguaaauacgugaugcaacuacuaagcaaaaucgucagaaaagaagacggcacugacaacggcacaaauucuauaaacauccuauccguuagcggaaaaauaacaagaguccuuaaaacugacuggggucucaaugacguauggaacgacuuauuaugcuacagauuugaaagacuaaauaaaauaaccaauacaaacuuguucacuacguacucagaacaaaaacaaaaaauaauaccaaucguacccgaccaguacgcaaaaggcuuucauaaaaaaaaauuagaucauagacaccacgcacuagaugcaauauuaauugcuuguauaaccagaaaucacauaaacuacaugaauaaccaaaacauacaaggagaaaaacuaaagaauuuuaaaauagacaaacauaacuaucacgaaauauuccaaaaaagccgacuggacaugcgagcacaacuuugcgaaaaaaaauacaaugaucacgauagcacgaaauauacaugggucuucaccaagccuugggcugacuucaccgaaaacaucaaggauacacuagaauuuaucauaccauccuucaaacaaaauuuaagaauuauuaacaaaacagucaauuacuacgaaaaauauaaugaaaacgggaaaaaaguuaaagugagacaaacaaaaggcgacaacugggcaauucgaaaaccccuccacaaagaaaccauaucugguaaaguacaucuacuuuacaagacaccagcuaaaggaaaaauauuaacagcaacuaggaaaguauuagacucaagcauggacuuuaaaucuauugaaaaaaucacagacacaggcauacaaaaaauccugaaaaauuaucucaaguacaaggagucuccugaacuugcguuuucgccggaaggaaucgaagaacuuaacauuacuauugccaaauauaacgacggauucuaccacaaaccaauauacaaagucagaauuuacgaagaaggaguuaaauucccacuaggcaauagagguaacaaaaaaaauaaauacguagaagccgagaaaggaacaaaucuguuuuucgcaauuuacaaagaucaagagaacaacagauauuuugaaacaauaccauucaacgacguauuagagaccuuaaaaaaagguaugagugcagugcccgaaaaaaaucaagaaaaaaauacguugguguuugcucucucaccacaagacuuaguuuucguaccgacacuagaugaaaucgaaaauccagacauagucgauuuucgcaauuugacaaaagaucaaacaaaucgcauauauaaaaugguaucuagcucugguaaacaaugcuuuuuuauaaaagcagaagucgcaacaagcauaguuaauaaaauggaauucacaacaucuaacaaaauggaaaacucaaucgaaggaauccaaauaaagucaaacugcuggaaacuaaagcuugacagacuggguaccaucacuaggguaauaaaauga

SEQ ID NO: 5708 - RNA, 4389 nt, Artificial Sequence
  Cas9 variant
augacuaaaaacauauuaggauuggaccuugguacaaauaguauaggaugggcacuaauaaaacaaaacuuugaaaacaaacaaggcgaaauacuaggaaugggaagucgaaucaucccaaugucgcaagacaucuuaggagacuuuggaaaaggaaacaguguaucacaaacagcagaaagaacaaaauaucgaucgguaagacgauuaagagaacgauuccuacucagaagggaaagacuacauagaguacuuaaccuacucaacuucuuaccacagcacuaugcuucacaaauagacuucgagaaacgauucgggaaauuuaaaguugagacagaaccaaaacuagccuggaaaaacauagacggucaauucucuuuucucuuccaaaccaguuucaacgaaaugcuggaagauuuuagagugaacggacaagauguuaaaaucccauacgauuggacaaucuauuaccuaagaaagaaagcacuaucuaagaaaaucgaaaaagaagaacuagcguggauccuacuaaauuucaaccaaaaacgaggcuacuaccaauuaagaggagaagaagaagaagaaaacccuaacaaauuagucgaauuuuauagcuugaaagucguagaugucguagcggacgaaccucaaaaaggaaaauuugauaucugguauagcuuaauccuagaaaacggcuggguuuacagacgauccucuaaaauaccccuuuucgacuggaaagauaaaacaagggauuuuaucguaacaacagauuuaaaugaugacggcaguaucaagaaagauaaagauggaaaugaaaaacgaucauucagagcaccaagugaaaacgacuggacacuggugaaaaagaaaacagaacaagagauagaacaaucaagaaaaacaguaggaacuuauauauaugaagcacuauuagacaauccaaaacagaaaaucaaaggaaagcuagucagaacaaucgaacguaaauucuauaaagaagaacuuaggcaaauacuagagaaacaaaaagaauuucaucaagaacuucaaucggacgauuuauauaaugauuguguuagagaauuauauagaaauaaugaagcucaccaacuaacccucuccaagaaagauuucguacaucuuuuaauggaugaccucauauuuuaccaaagaccccugaggagucagaaaaguucaguaagcaauuguacacuugaguuccgaaaauacaaagacgaaaauggagcggaacauacacaauaucuaaaagcuaucccaaaaucaaauccauacuaccaggaauuuagacuguggcaauggauauacaauuuaaacauauaucgaagagaagaugaacaaaauccaaucacaggggaauuuuuaaguacuacuaaagaguucgaaaaucucuuugaguuccucaacacacguaaagaaguugaucaaaaagcgcugcuaaaacauuucaaacucaacgacaaaacacacagauggaacuucguggaagacaagaaauauccuuguaaugaaacaaaaacuaugauaucgagucgacuggaaaaaguugaaaacaucucagaugacuucuuaacgagggaaauagaacagaaaaucuggcauauuauauacagcguuaacgauaaaauagaauacgaaaaagcauuaaaaucguucgcaaagaaacaccacuuggaugaaucgucauuuuucgaggcuuucagaaaauuuccuccauucaaauccgaauacggaucauuuagcgaaaaagccgucaagaaacuauuaccgcucaugcgcuuaggaaaauacuggaauuacgcugacauagauaaaaguagcaaagaacguauccagaaaauaauuucaggcgaauaugacgaaaauauaaaagacaggguaagagaaaaaucagugcaccuaacaaccgaaaacgauuuucaaggccuacaauuauggcuagcacaauauauagucuaugguagacacucugaagcuagcaugauaggaaaauggaacuccgcagaugaucuugaagaguuccuuaaaaauuuuaaacaacacagucuacguaaucccauuguagaacaagucauuacagaaacucuacgaguaguaaaagauaucugguugaaauaugggaauggagccaaagacuucuucaacgaaauucauaucgaauugggacgagaaaugaaauuacccgcuaaagaaagagaggaccuaacgaggaaaauaacggaaaaugaaaauacaaaucuaagaauaaaggcuuuacuagcggaaaugaugaacgauucaagcguugaaaauguaagaccuuuuuccccaaugcaacaagaaauccuaaaaauauacgaagacggagucuuaaacagcggaauugagaucgaagaugaguauuugaaaauaaguaaaaccgcccaaccauccccauccgaccucaaaagauacaaacuauggcuagaacaaaaauauaaaucaccguauacaggacaaauuauccccuuaaauaaauuauuuacaccugaauacgaaauagaacauaucauaccucaaaguagguacuucgacgacagcuucagcaauaaaauaauuugcgaaagugcagugaacaaacuaaaagacaauuauauaggucuaggcuuuauuaaacaauuuggaggaacaauuaucgaacuuggauucgguaaaaguguaaaaguauucgagacggaagaauaugaagacuucguaaagaaacauuacgcaaacaaccggagcaaaagaaauaaacucuuauuagaagauauaccagagaaaaugauagaaagacaaauaaaugacacaagacauauauccaaauacauuagcggaguacucaguaacaucguaagaauagaugaugaccaagcgaagaaaauaauagaagaugcugaaauacucgcucgaaaagaaaucgacaaagacaaagccaaugaaauuagacgcaaagccaaaagucuagcgacagaugauggaauaaauagcaaaaacauuguuccaggcaacggaaaaauuacgacccaacuaaaacaagauuggggauuaaacgacgucuggaaugaucuaauauuaccaagauucgaacggaugaaccaacuuacaaacagcaaagauuucaccguauggaaugaaaaccaccaaaaauaucuaccaacaguaccaauagaguucucaaaagguuuuagcaagaaacgaauagaccauagacaccacgcacucgacgcauuggugauagccugugcgacuaaagaccauguaaauuuauuaaauaaccaaagcgcaaaaucagacacuaaaagauaugaucuuaaaaagaaacuaaugaaauuugaaaaaguaguauaucaucacacucaaacaggaaauaaaauugaaagagaaauaccaaaacaauuucugaaacccugggaaaacuuuaccuucgacgcgaaauauaauuuagaaaguaucaucguuuccuuuaaacaaaaccuacguguaauaaacaaagcgacaaauuacuaugaaaaauacguagaaaaggacggaaccaaaaauaaaggacgcguagaacagacaggaacaaauugggcuauaagaaaacccaugcacaaagauacaguaagugguaaaguaaaucuaccaugggucaaaguaccaaaaggaaaaauacuaacugcgacaaggaaaauacuagacaccagcuucgaccucaagaguaucgggucuauuacagauacagggauucagaaaauauuaagaaauuaccuugaguucaaaggaucccccgaacuugcuuucuccccagaaggcauagaagaucuuaacaaaaacauagaaaaguacaaugacggaaaaccgcaucaacccauaaacaaaguaagagucuucgaauuaggaaguaaauuccaagugggacaaacaggaaauaagaaagacaaauacguagaagcagcuaaaggaacaaacuuauucuuugcuguauacgaagauaaaaacggcaaaagaucauaugaaaccauaccacuuaaugaggucauagaacgucaaaaacaaggacuaagcguaguugacuuaaaaggaacaaacgauuuuuaccucugcccaaaugaucuagucuacauaccaagugaugaugagcuagaaaauaucaacaauauugauuucaagaacauagcgaaagagaaaaacgaaagaauauauaaaguuguuagcuuuagcgggucccaaauuuucuuuguaagacaagacauugcaacauccauaguaaacaaagcugagcuaucaacuuuaaacaaaauggaaagggcgauggacgguagcaugaucaaagaaagcugugucaaauuaaauguagacagguuaggcaacauauccaaggcuuga

SEQ ID NO: 5709 - RNA, 4401 nt, Artificial Sequence
  Cas9 variant
augacuaaaaauauacuaggauuagauuuaggaacaaauucgauuggaugggcgcuaauuaaacaagauuucgaaaacaaacaaggugaaauccuaggaaugggaucgaggauuaucccaaugucucaagauguauugggagaauuuggaaaaggcaauaguguaagccaaacagcagcacgaacagauuaucgaggaguaagacgacuacgcaaaagauuuuugcuucgcagggaacggcuccauagaguacugaacguacuaaacuuuuuaccgguacacuacgcuucacaaaucgauuucgagaaaagauucgggaaauuuaaagaagacacggaaccuaaacuagcauauaauaaagaaggcuuuauuuucaaaaacaguuuugaagaaaugguagcagacuuccgaaaacaucaaccacaauuacuugaaaacgauaagaaaauacccuaugauuggacaaucuacuauuugcggaagaaagcauuauccaagaaaauagaaaaagaagaauuagcauggauucuacucaauuucaaccaaaaacgaggcuauuaccaacuacgaggagaagaagaagaagaaaacccaaacaaacuuguugaauuuuacagccuaaaaauaaccgacguccuagcagaugaaccacaaaaaggaaaaucagacauaugguacagucucauuuuagaaaauggauggauuuacagaagaaguagcaaaacaccacucuucgacuggaaagagaaaacaagagacuucauaguaaccacugacuuaaaugaugacggaucgauaaaaaccgauaaagacggaaacgagaaaagaucauucagagcgccaagugaaaacgacuggacgcucgucaaaaagaaaacugaacaggaaauugacaaaagccagaaaacagucggaacauacauuuacgaaaccuuacuucaaaacccaaaacagaaaauaaaagggaagcuaguauguacgaucgaaagaaaauuuuauaaagaagaacuaaaacaaauacuagaaaaacaaaaagaauuucaucaagaacuacaaaaugacgacuuauauucagacugcguucaugaacuauaucgaacaaaugaagcccaucagcuaacauuaucuaagaaagaaauaguaaacuuauuuauggaagacuuaauauucuaccagagaccacuacguagccagaaaaccaguauaaguaacuguacacucgaguucaggaaauacaaagaugaaaauggcguagaacauacucaauuucuaaaagcaauaccaaaauccaaccccuacuaucaagaauuuagaauauggcaauggauauucaaucuaaacaucuacaaaagagacgacgacucaaacguaaccaaagaguuucuaaauacgacagaagacuucgaaaaucuuuucgaguuuuuaaauaaccgaaaagaagucgaacaaaaggcuuuacuaaagcacuucaaacucaacgaaaaacuacauagauggaacuucguagaagacaagaaauacccaugcaaugaaacaaaaacaaugauaagcacgcgauuagacaaaguagaaaacauuagcaaagacuucuuuacuagagaaauugaacagaaaauauggcacaucauauauucagugaacgacaaaauagaauaugagaaagcacuaaaaaguuucgccauaaaacauaaccuagacgaaaauucauuuuucgaagccuuuaagaaauuuccaccauuuaaaagugaauacggauccuuuagcgaaaaagcaaucaagaaacuucuucccuugaugagacucgguaaauacuggaacgaagaugaaauacuaaaauacagugacgacuacuucaaaaacauagaaagucuacuaggggugcuaaaacaaagagaugaaaacauaucugaugcugacagagaaaacuacaauaaaaccauaaacaauaaauuaagagcugaauuagaaaauuuucagaaugcagaaauagaauccuuucaaggucugagauuacacauagcccaauacauauuauacggaaaacauucagaaggagacaacaagaaauuuaauucagcagacgaucucgaaaaauuucuaaaagaguucaaacaacacucacuuagaaauccaauaguugaacaaguaauuacagaaacucuaagagugguaaaagauauauggacaaaauacggaaauggcgccaaagacuucuuugaugaaauacauauagaauuaggaagggacaugaagaaaacccgcgacgagcgugcggaugccacaaaaaucauaacagaaaacgaaaacacaaaucuucgaauuaaagcucuacucgcggagaugaugaacgacguagaaauggaaaauguacgaccguauucaccaaugcaacaagaaauauuaaaaauauaugaagaugguauuuuaaaaagugacauugaaaucgaagaugauauacuaaaaaucucaaaaaccgcccaaccgaguucuucagacuuaaaaagguacaaauuaugguuagaacaaaaauacaaaagcccuuacacaggacaaaucauaccgcuaaauaaacuauuuaccccugaauaugaaauagagcauauaauaccacaaucaagguauuuugacgauucuuucagcaacaaaaucauaugugaguccgcagucaacaaacugaaagacaacuacauuggacuagguuuuauaaagcaauucggaggaacaauaguggaaugcgguuuuggcaaaaauguaaaaguauuugaagcagaagaauaugaagauuuugucaagaaacacuacgcaaauaaucgaggaaagaggaauaaacuacuacuugaggaaauaccagagaaaaugauagaaagacaaaugaacgauacaagacauauaucaaaauauauaucaggcguacuaagcaacauaguaagagucgaagacggaucagaugaaggcguuaacagcaaaaauauaguacccggcaacgggaaaauuacaacacaacuuaaacaagacuggggacugaaugauguauggaaugaacuaauacucccuagauuugaaagaaugaaucaauuaaccaacucaacugacuuuacagcauggaaugaaaaucaucaaaaauuccuaccaacaguuccuaucgaguucagcaaaggauucucgaagaaaaggauagaucacagacaccacgcuuuagacgcauugauaauagccugcgcgaccaaagaucauguuaaucuuuuaaacaaccaaagugcaaaaagcgacaccaaacgauacgaccuaaagaagaaauuaaugaaauucgaaaaaguuguauauaaucacccucaaacuggugauagaaucgagagagaaguaccaaaacaauucuugaaaccaugggauaauuuuacuuucgaagccaaaaacaacuuagacaaaauuauugucaguuuuaaacaaaauuuacgaguaauuaacaaagccaccaacuacuaugagaaauucgucgaaaaagacggaguuaaaacaaaagaaagagucgaacaaaaaggcaccaacugggccauucgaaaaucgcuacaugaagaaacuguaagugggaaaaucgauuuacccugggucgaaacgaacaauggcgaguucauaacugcaacaagaaaauccuuagacgccuccuucaaucuagagaagaucaagaaaaucacagauacaggaauacagaaaauacuccguaacuaucuaaaagcaaaagacgacaaugccgaacuggcauucucgccagaagguaucgaggaucugaacaaaaacauagaaaaauacaacgacgguaaaucacaccaaccuauaguaaggguacgaguuuaugagaaaggaaagggcagauucgccuugggccaaacaggaaacaacauagauaaauacguacaaggaaguccaaaccuauucuucgccauauacaaagacgaaaauggcaagaaaucauacgaaucaaucagauuagacaucguaauagaaagaaugaaacaaggauuacaagcaguacccgaaaccaauccaaaugggauauccuuauaucaaaaccucucaccuuuagacuuaguauacauaccuacugaagaugaaaucgaaagcccccaccuaauagauuucacaauacuaaauaaaacccgacuagaaagaaucuauaaugucaacgauuucagugguuauacaaucuauuuuagucaaaacucauucgccaaaaacauauacccuaaagaaauggauaugacauggaaugagaagaaacagaaaccuagcggcagcuucgacucaaaaacagcaagcuauaacaaaaaguccauaaaagacauauuuauuaaacuaaagauagaccguuuagguaacauaucaaaaguaaguaacacgcucuga

SEQ ID NO: 5710 - RNA, 4401 nt, Artificial Sequence
  Cas9 variant
augaaaaacauauuaggauuagaccuaggcacaaacucuauaggaugggcccuaguaaaagaagauuucgaaaauaaacaaggggaaauccuaggacuaggaucaagaauaaucccuaugagucaagacauacuuggagaauuugggcguggaaauagcauuucacaaacugcagauagaacugguuacagaggaguccgacgacuccgcgagaggcacuuauuaaggcgagaaagacuacauagaguacucaacauauuaggauuucuaccuaaccacuacgcuaaagaaauugacuuuacuaaacgauuaggcaaauuuauaaaccacgcagaaccaaaacuaucguucgacaaagaauuuauauucaaagacagcuuuaacgaaaugcucaaagauuuucaacaaaaccaaccggguuucaucauaaauaagcacggcgaagaagcacuuguaccauacgacuggaccauuuauuauuuaagaaagaaagcucuaacucagaaaauagacaaagaagaguuagcauggauacuucuaaauuuuaaccagaaaagagguuauuaucaauugagaggagaagaggaagaagaaaacacaaacaaauugguugaauuuuacucacuaaaaauuaucgacguaauugcagauaaugaaguaaauaagaaaggugaaguaugguacagccuacauuuagaaaacggauggauauauagacggucgagcaaaauaucccuaguagacuggaaagauaaagucagggauuuuauaguaacaacagacguaaacgacgacgguuccgaaaaacuagacaaagacgguguaguaaaacgaucauuuagagcuccuagugcagaugauuggacacuuuugaagaagaaaacagaacaagauauagauaacuccaauaaaacagugggcgccuacaucuacgaaaaccuucuacuaaacccaaaacagaaaaucaaaggaaaauugguacgaacaaucgaacgaaaauuuuacaaagaugagcugaaacaaauccuagaaaaacaaaaagaauuucaccaagagcuacaaaacgaacaacuucuccaagacuguguacgagaacuauacaaauauaaugaacaacaucaacaaaugcucgaaaguaaagacuucguucauuuauuucugaacgacauuauauuuuaccaaagaccucuaagaagccaaaaaucguuaauuucaaacugcacacucgaaaagaggguaagcagagauggugucguguuuccaauaaaagucauaucgaaaucaaauccauacuaucaagaauuuagguuauuacaauggcugcaaaaucuugcaauauauagaaaagacgaugauguuaacgugacgcaagaguuccuaaacucaauagaaaguugggaaaaucuucuacaauuccuaaacgcgaaaaaggaaauaaagcaagaacaauuaauaaaguuucuacuagaacaaaaaggacuuaaaggaaauagucucaaaacagcaauccuaacuuacagauggaacuacguuacagacaagguuuauccuaugaacgaaacacguucgcuuauccaagacaaauuaaagaaaguggaaaacguugcaacagacuuccuauccuucgauaaugaaauggcacuauggcacauuauauacagugucaaugauaaaauugaauaugaaaaagcguuagcuaaauucgcuucaaaacacaaccuagacgaaauaucauucguggagaguuuuaagaaauucccaccauucaaaucagacuacggauccuucagugagaaagcgaucaagaaacuauuaccacuaaugagauucggaaguguuuggaacaaaaauaacauaguaccuagcguauuggacaggauagauaaaauacucacaggcgaauaugaugagaaaauaaaaauacgcguuagggaaaaagcagaacaauuccaauuaaaccaaauagaagauuuucaaaauuugccacuaugguuggcucaauaugucguauaugauagacauagcgaagcagaaaucgcaggaaaauggaacucugucaaagacuuagaaaauuauuuaaaagaguucaaacaacacucucuaaggaauccaauaguggaacaaauaaucacugaaacccuacgcgugguaaaagauauauggcaacaauacggcaauggaguucaaaauuucuucgacgaaauucacauagaacuaggacgcgaaaugaaaaacaccgcagacgaacguaaacggauaacaaauucuguaacggaaaaugaaaauacaaauuuacgaauuaaagcacuucugguggaacuaaaagaagauacaaacaucgagaacguuagaccgcacucaccaaugcaacaggagaucuuaaaaaucuaugaagagggaguauuaaaugcaguagaaaauauagacgaagauauccuuaagaucaguaaaacagcgcaaccaucgaaaucagaauuaauucgauacaaacuaugguuagagcagaaauaccaaucuccauauacaggagaaaugaucccauugagucgccucuucacuucugauuaugaaauugagcauguaauaccucaaagucguuauuuugaugauucccuaaguaacaaaguaauaugugaagcagcuguaaacaaaagaaaagauaaucaacugggauuagaguucaucaaaaaucaucauucagagaaaauagaacuagguaauggaagaacugcacaaguacuagaaguagaagcauacgaaaguuuugugaagaaaaauuaugacaaaaacaggggaaaaagaaacaaauuauuacuggaagacguaccugagaaaaugaucgaaaggcaacuaaacgauaccagauauauuucaaaauuuguaacacauuuacucucaaacauaguaagaaaagaugaaguuaacuccaaagaugacggaauaaauaguaaaaauauuauaccaggaaacggcaaaaucacaagccaacuaaaacaagauugggguuugaaugauguauggaacgaauuaauacuuccaagauucgaaagaaugaauaaccuaacaaauucaaccgauuucaccaguaccaacacaaauggaaaaauaauuccuacuguacccuuggaauacucaaaaggcuuuagcaagaaacguauagaccacagacaccacgcucuagaugcccuagucauagcgcuagccaccagagaccauguaaaccuccucaacaaugaaagugcauuaccaaagaaagacagaaccaaagaagaacaaaaaucuuucagguuugauuuacaagucaacuuaagaaacaaagaaaaauauuucaacgugaaagaaggacgagaaaaagaaaaauuuacuacauuuaagaaaccauggaacaccuuaacucaagauacacgcgaugccuuagagaauaugguggucucuuucaaacaaaacuuaagagugauaaacaaagcuacaaauuacuacgaaaguuauacagaugagaacggcaauuugcgauuagacaaauacgguaauccaaagaaagaauuaauaucacaaaaaggcacaaauugggcaauaagaaaaucauugcauaaagaaacaguaaguggacaaauacaccuagaccgcguaaaaguaacaaaaggaaaaauaguuaccgccacacgcaaaucauuagacucgaguuucaacgaaaaaucaauagaaucaauaacggacacuggaauccagaaaauucuucgaaacuauuuaaaagcaaaagacaacaaaccagacguggccuuuagcccagaagguauagaggaauuaaacaaaagcauaagcgucuauaaugaggguaaaaaccaccaaccaaucauuaaaguccgaaucuucgaacaagguucaaaauucccggugggagagacaggaaacaaaaucgcaaaauuugucgaggcagcuaaagggacuaaucuauucuuugggauauaccaagacaaaacaggaaaaaggucauacgacacgauaccauuaaacuuagucauagaacgacuuaaacagggucuaagcccuguaccagaaaccaaugaaaaaggacaucaauuacuauuccacuuaagucccaacgaucugguuuacgugccgacuaucgaugauaacgaacaacuagacaguaacagaguauacaaauuuacugacucaucugauacaacaugcaauuucauaccaagcaacauuagcgcaauaauauucaauauaaacaguaaagaacaagaaaaacgggggauaaauuaccccauacaaaacgaauuagggguaggaucaccccaaaguaaaaaccagaaaaguuucgaugguuucaugauaaaagaagugugcaucaaacuaaaaguugauagauuaggcaauauaucaaaaaccuga

SEQ ID NO: 5711 - RNA, 4416 nt, Artificial Sequence
  Cas9 variant
auguguaaauauuuuuauaucaaaaacuucauaacauucguuuuaucuaaaucaauaauacccaugaaacacauauuaggcuuagauuuagguucaaacaguauagggugggcauucguacaacaagauuuugaaaauaaacaaggcaaaaucauagcaacaggaucaagaauaauuccaauggaucaagguauuuuaggcgauuucgaacguggaaacacaguaucacaaaccgcggaaagaacaacauauaggucuacaaggcguuuaagagaaagacacuuauuaagaagagaaagauuacaucggguauuacacauauuaggauuuuugccuccccacuacgaugcucaaauagauuucacaaaacgguauggcaaauucaucgauaacgcagaaccaaaaauagcguacaacaacggaaacuucauauuuaugaacucguucaaugaaaugauagaagauuuuaagaaacaucaaccccaauuauuuuacaagaaaaguaacggugaagaaucgaaaauuccauacgacuggacaaucuauuaucucagaaagaaagcacuaucacagaaaauaacacaacaagaauuagcguggcuaauauugcacuucaaccaaaaacguggauauuaucaguugaggggcgaagaagaaacagaaaaucccaacaaagaagucgcauuucacucauugaaaguaguugacguagaagcagaagcaccaaacaagaaaggugaaaucugguacacaauaagacuugaaaacggauggauauaccgaagaacauccaaaaucccacuagacgacuggaaaggcaaaacacgugacuuuauuguaacaacagaucugaacgacgauggaaccauaaaagucgacaaagaagguaaagagaaaaggucauuccgugcuccagacgaaaacgacuggaaccuauuaaagaagaaaacagaacaugacauugacuuuucaggaaaaaccgugggagcguauaucuaugaccaccuauuacaaaaccccaaccagaaaauuaaaggaaaacucgugcgcaccauagaaagaaaauacuauaaagacgaacucaaagcaauauuagcaaaacaaaucgcacuccaaccggaacuuuucacugaaacauuacuggcagacuguauucgcgaauuauacaggaaaaaugaaacacaacaacagaacuugcucuccaaagacuuuuuacaccuguucguugaagauauaauuuucuaucaaagaccauuacgaagcaagaaaaguacaauugcaaauugcacccuugagaaacgaucauacauugacaaagaaacaaacgaacguaaagacgcacccauaaaagugugcgcaaaaucaaaucccuacuaucaagaguucagaguacuacaauggcuucaaaacuuaaggauauaugaaauagaaacagaccgagagguaacagcagaguucaucgaaacgccacaagacugugaagcauuauucaacuucuugaugucacaaaaagaaaucgacaauaaaggacuacuaaaauacuuucuguuugccaaaaacccacaaaucaaagacaaagccgccaaaucagaacuaaagaaauggcuaacgacauauagauggaacuacguauacgacgcggcugauaacucuagcaagaaauauccgaugaacgaaacggguuaugaauuacaaagauaucuacaaaaagucgaaggucuacccgcgaacuuucuuacauucgacauaacuuaucaacucuggcauuuacuauacucuguaaaagacaaaguugaguucgaaaaagcgcuaaagaaauucgccaaaaagaaacaacuagacaaaacuucuuucguugauucauucaaaaauuucaaaccuuacccaaaugaauauggaucguuuucagaaaaagcaaucaagaaacuauuaccucuaaugagauucggaaaucauugggacuucaauagaaucgacgucucaacacaaaaacgaauagaugauuuaauaaauggaguagcaaaugaggauauacggaccauuaucagggaaaaagcggaaaaauaccaacucaacucagagacuugcuuucaagacuugccucuuuggcucgcucaauacguugucuauaacaggcacgcagaagcaacagacauagaaaaauggaccagcguaucagaccucgaagcauaucuagaggauuucaaacaacauagucuucguaauccaauuguagaacagguugugacugaaacucuacguguaguuagagacaucuggcaacaauauggaggagggcaagcuaauuucuuugacgaaauucacauugaacuaggacgagaacuaaagaaaacagccgaggaacgaaaacaacucuccgacaaaaaucaggaaaaugagaguacuaaccuaagaaucaagaaacuacuagccgaacuaaaagaagaugccagcauacaaaauguucgaccguauuccuuaguccaacaagaacuccuaaaaauauaugaggaaggagucuucagugcaacagacgaaguagaagaagacauccagaaaauacgaaagaaagcagaaccuucuaaagcagaccugcaaagauacaaacuauggcuagaacaaaaauacaaaaguccauacaccggagaagucauaucgcuaaccaaauuauuuacagaagaauaugaaauagagcauauaauaccacaaagcagauacuacgaugacucccuaucaaauaaaguaauaugcgaaucagcagucaacaaacuuaaaaccaaccaacuaggauuagaauuuauucaaaaccaccacggggaaaaggucagaauaacagcaaauaaggaaguaacuauauuuaccgaagaacaauacaaagaguucgucaagaaacacuacgcuaauaauucagcuaaacaacagaaacuuuuacucaacgaaauaccggagaaaauggucgcacgacaauuaaaugauaccagauauauaaguaaauacaucucggaaauacuuuccaaaauaguacgcagugaugagaaagacgaagguguuaacagcaaaaacauuauacccugcaccggaaaaauaacaacagcauuaaaacaagacuggggccucaaugacgucuggaacaaacugauacuaccacgauucgaacgaaugaaucagcuuacucaaacacaauuauuuacaaguuacaaugaccgacuacagaaaaaucuaccaaccguaccuauagaguauagccaaggguuccaaaagaaacgaauagaucacaggcaucacgcaauggacgcacugguuauagcaugcgccacaagagaacauauaaacuauaugaacaaucaacacgcauuagauaaaucaaaagauaagaaagaaaaacaacaaucuagaauagacuugagaacaauacugugcgagaagaaaaauaauaacuggcaauucaagaaaccauggucaacauucacacaagaggccaaagaagcacucgaacauauagucgucagcuucaaacaaaauuuacgcguaauuaacaaagcaaccaauuacuacgagaaaugggaagagaaaaacgggguauuagucaagaagaaaguuaaacaagaagguacaaacugggcaauaagaaaaccucuucauaaagagacaguaagcggaaaaauaguacuagacaggaaaauaggaaaagauaaaauccuaacagcaacccgaaaggcaguugacauuacuuucacggagaaaaucauaagcucaauaacugacacagguauucagaaaauacuucucaacuaccuaaaauacaaagguagcccagaagucgcauuuuccacggaaggauuagaagaacuaaauaaaaacauagcacaauauaauaacgguaagaaacaucaacccauauacaaagugcgcauauucgaagagggaaguaaauucccucuaggagaaacuggcgcuaaagcaacuaaauauguagaagcagcuaaaggaacaaacuuauucuucgguguuuaucaagguaagggaaaaaggacauaugcuacaauaccuuuaaacgaaguaaucgagaggcaaaaacaaggccuaccguccguaccagaaagaaacgaaaaaggugaaccacuauuauucagcuuaaguccaaaugacuuaguuuacguuccaauggaaggugaaauagcugaaacaauagacuuuaacaaccuuucaaaagagcaaaaagaacgcauuuacaaaacaguuucguuuaccgguaaccaaugcuuuuucguucaggaagcagucgcaacuccaauagugaacaaaauggaauacuccccauugaauaaaauggaacgagauauccuagguaccaugauaaaggaaguaugcauaaaacucaaaguagaccgacuaggaaacaucacaaaagcguga

SEQ ID NO: 5712 - RNA, 4416 nt, Artificial Sequence
  Cas9 variant
augggauauaaagcgccacgaaaugauaaaggcgaaauagauuauggaguuggccuagaucugggcaacgggaguguuggaugggucgcaauggauaaagacuaccacuuaauucgggcucgaggccaugaauuaaucggugcucggcuuuucgaccccgcaaacucagccgaaaaccgucgcgagaguagaacaacacgaagaagauuaagccgacgaagauggcgauuaagaaugcuagauaguuuauucgcuagugaacuagcgaaaauagacccaaauuuucuagccagaagaaaauauucauggguucauccaaaagaugaacaaaaucaugaaaauugguaugguucaaucaucuuugggaguaaagaacaagacaagcaauuuuacaaagauuauccgacaauauaucaucuacguaagaaacuaacugaagacacagaacggcaugacauaagagaaaucuacguagcgauucaccacaucguuaaauacagaggacauuuucuacgagaaggagaaaucaauucagaaaauuuauuugauccagaaggcuucgucgaacuaauaaaagauguuauaaaacucaauaacucauaugaugagucuacaccuauuuuugaagcaucaccggcagauguaucagaagcgcuguuaaacgaacacacaucucgcaguggaaggauagaagauacauuagacaaauuggauuuuagugugucaagaguagauaaacacgaacucaaaggaaugagagacgcagcaaaagcaguuauuggagcaauaguagguaauacugcggauuuuagcaaaauauucaauuuagauaaccuugauaaagacucaaaagauaacuuaaaauuaaaauuugcagauaguaacuuugaugaaaaauaugguggaguagucggaucaggcuuguuggaugaaacucaaauagaacucguugaucgcauacacgcugucuaugaugcaguugcuuuaaaaggaauacuaggggaugcgcauacaauaucugaagcuaaaguggaaaguuacgaaaaacauaggaaaaacuggaaauuaauuaaagaagaacuccgaacaaaagagaauaaggaugaaguagaccuuugguacggcgauuugucuggucggcaauacaaaaaucccccagacccagaaaaaggacccgacgagggaagcaaaaaggauucaccaauaagagauucugaccaaaaacaaaauuuaaucaaaaaggcuaaugacuauuucacggaacuaauagacgauucacaacuuucagaagaacagaaaaauugccucaaaaacgauauuaauaaugggcaacuauuuccuguacaacgaaguagugauaauggaguaauaccauaccaaauacauuuaaacgaguuaagacgaauaauagaaaaucaaaaacaauauuaucccuuccucgcagaaacguucauacguaaaacugcugaagguaaaagcuaugaagagaauaagaucguagccuugcucaaauucagaguaccauacuauguuggaccccuaguuucaaaagaagauauggaggaacauaguuccggaaauucggcauaccauuggauggcacgcaacccaggcagaggcgaagcaauuacaccauggaacuucgacgaaguaguagauaaagaugaaucgggcgccagauucauaagucgauugacuggaacagauaccuaucucuuaggcgaaccaacacucccacaacacagccuacuauacgaagaauauaugguuuuaagugaacuaaauaacguucgauuaaacgucagacaaggaaaccauuggucagauaaaaacaggcaaagauuaucuuauaaacaaaaagaguucuuaaucgaaaauuuauuuaaagaacacaaaacgguaacacguaaacgagcggaagauugucuaagcucaauggguuguggggaaguacaacuauuuggauuaucugacgaaaagaaauucgcaagcagucugagcagcuauauuacauugaagaaaauucucggaaaagcauucguagaugacucugggaauagugcgauacuagaaaggauaauagaaguccaaacaguuuucgaagauagagaaccccuaacccaccaauugagucucauagacucacuuacaguagaacaaagaaaacagcuggcuaaaauacauuauacuggaugggguaaauuaaguagaaaacuucuuacaaguaagaaaggaucuuacaaaauucauagucaaaaugaaaucaugcgaacacaacacucaauaauugacauaaugagaggugauucucuaaaccuaaucgaaauaauuagggauaagaaaaucggaauaggagaauggauagacaacgaaaaccucgauagagaaacgggagaaagcgacguuuccagacuagaaaguguauuugaaggaauaguaaugucaccacguguuaaaaggggagucguacaagcagucagaguaauagaugacuuagcaaaagccauagggaauccaccacagaggauauuuauagaaauggcugaugaaguccaagcaagccaacggaccguuucccgccuaucacgccucaaagcauuauacggaaguccauccuuacaaaaagaguucaacgauuuaaaagaccuaagaaagagcuuaaaugaaacaaaagaugcagaucuacaggaagaucgacuauaucuauacuacauucagcuaggaaaagaucuauacacugguaaagaaauaucaauagauagcuuaagcucagcauacgauauagaucacauaguaccacaagcgcuaacccaagacgauaguaucgauaacagaguauugguaagcagaaaagaaaaugcaagaaagaccgauaguuauuuauauacaccagaccugauuaaaaacaugcgaccuuuauggggaaaacugcucgcugcgggauuaaugagccaaaagaaguaugacgcauuaacuagaguagaugacuucaaggacagagaaaaacaaagauucguacaacgaucacucguugaaacucgucaaauaaugaaaaauguuucaaccauacuucgcacuuauuauggcgaagauacaaauguaguaacauuaaaaucaucaauaacacacgacaugagaaaauaccuaggcuucccauacaagaacagggauauaaaugauuaucaucacgcacaagaugcuuuauguauaucugcagcaggacaauucaugcuaaacaggcacuuugucucuggaggcgaagucaccgauggcgccuccaacgccuacaauauguacuuagcagaauauuuacaggaguucagagacgcaaaagcccggggagaaagaaaaagaucaacagcuuuuggauuuguuguuggcuccaugucuucaaaagacgacgagaaaagaacugaccacaggacaggagaaauagucuggagcgaaaccaaugcagaauaccuaagaaaaguaaugaacuacaagaaaauguuaaucacacaaaaagugggagaugugaaaacucgagcacuguacgaugaaacacgauacgggcacaaagaaucuucagcaaaaucaauaaaauuugauaaucuucgaagagauacaucucuauacggaggauuuucaggugcuagcacugccuacaugauguuagucgaauauaaaaagaaaaauaagcuaguuucuauaacggcacaagaagcaaguuuacuugcuguagcagaccagaaaaacgacaccguaucaguaauggacggcauucuagcaucacacggauuaucaggagcuaaaaucuuacucccaaaaaucguaacaggacaacuacuagauuauagcgaugccuuagucacgcuucaaucugccucagaauuaaacacggcacgacaaaugugguuaccaagaaaugauuauaaugacauagauauaauuuugaaaucaaaagacauagaggaugcggcacacaagcuaggauacgacagugacaccguccacguauugcgacgaauccagaaacuauuugaggcuguauuucgaguugcugagagucaauuuccacuacaccaauuaucaaaagaucaacaagaagaaauacuacgagauccacaaaacuauggauuuggaucagcaguaaaguuacuaggaggcuuacucaaagcacuacaugcgaacgcagaaaauacaaacuuagcaggacuugugaaagugcuucauggagauaaagaauauucagacgacgguaaagcaaaagaauuuaagaaauucggguucagucccagauggcggcgcauaaguaaucccacaggauuuacgcugucggacuccgacacauucaucuaucaaaguccaaguggaauauuugaacagcgaguaacuguaaaagaauuaaaagaaaaagcagacaaacaaaaguga

SEQ ID NO: 5713 - RNA, 4422 nt, Artificial Sequence
  Cas9 variant
augaaaaacauacuuggacuggaucugggcaccaacucaauaggcugggcuuuaauugaaaaggauacagaucagaaaaaugguaacauauuaggaacaggaucuaggauaauaccuaugagccaagacaucaaagaugaguucggaaaaggcaacaguauaagucaaacagcagacagaacuaaguuucggagcguuaggagguuaagggaacgacaucuacuaagaagagaaagacuacauagaguacuaaacgugcuaggcuuucuaccaaaacauuaugccgaccaaauugacuucaagaaacgauuaggcaaacucgucaaugaaacggaaccuaagcuaguguaugacaauaaaaauuuuauauucaagaaaaguuucgaagccaugcuuucagacuuuaaccaacaucaaccauuauuauuagcagacggcaagaaaguaccauuugauuggacaauauauuaccuacgaaagaaagcacuaacagagaaaauugaaaaagaagaacuugccuggcuaauacuaaacuuuaaucaaaaacgaggauauuaccaauuaagaggagaagaagaagaagaaaauccaaacaaaaugguagcauuucacucacuaaaaaucgucgaaguaauagcagaugaaucccaaaaagguaaagcagaaaccugguacucuuuaauucuugaaaauggauggauuuacagaagguccagcaaaacaccccucuacgacuggaaaggaaaacaaagagauuucaucguuaccacagaucuaaaugacgauggaucaauaaaaacugauaaagaaggauuggaaaaacggucauuucgugcaccgguagaagaugacuggacucuaguaaagaagaaaacagaacaagaaauuaaucgaagccacaaaacuguuggcaccuacaucuacgagaaccucuuacaagacccaaaacagaaaaucaaagguaaauuaguaagaacuauagaaagagaauuuuacaaagacgagcuaaaaaugauucuuaaaaaccaacaaaaauuccacccagaacuaaaugacgaacaccuauauauuaacugcgugcgagaacuauaccgaaacaaccaagcacaucaaacaauccuuagcaagaaagacuuuguacaccuauuuauagacgacauaauauuuuaccaacgacccuuacgcucacaaaaaucaucuauuuccaacuguacccuagaguucagaaaauacaaaaaugaaaacggcaccgaucaaacagacuaccucaaagcaaucccaaaaagccauccucucuuccaagaauuuagacuauggcaauggauauauaauuuaggaauauaucaaaaagaagacgacaccaaugugacagaugaacuaaucaaaaauauagacggcuaccaggauuuauucgacuuucuaaacaacaagaaagaaauucgacaagacauacucauaaaauucuuggucgaacaaacaggacucaaaggaaaaccacuaucuucuguagucgcuaaauaucgauggaauuucguagaagacaaaauauacccgugcaacgaaaccggaacucaaauuaggacacggcucgccaaagucgaaaacacuccagaagauuuccucacagcagaaaccgaaauaaaauuauggcacauuauauacucagucaaugauaaagccgacuacgaaaaagcauuaaaaacauuugcugaaaaacauaaccuugauacacacagcuuugucgaaaauuucaagaaauucccaccauucaagucugaauacgggucauuuucugaaaaagcaauaaagaaacuccuaccauugauaagacuuggcaaauauugguccugggaaaacauagauaagaaaacucaagaaagaauagagaaaauuuuaacaggagaauuugacgaagcgauaaaaagucggguacgcgacaaagccauacacuuaacagaagaagaucacuuccaaggcuuacaacuauggcuagcuuccuacguaguauacgggcgucacucagaagcagauaaucuagauaaauggcauaccgucgcagaucuagaagauuacuuggcugaguuuagacaacauagucuucgaaacccuauaguagaacaagucauuacagagacucuuagaguaguaaaagacaucuggcuucaguacgggcaaggagcuaaagacuuuuucucugaaauucauauagaauuagcgcgugaaaugaaaaacacgggagaugaacgcaaacgacucacgaguuuaguaacggauaaugaaaauacaaaccuucgaaucaaagucuuauugucagaacuauuaaacgacgguaauguggagaauguuagaccauacucacccaugcaacaagaagcucuuaaaauauuugaagacggaguucuaaauuccgacauugaaaucgaagacgacaucuuaaaaauaagcaaaauggcgcaaccaacaaauacugaacuuaagagauauaaauuauggcuagaacaaaaauacagaucaccauacacgggucaaauaauaccacuuaaccgucucuucacagccgacuacgaaauagaacauauuaucccccaaagcagauucuuugaugacagcuuuucaaauaaaauuauaugugaaagugcggugaaccaacuaaaagauaaacaacucggucuagaguuuauuaaaaaccacagugguacgauagucaaguuaggcaugggcaaaacagccaaaauucucgacguagaaucauauaacgaguucguaaaaggcaauuauaccaaaaacauaucuaaacguaauaaacuuauguuagaagaaauuccagacaaaaugauugaaagacaauuaaacgacacacgauacauaagcaaguuuauuauaucagcgcuaaguaauauuguacgcuccgaaaguaacgaugacgguuucaauucgaagaacgucuuaccaggaaauggaaagauaacaagccgacuaaagcaagauuggggcaugaacgauauauggaacgaauuaauacuaccacguuuugaacguaugaauaaaauuacagauucagcugucuucaccgcauggaaugaaaacaaucaaaaauuucuacccauagugccccuggaguucucaaaaggauuccaaaagaaaaggauagaucauagacaucacgcauuagacgcuuuaguuauagcagcaucaacacgagaacacauuaaucuacuuaacaacgaacaugcgaaauccgauaaaagguuugacuuaaauagaaaacuccguaaguucgaaaagguagcuuacaaugacccaaaaaccgggaaacgcauagaaaaagaaguacccaccauauuucuaaaaccaugggaaacauucacaguagaugccaagaauagucuagaaucaauuauagucucauucaaacaaaacuugagaguaaucaaccgugcaacaaauuauagugaaucuuauaaugacgaaaauggugccuuaagauuaggaaaggaugguaauccguuaaaagagaaaauuaaacaaucaaaaggagacucaugggcaauccgaaaaccaaugcacaaagacuuuguauacgguaaaguacauuuacaaaauguaaaacugccaaaagacaaauucauaaccgcgauuagaaaaucacuagacguaacuuucgaccuaaaacguauagaaacaaucacagacaccggcauucagaaaauccugaaaaauuaucuacauucaaaagaaaauaaggucgaacuagcuuuuucaccagaagggauagaagauaugaaucaacacauagaacgauauaaugacgguaaaaagcaccaaccaauccauaaagucagaguauuugaaauagggucgagauucucacuaggagaaucaggcaacaagaaaacaaaauuuguagaagcagccaaaggcaccaaccuauucuucgcgguauaucaagacgauaacaaagggaaaagaaacuacgaaaccaucccauuaaacauagucauagaacgccaaaaauuaggcuuacacagugucccaacagaagacgcaaaaggcggaaaacuacuguuccacuuaucacccaacgacaugguuuaugugccuacuucagaagaacucgaagauaaccuugcgucaguuaacauaaaaagauuaaacacggcucaacguaaaagaauuuauaaaguggagaaagcaagcggaguugaaugcuacuuuauaagacaagacauagcuuaccucauuaaaaauuaugaugccaaaaccaagauaggagaacuagaaucccaaaauaaauuacaaaccacaaugacagacgacagacugaaaauaaccgauguuugcguaaaacuaaacauagacagauuaggauccaucgcagaaaccuucuuaggaaaucaauacggagcgucaaagaaaaccuga

SEQ ID NO: 5714 - RNA, 4422 nt, Artificial Sequence
  Cas9 variant
auggcaaaaauacuuggacucgacuuagguacuaacagcauaggaugggcaguaguugaacgugaaaauaucgauuucucuuuaauugacaaaggagucagaauauucagcgaaggagucaaauccgaaaaaggcauagaaucaucaagagcagcagaaaggacaggauacagaagcgcaagaaaaauaaaauacagaagaaaacuaagaaaauacgaaacccucaaaguucuaucauuaaaucggauguguccccuuagcauagaagaaguugaagaauggaagaaaucuggcuucaaagacuauccauuaaacccagaauuucuaaaauggcuaucuacagacgaagaaucaaacguaaaucccuacuucuuuagagauagagcaucaaaacauaaaguaagccuauuugaacuaggcagagcauucuaucauauugcacaaaggcgaggguuccuaagcaaccgguuagaucaaucggcugaagggauauuagaagaacacugcccuaaaauagaagcaauaguagaagacuuaauaaguauagacgaaauuucaaccaacauuacugauuacuucuuugaaaccgggauacuagauaguaacgagaaaaacggcuaugcaaaagauuuagaugaaggagauaaaaagcuaguuaguuuauacaaauccuugcuugcaauacuaaagaaaaaugaaagcgacuuugaaaacugcaaaucagaaaucauagaaagacucaauaagaaagauguauuagggaaaguaaaaggcaaaauaaaagauaucagucaagccauguuagaugguaauuacaaaacauuaggacaauacuucuacucacuauacucgaaagagaaaauccgcaaccaauacacaucaagagaagaacacuaucuaagugaauuuauuacaaucuguaaaguccagggcauagaccagauaaacgaagaagaaaagaucaaugaaaagaaauucgauggauuagcaaaagaucuauacaaagcgauauucuuccaaagacccuuaaaaucgcaaaaaggacucauaggcaaaugcucuuucgaaaaaucaaaauccaggugcgccauaagucacccagacuucgaagaauacagaauguggacauacuuaaauaccaucaaaauaggaacccaaagugacaagaaacuaagauuucuaacacaggacgaaaaacuaaaauugguuccaaaauuuuauaggaaaaaugacuuuaauuucgauguccuagcaaaagaacuaaucgaaaaaggaagcagcuucggauuuuauaaaucaaguaagaaaaaugacuucuucuacugguuuaacuacaaaccaacagacacuguagcugccugccaaguagcagccaguuugaaaaaugcaauaggagaagauuggaaaacaaaauccuucaaauaucaaacaauuaauuccaacaaagaacaagucucaagaacaguugacuacaaagaucuauggcaucuauuaacagucgcgaccagcgauguuuaucuauacgaguucgcaauagacaaacuaggacuugaugagaaaaacgcgaaagcauuuagcaaaaccaaacuaaagaaagacuucgcaucacuuucucuuagugcaauuaacaaaauacuaccauauuugaaagaaggauuacuuuacagccacgcuguauucgucgcaaauauagaaaauauaguagaugaaaauauauggaaagaugaaaaacagagagacuacauaaagacccaaauaagugaaauaauagaaaauuauacauuggaaaaaucacgauucgaaauaauaaacggacuacugaaagaguacaaaucugaaaacgaagauggaaaaaggguguacuauucaaaagaggcagaacaaaguuuugagaaugaccucaaaaagaaauuaguauuauuuuauaaaucaaaugaaauagaaaauaaagaacaacaagaaacaauauucaaugaauugcugcccauauuuauccaacaacuaaaagacuaugaauuuauaaaaauacaaagauuagaccaaaaaguacuaaucuuuuuaaaggggaaaaaugaaaccggacagaucuucugcaccgaagaaaaaggaacagcggaagaaaaagagaagaaaaucaaaaaccgacuaaagaaacuuuaccauccaucagacauagaaaaauucaaaaagaaaauaauuaaagacgaauuugguaacgagaaaauaguacuagggucaccccuuacaccuagcaucaaaaacccaauggcuaugagggcucuacaccaauuacgaaaaguccuaaaugcucuaauucucgaaggacaaaucgaugagaaaaccaucauucauaucgaaauggcccgcgaauugaacgaugcuaauaaaagaaaaggaauacaagauuaccaaaaugauaacaagaaauuuagggaagacgcuauuaaagaaaucaagaaacuauauuuugaagauugcaagaaagaaguagaaccaacugaagaugauauacuacguuaccaauuguggauggaacaaaaucguucugaaauauacgaagaagguaaaaauauaagcauaugcgauaucaucggaucaaacccagcuuaugauauagaacacaccauacccagaucaaggucacaggauaauucacaaaugaacaaaacauuaugcucacagcgauuuaaucgugaagugaagaaacaaaguaugccaauugaacuaaauaaccauuuagaaauucuaccaagaauagcccacuggaaagaagaagcggauaaccucacucgagaaauugaaauaauaucaagaucaauaaaagcugccgcaacaaaagagaucaaagacaagaaaauacgacgaagacacuaucugacauuaaaacgagauuacuugcaaggaaaauacgacagauucauaugggaagaaccaaaaguaggauucaaaaacucacaaauuccagauacuggaauuauaacaaaauacgcacaagcauacuuaaaaaguuacuucaagaaaguagagucaguaaaagggggaaugguagcggaauuucgaaaaauaugggguauacaagaaaguuuuauagacgaaaauggaaugaaacauuauaaaguaaaagauagaucaaaacacacccaucacacuauagaugcaauaacuauagcuugcaugacaaaagaaaaauacgaugugcuagcccaugcauggacccuagaagaccaacaaaauaagaaagaagccagaagcauaauagaagcaagcaaaccguggaaaacauucaaagaggaccuccuaaaaaucgaagaggaaauucuagucucucacuauacaccagauaaugucaagaaacaagccaagaaaauaguacgcgugcgugguaagaaacaguucguugcugaaguugaaagagauguaaacggcaaagcaguacccaagaaagcggccuccggcaaaacgauauacaaauuagauggagaagguaagaaacuaccgaggcuucaacaaggugacacuauccggggaucauugcaucaagauagcauauauggcgccauuaaaaauccacuaaacacggaugagaucaaauacgucauuagaaaagacuuagaaaguauuaaaggauccgacguagaaucuauaguggaugaagugguaaaagagaaaauaaaagaagcaauugccaacaaaguacuccuacucaguagcaaugcacaacagaaaaauaaguuaguagguacugucuggaugaaugaggaaaaacgaauugcgauaaacaaagucagaauauacgcaaacuccgugaaaaauccacuacauauaaaagaacacagucuuuuguccaaaucgaaacauguccauaaacaaaaagucuacggacaaaacgacgaaaauuaugcaauggcaauauaugaacucgauggcaaaagggauuuugaacucaucaacauauucaaucuugcaaaauuaauaaaacaaggacaggguuucuauccacuccacaagaagaaagaaaucaaaggaaaaauaguauucguaccgauagagaaaagaaacaaaagagauguaguccucaaacgcggacaacaagugguguuuuaugauaaagaaguagaaaaccccaaagauauaagcgagauagucgauuucaaaggacggauauauauaaucgaaggauuaucgauacaacguauuguaaggccaagugggaaaguugacgaauacggaguaauaauguuaagauacuucaaagaagcaagaaaagcugacgauaucaaacaagauaauuuuaagccagauggaguuuucaaacuaggcgaaaacaagccuacaaggaaaaugaaccauaaucaauucaccgcuuuuguagagggaauagacuucaaaguguuacccaguggaaaauuugagaaaauauga

SEQ ID NO: 5715 - RNA, 4425 nt, Artificial Sequence
  Cas9 variant
augaaaaaaauauugggauuagaucuagguacgaauagcauugggugggcuuugaucgaaagcgacuuugaaaagaaacaagggaaaaucaacgguuuagguucuagaauaauaccaaugucucaagacauccuaggaaaauucgauucgggagucaguauaucucaaacagcagaaagaacuaguuauagagguguacgaagacuuaaucaacgaaacuuauuaagaagagaaaggcuccaccgaguacuuaacaucuuggauuuucugccaaaacacuacucaaaugcaauagauuucgagaaaaaauuaggccaauucaaagaaaauguugaagaaaaacuaaacuacgccaaaaaccaaauaggaagacaugaauuuauauucauggauucauucaaagaaauggugaaagaauucaaacagacccaaccgcaacuuuucuacaaaagagaaaauggaauagaaacaaaaauuccguacgauuggacacucuauuaccucagaaagaaagcacuuagucaaaaaauaaaaaaggaggagcucgcauggauaauauuaaauuucaaucaaaaaagggguuacuaccaauuacguggagaagacgucuuagacgaaucgaaaauagaagacuuuuacaguuuaaagguuguggaaguacaggaaaccgaagauaaaaaugcccgcggaacuugguacaauguaauacucgaaaacgauuggguauacaaacggcaauccaaggagucacucgacaauuggauaggaaaaaacaaagaauucauaguaaccacgaauaaagaaaaagacggaucauuaaaacuugacaaggcaggcaauguuaaacgaaauuuuagagcaguagacuccgaaaaagauuggauugcaauuaaaaaaaaaacugaacaagacguugaaaucuccaagcauacaguaggucaauauauauacgaaacuuuacuacaaaaugcgaaacagaaaauaaaaggaaaauugguaaaaaccauagaacgaaaauuuuauaaagaagaauuuauaaaaauaauuaaagaacagcuaaaacaccauccagaacuacagagcaaaacacuuuacgaaaccugcauccaagaauuauacccucgaaacgaagcucaucaaaacaauauaaaaucaaaaggcuuugaguauuuguuuacagacgauaucauuuucuaccaaagaccauuaaaaaguaaaaaauccaccaucuccggaugucaauacgaaacacgccuguuuaaaaaaaccguucuuaauaaaguaacaaauaaggagaaugaaauauggcaaaaggagccucucaaagcgauaaguaaaucacauccauuauuccaagaauucagauuauggcaauucuugaagaaccuaaaaauauaccaaaaggaagauguaaagggaaaccucauagaucacgacauaacgagcgaucuacuaaagacugaagcagauugggucgaguuauucgauuuuuugaacauuaagaaagaaaucgagcaaaaacaaauaauacaauuuuuuauaaacaacaaacaaauagaaaagggcaaaaaaaacaacuacagguggaauuauguugaagacaaaaaauacccuugcaaugaaacuaaaagccaacucauaucuagacuuaaaaagguaaaaaaccuagacuuaaaccucuuuuucacaucagaaaccgaacuaaaacuauggcauaucauauauagcguaaaagacaaaauacaauaugaaaaagcaaucaaaaauuuugcaaucaagaauaauauagacauagacucauucguggaaaacuuuaaacgauucccuccuuuuaaaaaugaauacgcagcauacucagaaaaagccauuaaaagauuacuaccacuaaugagaaugggagaguacuggaacgagucugagauaaaacaagaaguuaaagauagagcauacuccaucaucgaaagauuaaaaggaauugauuucaauaaggacaaaauagaugagaaaaucacagacgacgacaucaaaaaacaacucuuaaaaucauucauagacuucaaagauaaaaauccuuuaaaaggacuaaacacguaccaggcuugcuacuuggucuauaacagacauagugaagucaacaguaucgcauauuggaaaucacccgacgacauuaauaaauauuuagaaggauuuaaacaacauucgcuaagaaacccuauuguugaacaaguugugacugaaacuuuacgaacuguaagagacauuuggcaauauuacggaaaaggaaaagcaucauucuuuaacgaaauccacguugaauugggaagggaaaugaaaaaucccgcauauaaacgaaaagcaucaaccaaccgugucacagagaaugaaaacacgaaccacagaauaaaagaaauucuuaaggaacuccagaaugaaggcguacaagaaguaaaaagcuacucuagaaaucaacaagaaauucucaaaauauacgaggaaggaauuuaucaaucgauagacguaguugacgaugcgaucgaaaagauacggaaaaacuccuccccaacgaaagcagaaauaauuaaauauaaauuauggcuagaacagggauacacuucaccuuacacagggaaaacaauuccaaugucaaaacuauuuacuacugacuaccaaauugagcauauaauaccacaaucacuauauuucgacaacucauuaagcaacaaaauaaucugcgaaagcgaaguaaaucaacucaaagauaaccaaacagcauacgaauuuauuaagaaacacggaacugaaaaagucagucuugggaaaaacaaaacaguagaaaucuuuacguuagaacaguacgaaaaacacugcaaccaauauuucaaaaaaaacaaaaacaaacuaaaaaaacuucucucagaagagauaccagaagguuuuauuaacaggcaauugaacgacucaagauauauaucaaaauuuauaaaaggucuauuaggaaaucuaguaagagaagaagacgaacaagagguaacaacaaaacacauaguuccaguaaccggcgcgauaaccucuaaacuaaaacaagauuggggauuaaacgauaaauggaacgaacucguagccagcagauuucaaagacucaacaccaugacaaacucaaacaauuucggauauugggacacgaagauuaaugcuuucagaguacaaguacccgaugaaaucaguaaaggauucagcaaaaaaaggauagaucauagacaucacgcauuagacgcacuaguuaucgcaugcugcaccagaaaucauaucaacuacuuaaacgcacucaacgcugaaaaaaaaaacuacggacuucgugaccuucuacuaauaaaaaacgacaaaaaccauuauacaaaauuuuucaaacauccaugggacggcuuuccaguagaagcaaaaagcguucuagaaaaaacaauaauaucauucaaacaaaauacaaggguaauaaacaaaacaaacaauaaaaccuggcaaugggccgagaaagaaggacaacuuaaaaaaguucugguaaaacagacaaaaggcgauaauugggccaucagaaaaccaaugcacaaagaaacuguuagcggaaagcuuaauauaccaacuccuaaagguaaaauugcaacagccucaagaguuucacugucagaaaucaagacaaggaaacaacucgacaaaaucacagacauaucaauccaaaagauauuggaaagacacuuaaacaauuaccuagacgauaaaggcaaagaaaaauucgaucuugccuucaacgcugauggagucgaagaacuaaacaaaaacaucaaaguuuugaacaaaggcaaaaaccaccaaccaauuuauaagguuagacuauaugaaaucggaucaagauuuaaaguaggaaacucaggaaacaaaaaggacaaauacguugaagccgcaaaggggacaaaccuuuucuuugcaauuuacuuaaaugaaaaagacaaaaaaagaguauaugaaacaauaccccuaaacgaggucauagagcaucaaaaacaaguaaguaaccuaccgaaaaacgagagaacaccgguaccagucaaucauacuaaaggcaaauuccuauuuagccuaaguccuaacgaccugguuuacguaccaacggaugaagaaauagauaacccaagucucguuaacuucaacaaucuuaacaaaaaacaagucgaaaaaaucuauaaaaccguaaguuguaguaccuaccaauguuuuuucguacauaacacgauauccaaacccauucaaaacaagguagaguucagugcuuuaaacaaaauggaaaaauccauagacggaauaaugaucaaggacagauguuggaaacuuaaaauggacagacuaggcaauauaauauccguaauacgcuga

SEQ ID NO: 5716 - RNA, 4443 nt, Artificial Sequence
  Cas9 variant
augaaaacaauacuaggauuagacuuaggcacuaauucaauuggcugggcaaaaguaugcguugacaacgauggaaacuauuuaagagacauuaaacuaggcaguagaaucauccccaugagccaagauacccugggcaauuuugauaaaggagugacagauucuccaacagcagcccggacaggauuucgcgguguccgaagaauacgagaaagagcacuacaaagacgggaaagauuacacagaguccuccacgucaugaaauuccucccaccacauuaugaaaacgcaauaggauggaacagagaagaagcaacgacguacggcaaauuccucaaccacggugaaccaaaauuagcaugggagaaacaagaggacgggagcaugagauuccucuuuauggacuccuuucaugaaaugauggcugauuuugcagagagccaaccugggcuaguagcaggcggaaagaaaauuccgcuggacuggacucuguauuaccuuagaaagaaagccuuaacacaagcuauaagaaaagaggaauuggccuggaucuuacuaaacuucaaucaaaaacgugguuacuaccaacuccguggagaggaagaugaggaaaaucccgcaaaaagagaagaauaccaugaauuaaaaguagucucagucgaggcagccgaggagggaaaaggaggaaacacuugguacaacguaacguuagaaaaugguuggauauauagacgccaaucaaaaguagaauuacaugauuggguaggaaaaacuagacaauucauuguuacgacagaauaugaaaaagacgguguaacaaucaaaaaggauaaaaauggagaaguuaaaagaucauuucgagcaccuagcgaagaugacuggggccuacggaagaaacgaacugagagcuuauuagaagauucaggaaaaacaguaggugcuuucauuuaugaccacauacuaagcgaaccaacggacaaaauaagagggaauuucauuagaacgauagagagaaaauacuauaagaaagaacucgaagcaauacuacuagaacaaacaaaacaucacaaagaguuaaaagaccaaaauacccucaucgcaugcauaaaagaauuauaucaaagcaacaaaccacaucaagacaguuuaaugaagaaagauaugacuuacuuacuaauaacagaccuuauauucuaccaacgaccacuaaaaagcaagaaaagccuaauagcggauugucccuacgaauauuacgaauauacaauaaaagaaaccggcgaaaucaaacgacaaggaauaaaaugcauagcaaaaagcaaccccuauuaucaagaguuccgacuauggcaauuuauaauaaaucuacgacuauucgaucgaaccgaugacaaagaaguaacaagcgaauacuuaucaaguauggaagacuauacaaaacucuuuacauaccuaaacgaucgaaaagacauaaaucaagaaacccuguuaaaagacuucuuuaaacaaaagaaaguuaaaauggggauggaaaaagaguucccaauaagauggaauuacauagaagauaaagagaagaaauacccauguaacgaaacacgacaugaacuauuggcagcacucgauaaagcagguauagaccauagcuggcuagacgacaaagaacguuuuuaucgacuuuggcaccuguuauacagcguggaaucgaaagaggaagcagaaggagcguuaagaaaacuuaaagacaacgacgacuucguaaacgcauucuuaaaaguaaaacccuucaagaaagacuauggagcauacagugaaaaagcuguaaagaaacuauuagcuauuaugcgaaugggcggacuguggaaugagacagauauaugcgaacaaacgagaaauagaauacaaucaauaauuaaaggagaaaucgaugagaaaauaaaagaaagaaugggacggacauuuugccaacuuucagauuuccaagguuuaccugaaugguuggccugcuacgucguuuauggaagacacagcgaagcaacagauauucaaagauggacaaaaccagaaaauuuaauggccuacauaaacgguuucaaacaacacucucuaaggaacccuauaguggaacaauguauuuuagaaacauuacgaacaguacacgacauauggaaagaagcgggacauauugacgaaauacauguagaacugggacgaucaaugaaaagcaccgcugaccaacgugcaaggaugagcaaaagcauacuacaaaacgagaauacgaauuuacgcauaaaaagucugcuaauggagcuaaagaacgcaaaagaaauagaaaacguucgacccuacaguccuaugcaacaagaaauauuaaggaucuacgaggaaggcgcuuuacaagaacugacaaaagaagaugcacaguauccggagauaucaaaaauaucacaaauggcccaaccuucggcuaaagaacuacuaaaauauaggcuguggcuagagcagaaauacugcuccccuuacacagggaaaccuauaucacuuagcaaguuauucaccucagcauaccaaauagaacauaucauaccacaaucaagguauuucgaugauagcuuuacaaacaaaguaauaugugaaacagaaguaaaccaguuaaaaaguaauauguuaggauacgaauuuauuaagaaacacucaggagagauaguacauuguacaacuauaggagauguaaaaauacuggaugcaaaagaauacuacaauuuuguaaccgaacauuacgcaaauaauagaagaaagaaagagaaacuacuauuagaagacauuccucaagaauuuuuaaauagacaaaugaaugacucaagguauaucaguaagaaaguuauggcaauucuaaguaauauuguucgcgaagaagacgaacaagaaacaaauagcaaauucguagucucuuguucgggaggcauuacagaucgccuaaaacaagauuggggauugaaugauguuuggaauaguauuguuuacccgagguuugaaagacugaauaaauuaacccaaacagaggcuuucggcagaugggaaaauaaagaaggcaaacaaguauuucaaacaagccuaccucuagaauuacaaagaggauucucaaagaaaagaauagaucacagacaccaugcaauggacgcauuagucauagcaugugcaucaaggaauauuauaaacuaccuaaauaacgaaucagcgaaaagccaagaacaacgggaagaccuuagaaagaaauuaugcgacaaaaaccgcauaauacguaaaccuugggaaaccuuuacacaagaugcgcgaacggccuuggaggaugucguuguauccuuuaaaaacuacgugagaguaaucaauaaagcaacaaacuacuaugaaaaauaugacgagucagggaagaaaggcauggcugaacagaaaggacaagacaugugggcuauucgcaaacccaugcacaaagaaaccguauuugggcaagucaaccuaagaagaaaaguaacaguaaaacuuaaagacgcauuagaaaauauaccagcuauaugugacaaagcauuaagagacuacguaaaugaccuuauagcaaagaaauuuaauacaaaacaaaugcuagcccauuucaaaucaauaaacuaccgacuaaauaugaaaagcguuaauaaaguuggaaucuggguauucucggacgaaaaagaaccuaugguagcaacccguaaggccauagacauaucauucgaugcaaaaaggauagauacaaucacagauacagguauacaacaaauauuaugcaaauacuugaaaagcaaaggaaacgauccgaacguagccuucacgcccgaagguauagcagagaugaauaaacauauaauagauuauaacaacggaaaacaacaccaaccaauccuaaagguaagaguuucagaaccgaaaggagcaaaauaucaaguaggggagaccgguaauaagaccaagaaauucguagaagcgcaaaaaggcacaaauuuauauuuugcaauauaugaggauaaagaugguaacagaucauacaacacuauuccacuuaacgagguagcugaaaggcuaaaacaggguuuaaguccuguuccagaaaagaaugaaaaaggaauaucucuaaaauuuuauuuaaguccaaacgacuuaguuuauguacccacagaagaagaaaaauuaucuaaugaaugcaaauuauccaaagaaaggauuuacaaaaugguaagcaguacaucaaacgaaugucauuuuauuccguacacaacggcgaaaccaaucuaugauaaauuugaauaugaagccaaaaacaaaaugggcagagcacuaacaggagaaaugauaaaagcuguuugcuggaaguuagaaguagauagacuaggaaacauauuaaaaauaauuaaauga

SEQ ID NO: 5717 - RNA, 4452 nt, Artificial Sequence
  Cas9 variant
augaaaacgauccuuggauuagaucuaggaacaaauagcauuggaugggcaaaaauaucaauagaugauaacggaaauuauuuacgagacauacaaaugggaagcaggauuauaccaaugagucaagacguucuaggcaauuuugacucaggaguaaccgagagucaaacggcgguuagaacaggguuucgcggacuacgaaggauacgagaacgaucgcuucuucguagagaaaggcuucauagaguacuacacgucauggguuuccugccuccacacuaugacuccgcaauaggauggaauaaagaggaacccaccacauaugguaaauuuuuaaaucauggagaaccaaaauuagcaugggaaagacaaggcgacgguagcaugcgauuucuauuuauggacaguuuccacaaaaugauggaagauuucgcuccccaucaacccgcccuuguggccgauggaaggaaaauaccguuagauuggacacuauauuacuuaagaaagaaagcucuaacacagcccauaaagaaagaggagcucgcauggauacuacuaaacuuuaaucaaaaacgaggauacuaccagcucaggggagaagaagaagaagaaaacccgacgaaaagagaggaauaucaugaacuaaaaguaguaucuguggaagcugcagaagagggaaagggaggcaacacaugguauaauguaaaauuagaaaaugguuggauuuaucgacgaaguucaaagaucccauuggaugauuggguaggcaaaacacgaccauucaucguaacaacagaauaugaggcugauggaaucacuuuaaagaaaaauaaagaaggagaagugaaaagauccuucagagcaccaggagaagacgacuggggcuuaagaaagaaacgaacagaaagucaauuagaagcaaguggcaaaacaguaggggcauucauuuaugaccaucuauuggcggaaccugcagacaagauaagagguaacuucauacgcacaauagaacgcaaauauuacaaacaagaacuugcagauauauuaagagaacaaucaaaauaccacgaagaacuucaaaguaagaaaauauuagcggauugugcagaagaacucuauagauccaaccaaccccauagggacucuuuauuaaagaaagauaugguauacuuacucuuaacagauauaauauuuuaccaaagaccuuuaaaaagcaaaaagucauuaauagccgauuguccauacgaguauuaugaauauguagacaaagagacaggagaaauaaaaagacaaggaaucaaaugcguagcaaaauccaacccauauuaucaagaauuuagacuauggcaauucguacucaauuuacgccucuaugacagaacagaagacaaagaaguaaccgcugaauacuuaccuuccaaggaagauuacgcuagacuuuuuguauaccugaacgaucgaaaagagauuaaucaagaaacgcuccuaaaagacuuuuucaaacucaagaaagucaaacaaagaucagaaaaagaguuccccguaagauggaacuauauagaagauaaagaaaagaaauacccguguaacgaaacucgccaugaauugcuuauggccuuagacagagcgggaaucgaacguaguuggcuagacgauacggcaagacaaugcagauuauggcaccuauuauauagcauagagguaaaagacgaggcagaaagggcucuacgaaaacuaaaagaugaugacgaguucguaucggcuuuucuaaaaguuaaaccauuuaagaaagauuauggagcuuauagcgaaaaggcggucaaaaagcugcucgcaguaaugcgaaugggcagucacuggugugaagaugacauaugcaaagaaacgaaagaacggauagaacacauucuacaaggagauguagaagagaaaauaaaggaaagaaugaaccacacagcauauaguuugggcgaauugagugacuuccaagcauuaccggaauggcuugcguguuauguaguauacggacgacacucugaagcgacagauauaaagcacuggaaaacacccgaaagccuuauggcauacaucaacggauucaaacaacauagucuaagaaauccaauaguggaacaaugcauacucgaaacacucaggacuguacaugacauauggaaagaagcaggacacauagacgaaauacauguugaacuagguagaucaaugaaaucaacauccgaucagagagcacguaugacugaaaacauacuaagaaaugaaaacacuaaucuuagaauuaagagccuauuaauggagcucaaaaacgacgccgacauaaaagauguacgaccuuauucaccaaugcaacaagaaauauuaagaauauacgaagaaggugcccugcaggaauuaacaaaagaagauaaugauuaugaagaaauuuuuaaaauauccaaaaugccccaaccaagcgcuaaagaacuacucaaauauaaacuguggcuugaacaaaaauaccggucaccauacacagguaagcccauaucccugucgaaauuguucacaucagcauaucaaauagagcacaucauaccucaaagcagauauuucgaugacagcuuuaacaauaaaguaauaugugaaucagaaguuaaugcguuaaaaggaaacaugcuuggcuaugaguucauuaaaaaucacggaggagaaauaguacacuguacacuacucggcgacguaaagguacagaaugaaagugaguauaaggcguucguuacagaacauuaugcuaacaacaaauauaagaaagaaaaauugcuaauggaggauauaccucaagauuuucuuaauagacauuuaaaugauagucgauacauuaguaaaguagucaaaacucuucuaucaaacauaguccggacagaagacgaaauggaaacaacaucgaaauucgucguaagcuguacgggagguauuaccgaucgauuaaagaaagauuggggucuaaaugacguauggaacucaauaguuuauagcagauucgaaagacuaaaugaauuaacuaaaagcgaugcauuuggacggugggagaauaaagaagguaaacgaguauuucaaacaaguguaccuuuggaacugcaaagagguuuuaauaagaaaagaauagaccaucggcaucaugccauggacgcacucguaauugcaugugcaucaaggaauauaauaaauuauuuaaauaacgaaagcgcuaauagcccaaagaaaagagaagauuuaaggcaacaauugugugauaaaaauagaauaauacgcaaaccaugggaaaguuuuacucaagaugcaagagcagcacuggaagacguaguagucucauuuaaaaacuacguuagaguuauaaauaaagcuacgaauuacuacgagagguaugaugccgacgguaagaaaaccauaacaaaacaaaagagcagagaaaugugggcaguuagaaaaccaaugcauaaagagaccguauuugggcacguaaaucucagaagaaaagcaauaguuaaacuaaaagaugcacucgaaaauauacccaguauauguaauaaagaauuacgggauuacauaaauggucuaguagaacgaaauuucaacacaaagcaauuacaugcacacuuucgaaguacugauuauagauggaauaagcaaaauguugacaaaguugaaguauggcgcuucucagaugaaaaggaaccauuggucgcaacucgaaaaccgcuagauaccuccuucgaugccaaacguauagacacaauaacugauacuggaauccagaaaauacuacugaauuacuuagaagcaaaaggaggagaucccuuaauagccuucacucccgagggaauagcagaaaugaaccaaaacauugccuuauacaacgauggaaaaaugcaucagccaauauuaaaaguacgaaucagugaacccaagggugcaaaauaucaaauaggacaaacuggaaacaaagcugacaaauuuguagaagcacaaaaaggaacaaauuuauacuuugcuauauacgaggaugaagaccgaaaccgaaccuacaauacaauaccacuaaaugaaguagcugaacgcuugaaacagggccuaccacccguacccgagaaaaacgaaaaagaagugccuuuaaaauucuauuuaaguccgaaugaucucguguauguaccaacagaagaggagauccuuaugaaagaaugcaaacuaaauaaaaacagaauauauaaaaugguaaguucaaccggaaaccaaugcuucuuuauaccuuuuagaguggcaguaucuauaguuaauaaaauggaauauuccccauuaaauaaaauggaaaaagcaauaagcucugaaaugauaaaagcagugugcuggaaacuagaaguagauagauuagguaacauuauaagggugguaaaauga

SEQ ID NO: 5718 - RNA, 4452 nt, Artificial Sequence
  Cas9 variant
augaaaacaauucugggucucgauuuaggaacgaacucgaucgguugggcgaaaguauccuuagaugauaaugguaacuaucuucaugauauaaaacuggggugccgcauaauaccgaugucacaagacguauuggacaauuucggaaaaggaguaacuguaagccaaacaucaguaagaacaggcuucagagguguaagaagaauaagagaaagaucauuacaacgacgagaaagauuacaccguguauuacaccgucugggauucuugccgcaacauuacgacgcagccauaggaugggacagcgacugcgcaaaaacuuauggaaaauuccuagacaacggggaaccuaaauuagcaugggaaagacaagaagaugggucaaugagauuucuauucaugaacagcuucuaugaaaugauagcagacuucacgagucaucagccugcgcuaguagcagacggcaagaaaauaccgcuugacuggacuuuauauuaucuaaggaagaaagcauuaacgcaagcaauaagaaaagaagaguuagcguggauauuacuuagcuucaaucaaaaacgagguuauuaccaacuaagaggggaggaagaagaugaaaauccgacaaaaagagaagaauuuugcgaacuaaaagugguagcaguagaagcagcagagaaaggcaaaggagaugacauaugguauaauguacaucucgaaaacggaugcauauauaggcgaucaagcaaaaucucauuagacgacugggugggaaaaacaaaacaauuuauaauaaccacugaauacgaaaaggaugguguaacucccaagaaagacaaagacggcaaagaaaaacgaucuuauagggcuccgaaagaagaugauugggguuuaaggaaaaagagaacggaaacagauuuagaagcgaguggaaaaacagugggcgccuucaucuacgagcaucuccuagcugaaccauucgacaagauaagaggaaauuuuauucauacgaucgaacggaaguacuauagagcagaacuagaagcgauacuuacagaacaaagaaaguaccacgaagaguuaagaagcgaacaaaugcuggcgguaugugcugaagaauuauacagauccaaucuaccacaccaacagagucuucuaaagaaagacaugguauaucuccuccugagcgaucugaucuuuuaccaacgaccacucaaaagcaagaaaucacuuauugcugauugcccauacgaauauuacagauacguagauaaagaaaccggagaaauaaagaaacaaggcaucaaauguauagcuaaaagcaacccuuauuaucaagaguuccgauuauggcaauuugugcuaaacuuacgcuuguucgacagaaugaccgauaaagaagugacagcagauuaccuccccacgaaagaagauuacguaagacuuuucgacuaccuaaauaacagaaaagaaauuaaccaagagacgcuucuuaaagacuucuucagauuaaagaaaguuaaacucggaagggaaaaagaauuugaaauaagauggaauuauauagaagauaaagagaagaaauacccaugcaaugaaacaagauacgaacuguuagucgcacuagacagagccgggauagacagaagcuggauagaugaagauggaagacaguaccgucuuuggcauuugcuauauucaaucgaagucaaagcagaagcugaaucugcuuuaagaaaauuaaauucugaugaugcauuugucaguucuuuucuaaaaguaaaaccauuuaagaaagacuauggcgcauauagcgaaaaagccguuaagaaacucuuggcaguaaugcgaaugggaaguauguggagcgaggcuaacauaugcgaggaaacccaaaaccgaauacguaguauaauaagaggagacauugaagagaaaauaaaagaacguaugggacauacggcaaggagcuuuaaucagauagaugacuuucaagcacuacccgaaugguuagcaugcuacguaguauacggcagacacucagagguaacagacauucaacauugggaaaccccagaacaauuacaauccuauauaaacggauuuaaacaacauagucugagaaauccaauagucgaacaauguaucuuagaaacgcucagaacaguccaugauauauggaaagaagcaggacauauagaugaaauccacgucgaguuaggaagagauaugaaaagaacagcugaucagagagcccguaugacuaaaaacauccucaaaaacgagaauacaaaccuaagaauuaaaucauuacucauggaacugaagaaagauacggacauaaaagaagugagaccauauaguccgaugcaacaagaaauauuaagaaucuacgaagaaggugcacugcugcaauuaaaaagagacgacgaagcauucgcagauauaagcaaaauaagccaaauggcucaaccaacugccacagaauuacgcagauacaaauuauggcuagaccaaaaauaccguucucccuacacugguaaauuuauaucccuaaguaaacuauuuacaucagccuaucaaauugaacacgucauaccucagaguagauauuuugaugauagcuucaguaauaaagugauaugcgaagcagagguaaaccgguuaaaaucaaauaugcuaggguacgaguucauaaaagcgcacggaggagaaauuguccacugcacaauguuaggagaugugaaaauccuaucagaaucugaauauaaggcuuuuguaaaugaacauuacgucaaucauagagcaaagaaagaaaaacucuuaauggaagauauuccacaagaauuucuaaauaggcaaaugaaugauucaagauauauaucaaaaguuguaaaagcguuauuauccaacauuguaagaacagaagaugaaauggauguaacuucaaaauucgugguaccaugcagcggagguaucacggacagauugaagaaagauuggggucuaaacgacguuuggaauaguauaguuuaccccagguuugaacgacuaaacagaaugacagguacagaagcauuuggacacugggaaaauaaagaaggaaaaagaguauuccaaacuucaguuccuauugaauuacaauuagguuucagcaagaaaagaauugaucacagacaucaugcaauggaugcauuagucaucgcaugugcaagccgaaacauaauaaauuaucugaacaacgaaucagcaaauucucaaaagaaaagagaagaccucagaagacuacuaugcgacaaaaacagaaucauacgcaaaccaugggagagcuucacccaagacgcgagaguagcauuacaagauauaguaguaucauucaaaaauuacguacggauuaucaauaaagccacaaauuauuaugaacgauacgaugaacaagguaagaaaacuacggcggaacaaaaaucuagcgaaaugugggccauaagaaaacccaugcauaaagaaacaguauucggucacguaaacuuaaaaagaaaaacaacgguaaaacuaaagaacgccauugaaaauauaccaaauauauguaauaaagaauuaaaagccuauauaaacgagcuaguugaaaaacauuucaauacuaaacaaauguuagcccacuuuaaaucaauaaauuacagauggaauagacagaauguagaaaaaguugaaguauggcaguauucagaugaaaaagaacgcauggcagcaacaagaaaaccauuagauacaucauucgauaagaaacguauagaaaccauaacugauaccggaauacagaaaauacugcuuaacuaccucgaagaaaaaggaggagauccaaauauugcuuucacacccgaagguauagcagaaaugaauaaaaauaucagcuuauucaaugacggaaaacuucaccaaccaauauuaaaaguaagaguagcuaaaacaaugggagcaaaauaccaaguaggacaaacagggaauaaagcagcaaaauauguaggagcccaagaaggaacuaacuuauacuuugcgauauaugaaaacgaggaaggagaaagaucguauaaugcuguaccauuaaaugagguggcugagcgccuaaaacaaggcaugucaccugugccagagaaaaacgaaaaagacguaccacuaaaauuuuauuugucgccaaaugaccuagucuauguaccuacagaagaagauaaacuaagcaaugaauguaaauuagauaacgaaagaauauacaaaauggugagugcaacaggaaagaaaugccauuuccuaccguacucagucgcaaauaucauauacaauaaaguagaauuugaaagcaugaauaaaaugggaaaagccuuaagcggagaaaugauaaaagccguguguuggaaacuagaagucgacagacuaggaacgauauugaggguaauaaaauga

SEQ ID NO: 5719 - RNA, 4452 nt, Artificial Sequence
  Cas9 variant
augaaaacagaacuagaccuuaacaaagaucgacuauauaaacauguauuaggucucgaccuuggaguaacaucaauaggguuugcacacguaguugaaagcgaaaauaggaaugaaucagaaauaaaacaaauaggaguaagaguaauacaacucgauaauuuugauaaaguagauaaaucaggaaaaacaucagaaagcaaaaaccccgcaguggauuucgcagcagggaaaggucucacaccaaacgggucaagaaccaagaaaaggggagcaagacgaaauuuagauagguaucaagacagaagggauaauuugcuugaaguauuaacaaaauccggauucauaaacagugaaacaaaacguacugaagacggaaaacauacaacacaccaaacaugggaaaucagagcuaaagcaguaagcgaaaaaguagaaaaagaagaguucgcgcgaauacuccuugcuaucaacaagaaaagaggauauaaaucgucaagaaaagccaaaaacgaagacgaaggucaagcaguagacggaauggcaguagcuaaaagacuauaugaagaaaaccucacaccaggacaauaugcguacgaaguauugucugggggaaagaaaucaauuccagacuucuacaggucagauuuacaagcagaauuugacaaaauuuggaacuuucaaaaacaauuuuacccgaauauacuuacagaugaauuuuacgaagaacucaaagggaaagggcaaagagcaacgagcgcagcauucuggaaaauucaucaauuuaacacagccgacauuaaagauuuagaagacgaguugaaaaacgaaagaacaauaaaauuaucuaaaagagaucagaagaaacuacaggcuuauaaauggcgauccgaagcgguagugaaacaauuagguaaagaagaaguugcauauguguuaacagagauaaauaacaacuuaaacaacaguagcggauaccuaggagcaaucucggaucgcuccaaagaacuguauuuuaacaaacagacaguuggacaauuccuauacaaacaacucaaagagaacccccacacaagacucaaaaaucaaguauucuauaggcaagacuaccuagaugaauuugaaacaauaugggaaaugcaagcacaauuccacccagaacuaacacaagaauugaaagaagaaauucgagacauuauuauauuuuaucagaggaaacuaaaaucacagaaagggcuuauuucuuuuugcgaauuagaauccaaagaaguaguaauuaacgauacgaagaaaaucauuggccuaagaguggcgccgaaaucaucaccauuauuccaagaguuuaaaauuuggcaaaauuugaauaacgucuuagugagaaagaaagggucacguaaaagaauggugaaagcucaaaaccaacauucacuuuuugaagaaccuaaagaaaucuuuagcuuagauuuagcauccaaagaaaaacuauucgaagaauuaaacuugaaagguaacuuaucagcuaaaaauugucucgauaucuugggacuuaacagcaaugaaugggaauugaauuacacacaacuagaagggaacaggaccaacaaaucucucuacgaagccuuccucaaaauacuagauauugaaggauaugauguaaaagaccuacuaaaagucaaaucauccaaagacgaaguagaacuagacgaucuaaaagugcccgcaucugaaauuaaaaacaugguaagagaaauauucucgacgaauaaaauagacacugaaauauuggacuucgaugcagaaauagacggaaaagcauucgaaaaacaaaguaguuaucaauuauggcaucuacucuacucauacgaaggugacgauucucaaucaggaaacgaaaaauuguacgagcuauuggcuaaaaaguuuggauucaagagagaacaugcucagauacucgccaauguaucauuaguugacgauuacggaaauuuaucaaguaaagcaaugagaaaaauauauccacauauaagagaaaacaacuacucgaccgcuugugaauuagucggauacagacauucuaaacacagccucacaaaagacgaacuuaaagauaggguacuggaagacagauuagagcuauuaaagaaaaauucuuuaagacaacccguagucgagaaaauacuaaaccaaaugauuaaugcaguaaaugcuuuaauagagaaaaacuccgaacgagacgagaacgguaauaucacaaaauauuuuaaauucgacgagaucaggauugagcuagcaagagaacuaaagaaaaaugcagcagaaagagcugaaaugacaacaaacauaaaugcggcgaaauuaguucaugagaaaauauucaaaauauuacaaaaugaauuugggaucaaaaacccaacacgaaaugauauuauucgauaccgauuauacgaagaacuaaaagguaauggauacaaagauuuguacagcaauaccuauauaccaagagaaauacuauuuagcaaucaaauagauauagaucacaucuuaccccaaucuaggcuuuucgaugacuccuucagcaauaaagucguaguguuccgcaaagacaaucuaaagaaagguaaccaaacagcaauugauuacauuggaagugaaguuggugaggaaggacucaaaaacuucauagaaagagucgaaagccuauacgaacuuggcaagaaaaauaaagaagaaggaaucucuaaagcaaaauaucagaaacuauuaaagucagcuucagagauaggagauggauucauagaacgagauuuaagggaaucacaauauauagcuaagaaagcgaaagaauuacucuucaaaguaaccagaucaguaguuaguacaaguggauccauaacugacagauugagagaggacuggggucuaauaaaugugaugaaagaauuaaacuuaccuaaauauaaaucacucggacucacagagauacaagagagaagaaauggacaucaaguagaagugauaaaagauuggacaaaaagaaacgaucacagacaucacgcaauggacgcauuggcuguagcauuuacaaaacauaaucacauacaauaccuuaauuacuugaacgcucggaaaaaugaaagccacaaauugcauggcaacaucauagcuaucgaaacacuagagacagaagucaaaauugacgaccucgguaacaagaaaaggguauuuaaggaaccaauuccgaacuucagacaaguugcaaaagaacaucuagagaacguucuaauuucacacaaagccaaaaauaaggucgucaccaaaaauaaaaacaagauuaguggcaaagaaaaauuacaaauaacacuuacaccacgaggccaauugcauaaagaaacagucuacgguaaauacagguucuaccagaguaaagacgaaaaagucagcgcaaaauuugaccuagaaacaauagaaaaaguagcaaacccaagcuauaaagcagcacuucuacaacgauuaaacgaaaaugaaaacgauccuaagaaagccuucagcggcaaaaacgccuuaucuaaaaacccaaucuauauaucaauggaaaacgacauuaaaguaccagacaccguuaaacuuguguggcuagaagaagauuacucaauaagaaaagauguaacaccugaaaauuucaaagacgagaaaucuauugagaaaauauuagaugaagguguuaaaagaauacugaaaaacagacuuaaagaauuugguggugaugcaaaagaagcauuuagcgacuuagacaaaaacccaaucuggcucaaugaggagaaaggaacaagcauuaaacgaguuagaauuuccgguguuaaaaacgcagaaccgcuucacuauaagaaagaucacuucgguaaugacauacuagacggaaacgguaauaaaauuccggcagauuucguauccacaggaaauaaccaccacguagccauauauaaagaaccggaauuugauaagaaaggacaaccagugcucgaugaauuaggaaaccagaaauauaacuugcaagaaaaaguuguaucauucuucgaagcugucgaaagagucaaccaaggauuaccaauaauugauaaaacuuacaaccaacaucugggauggcaauucuucuuuacaaugaagcaaaacgaaauguuuguauuuccaaacgagaaaacacgguucaauccaauagaaauagaccuccuagacccaaauaauaagaaacucauaagccuuaaucuauuuagaguacagaaaauagcaaauaaaaacuacauguuucgacaucaccuagaaacaaauguagaugacaagaaagaaaugaaaaauaucgcuuucauacauauccaaaguugcaauuuacuuaaagaaauaauuaaagucagacuaaaucauuuaggagacauaguaaguguaggagaauacuga

SEQ ID NO: 5720 - RNA, 4452 nt, Artificial Sequence
  Cas9 variant
augaaaacaauacucggucuagacuuagguaccaacucaauagguugggcaaaaguaucagucgaugaucaugguaacuacuugcacgauauaaaauugggcagccgaauaauacccaugagucaggauauacuaggaaacuucgacaaagguguaacagaaucacagacagccaucagaaccgguuuccggucuguaagacggauaagagaaagaucauuauuaagaagagaaagacuucaucgaguccuccaugucaugggauuuuugccuccgcacuacgauucagcaauaggcuggaaucgggaagaggcaucaacauauggaaaauuucucaaccauggagaaccaaaacuggcgugggaacgucuugaagacggaagcaugcgcuuucuguucauggacucauuccaugaaaugauggcaaacuucgcaagacaucagccagcgcucguagcagauggaagaaagauacccuuggauuggacacucuacuaccuaagaaagaaagcacuaucacaagcuguaggaaaagaggaacuagcauggauauuguugaauuuuaaucaaaaacgaggauauugccaacuucgcggcgaagaagaagaagaaacaccuacaaaaagagaagaauauuacgaacuaaaagugguaucggucgaagcagcagaggaaggaaaagguggaaauacaugguaucgcguucaauuagaaaacggauggauauaucgaagaccauccaaaauagcauuagacgauugggugggaaaaacaaaacaguuuauaguaacaacagaguaugaaaaagauggaacuacacuaaagaaagacaaagacggagaaguaaaaaggagcuucagagcaccaggggaaaaugauuggggguuaagaaagaaaagaacugaaagccaacuugaggcaucugguaaaacgguaggagcauuuauauacgaccaucuuuuagcugaaccagccgauaaaauacgugguaauuuuauaagaaccauugaaaggaaauauuauaaacaagaauuagaagcaauacuaagagaacagaccaaacaucaugaagaacuaagaucaaaagaaaugcuugcuaaaugugcagaagaauuauaucaaagcaaccaaccacaucguaaaagucucuuaaacaaagacaugaccuaucuacuucuuaccgauuuaauauucuaucagagaccacuuaaaaguaagaaaucacuaauugcagaauguccauacgaauacuacaaauauaaagauaaagaaaaagguaaaaagaaaagacagggaaucaaauguguagcaaaaucaaauccauauuaccaagaauuuagacuauggcaauucauaguaaaccucagacuauuugacaggacagaugacaaagaaguaacugccgaauacuuaagaagcagagaagacuaugcacguuuauuugccuaccuaaacgauaggaaagaaauuaaccaagaaacgcuuuuaaaagacuucuuuggacuaaagaaaguaaaaauuggagcugagaaagaauuugccaucagauggaacuauauugaagauaaagagaaaaaguauccuuguaacgaaacucggcaugaacuucuucuagcauuagaccgagcaggcauggaccgaaguuggcuugacgauagcgaauugcaauacagacuauggcauuuauuauacuccguagaagcaagagacgaagcggaaggggccuuacgaaaacuaagggacgaugaugaauuuguaggagccuuuuuaaaggugaagcccuuuaagaaagauuauggugcuuauagcgaaaaagccguaaagaaauuguuagcgguaaugcgaaugggaucuugguggcaugaagaagauauaugcaaacaaacacgugacagaauagaaagaauaguacaaggagacauagaagagaaaauuagagaacguaugggccacgcugcauauucauuuucccgauuagcagacuuucaagggcucccggaauggcucgcuuguuauguuguauacggacgacacagugaagcuacccacauuuugagaugggacaguccagauaaacuauuaaguuacauuaaggguuuucggcaacauagucucagaaacccaaucguagagcaaugcauauuagaaacguuacgaacaguccaugacauauggaaagaagcgggacacauagacgaaauacauguagaacuagggagaaguaugaaaagcacagcggaacagcgugcacacaugaccaaaaauaucuuaaggaaugaaaacacaaacuuaagaaucaaaugcuuacuuauggaauuaaagaaugacgccgaugugaaagauguaagaccuuauagcccuaugcaacaagaaauacuacgaauauaugaagagggagcguugcaacagcugacgaaagaugacgcggaauaugcagaaauaagcaaaauaaguaaaauggcgcaacccucagcaaaagaacuucuaagauauaaauuauggcuagaacaaaaauauagaaguccuuacacaggcaaaccuauuucacuaucaaaauuguucacaucagcauaccaaauagaacaugugaucccgcaaucacgcuauuuugaugacuccuuuaauaauaaagucauaugcgaaucggaaguuaauacacugaaaaguaauaugcuaggguaugaauuuauuaaaaaucacuguggagaaauaguacacugcacuauguuaggagauguuaaaguauuuucagagagugaguauaaagcauuuguaacagagcauuacucaaacaacaaauauaaaaaggaaaaacuucuccuagaagauauaccacaagaauuucuuaacaggcaaaugaaugacagucgcuauauaagcaaaguuguaaaagguuuauuaucaaauguaguccgaacagaagacgaauuagaagcgacaucuaaauucguggucagcuguacgggaggcauaacagacagacuuaagaaagacuggggauugaaugacguauggaacagcauaguguauagcagauuugagagauuaaacggucuaacgaaaagugaacauuuuggccacugggaaaauaaagaaggaaaacgcguauuucaaaccucaguuccuauggaauuacagcgcggcuucaacaagaaacguauagaccacagacaccacgcaauggaugcauuaguuauagcaugugcaucgagaaauauuauuaauuacuuaaacaacgaauuugccaaaaguccaaaacaaagagaagaucuacgucaacuucucugugacaaaaauagaauaaucagaaaaccuugggaaacuuuuacucaggaugcuagggccgcauuagaagauguagucguguccuucaaaaauuauguaagagucauaaauaaaacaacuaauuauuaugaaagguaugaugcugacggaaagaaaacaaugguaccucaaaaagguaacgaaaugugggcuguaagaaaaccaaugcaugaaggcacaauguacggaagagucaaucuaagaagaaaagcugucguaaaauugaaagaggcacuugaaaauauaaguagcauauguaauaaggaguuaagagacuauauaaauguucuaguagaaaagcaguuuaacacaaaacaacuguuagcacacuucaaauccauggacuacagauggaauaagcaacauauugacaagguagaagucuggagauucagcgacgaaaaaguacaaauggucgccgcccguaaacccuuagacacgagcuucgauaaagaauguauagcaaguauuacggacacagggauacagaaaauacuucuaaauuaccuagagucaaaaggaggagauccugcaauagcauuuacaagcgaagguaucgcagaaaugaaucaaaacauagcaguuuauaaugauggaaagaaacaucaaccagucauaaaaguuaggaaauccacgaaauuaggaaagaaauuugcaguaggucaaauaggaugcaaaagcaaacaauuuguaguggcggaagcagguacgaaucuauacuuugcaaucuacgaggacgaagaaggaaaaagaaguuacgacacaauccccuuaaacgagguaacagaaagauuaaaacaaggauuaagccccguaccagagaaaaaugaaaaagaaguaccacucaaauucuaccuuaguccuaacgaucugguauacgucccuacagaagaugaaaugcaaaugaaagaaugcaaacucaauaaagaaagaauuuauaaaaugguaucgaguacugguaaugaaugucacuuucuaccauacagcguagcaaguguuauuuauaauaaaguagaauuugaaagcaugaacaaaauggguagagcacuaacuggagaaaugaucaaagcugucuguuggaaguuagacguagauagauugggaaauauauuaagggugauaaaauga

SEQ ID NO: 5721 - RNA, 4452 nt, Artificial Sequence
  Cas9 variant
augaaaacaauacuaggacucgauuugggaacaaauucgauagggugggcaaaaauuucaauugacgauaauggcaacuacuuacgagauauucaauuaggcaguagaauaauaccuaugucacaagauguacuuggcaauuuugacaacgguguaacagaaucacaaacagcaguaaggacaggguucagaggauuacggcguauacgggaaaggagucuacuaaggagagaacguuugcacaggguacugcaugucaugggauuucucccuccccacuacgacagcgccauaggcuggaauaaagaggaaccaacaacauauggcaaauuccuaaaccauggagaaccaaaacuggcaugggaaagacaaggugaugguucaaugagauuuuuauuuauggauucuuuucacaagaugauggaagauuucgcaccucaucaaccugcauuagucgcugacggacgaaaaauaccuuuagacuggacauuauacuauuuacgaaagaaagcacuaacgcaaccaauaaagaaagaggaacuagcguggauacuuuuaaacuuuaaucaaaaacgaggauauuaucaacuacgaggagaagaagaagaagaaaacccuacaaaacgcgaagaauaucacgagcuaaaaguaguaggaguagaagcugcugaagaggguaaaggagggaacacgugguacaacguuaaacuagaaaauggcuggauuuauagaagaaguucaaaaauuccacuagacgacuggguaggcaaaacuagaccauucauaguaacgacagaauaugaagcagaugguauaacccuaaagaaaaacaaagaaggagaaguaaaaagaucauuucgagccccgggggaagacgacuggggguuauggaagaaaagaacagaaucgcaauuagaagcaucaggaaaaaccguuggcgcguuuaucuaugaucaucuauuagcagagccugcagauaaaauccgagguaacuuuauacguacaauagaaagaaaauacuauaaacaagaacuagcagacauauuaagagaacaaucuaaauaccaugaagaacuucaaaguaagaaaauccuagcggacugcgcugaggagcuauauagaagcaaucaaccucacagagauagcuuacucaagaaagauaugguuuaccucuuauugacagauuugauauuuuaccaacgaccgcugaaaucaaagaaaucauuaaucgcagacugucccuaugaauauuaugaauacguagacaaagagacaggagaaauaaaaaggcaagggaucaaauguauagccaaauccaacccguauuaucaggaauuucgacuuuggcaauucguacuaaauuugcgacuuuaugacagaacagaagacaaagaaguuacagcagaauaccuccccucaaaagaagauuaugcaagacuauucguauaucugaaugacaggaaagaaauaaaccaagagaccuuacuuaaagauuucuuuaaauugaagaaaguaaaacaaagaucagaaaaagauuuucccgugagguggaauuauaucgaagacaaagaaaagaaauaccccugcaaugaaacacgacaugaauuguuaauggcauuagauagagcaggaauagaaagaaguuggcuagaugacacggcaagacaauacagauuauggcacuuguuauauaguauagaaguuaaagaugaagcagaaagagcauugagaaaacuaaaagacgaugaugaauuuguaagugcuuuccuaaaagucaaacccuucaagaaagacuauggcgcguauucggaaaaagcaguuaagaaacugcuagccgugaugcggaugggcagucauuggugugaagacgauauuuguaaagaaacaaaagaaagaauugaacauauccuacaaggagacguaggagagaaaauaaaagaacggaugaaccauacagcguacucacucggagaauuaagugacuuccaagcauuaccagaaugguuagcauguuacguaguauaugguagacauagugaagccaccgacauuaaacauuggaagaccccagaaucacuaauggcauauauaaacgguuucaaacagcacagccuucgaaacccaauagucgaacaaugcauauuagaaacguuaagaacuguacacgacauauggaaggaagcaggacauauagaugaaauucacguagaacuaggaagaaguaugaaaaguacaucugaucaaagagcgagaaugacagaaaacauacuuaggaacgaaaacaccaacuuaaggauaaaaucacuucuaauggaguuaaagaaugacgccgacaucaaagauguacgacccuauagcccaaugcaacaagagauauuaagaaucuacgaagaaggagcucuacaagaacucacaaaagaagauaaugauuacgaagaaauauucaaaauuaguaaaaugccacaaccgucagccaaagaacuuuuaaaauacaagcuaugguuagaacaaaaauauagauccccauauacaggaaaacccauuucacucucgaaacuauuuacaagugcauaccaaauugaacacauuaucccccaaucuagauacuucgaugauagcuucaacaacaaaguaauaugugaaagugaaguaaacgcauuaaaggggaacauguuagguuacgaguucauuaaaaaccacggaggcgaaauaguacacugcacacuacuaggagacguuaaaguacagaaugaaagugaauauaaagccuuugucacagaacauuacgcaaacaauaaauacaagaaagaaaaauuacuaauggaagauauaccacaagacuuccugaacagacaucuuaaugauucaagauacauaucaaaaguagucaaaacacuacuaucaaauaucguaagaacagaggaugaaauggaaacaacaucaaaauucgucgucucuugcaccggaggaauaacagauagguuaaagaaagacuggggacuaaaugacgucuggaacuccauuguuuacucucgauuugaaagacuuaaugaauugacaaaaucagaugccuuugggcgaugggaaaauaaagaagguaaacguguauuccagacuagcguuccccuagagcuucaaagaggauucaauaagaaaagaaucgaucacagacaccacgcaauggacgccuuagugauagcaugcgccagcaggaacaucauaaacuaucucaauaaugaaucagcuaacucuccaaagaaaagagaagaccucagacaacaacuuugugauaaaaauagaauaauacgaaaacccugggaaucauucacgcaagacgcaagggcugcccucgaagauguaguaguuaguuucaaaaacuaugucagaguaaucaauaaagcaacuaacuacuaugaaagauaugacgcagauggaaagaaaacgauaacaaaacagaaaaguagggaaaugugggcaguuagaaaaccaaugcauaaagaaacaguauuuggacacgugaacuuacgaagaaaagcaauaguuaaauugaaagacgcacuugaaaacaucccuucaauaugcaauaaagaauuaagggauuauauaaaugguuuaguagaaaggaauuucaacacaaaacaacuccacgcacacuuccgcagcaccgauuacagauggaacaaacaaaacguugacaaaguugaaguauggagauuuagcgacgagaaagaaccgcuaguagcaacaagaaaaccucuagauacaaguuuugaugccaaaaggaucgacacaauaacagauacaggaauacagaaaauauuacuaaacuaucuagaagcuaagggcggagacccacucauugcauuuacaccugaaggcauagcagaaaugaaccaaaauaucgcccuauauaacgauggaaaaaugcaucaaccaaucuuaaaaguaagaauuagugaaccaaaaggcgcuaaauaucagauaggucaaacgggaaacaaagcggacaaauucgucgaagcucagaagggcaccaaccuauauuucgcaauauaugaagaugaggacagaaaucguacauauaacacaauaccacuaaacgaggucgcagaaagacuuaaacaaggauuaccacccguaccagagaaaaacgaaaaagaaguaccucugaaguuuuacuugucuccuaaugaucuaguguacguaccgacugaagaagaaauauuaaugaaagaaugcaaacucaacaaaaauagaauauacaaaaugguuucaucaacuggaaaucaaugcuucuucauaccauucagaguugccgucucgauagucaauaaaauggaauacucuccucuuaacaaaauggaaaaagccauaucauccgaaaugauaaaagcuguaugcuggaaauuagaaguagaccgccuaggaaauauaauaaggguagucaaauga

SEQ ID NO: 5722 - RNA, 4458 nt, Artificial Sequence
  Cas9 variant
augaaaaacauacuuggcuuagacuuaggaacuaauucuauagggugggcaaaaaucucaauagaugacaacgguaaauacaucaaagacucaauaaaacucggaucacguaucauucccaugucucaagacguuuugagcaauuuuucaaaaggaguuacauuaagccaaaccagugagcgaacaaguuucagaggagccagaaggcuccgagaaaggaccuuacuacggagagaaagacuacaccggauacuucaccuacuaggcuuccuaccuaaacacuacgaaaaagccauaggcugggauagaaaugacaauaaaaccuacggaaaauucauuaaccacgcagaaccaaaauuggcauggugcaaagacaauaacggcaaaaugagauuuuuauuuauggacucauuucacgacaugcucuccgaguuuagcgaaaaacacccagaauuacucgcaaacgguaagaaaauuccauuagacuggacgauauacuaccuaaggaagaaagcgcuauauaaagccauaacaaaagaagaacuagcauggauuuuacuaaauuucaaccagaaaaggggauauuaccagcuuagaggcgaagaagacagagauagcgaagcaaacaagaaagaauacuuagaauuaaaaguaauuggcguagaagcaacaggagagaagaaagguaacgacauaugguauaacauacaccuagaaaacggcuggauauauagaagauccucuaaaaauccucucaaugacuggcuaggaaaaguuaaauccuuuaucguaacaacagaucuagacgccgauggaaaccccaagaaagacaaagacggaaauaucaaaaggagcuucagagcaccgucagaaggagacuggacauuaauaaagaaaagaacagaaucccuucuugaaaacaguggucaaacgguaggccaauuuauauauaaucacauuuuggaggagccaucagccaaaauaagaggaaauuucauaagaacaauagagcgaaaauacuacaaagacgaacuaaaagcaauacucgaaaaacaaaaagaguuccaucacgagcuaagcucagaaucacuacucacagaaugugcgaaagaacuauauaaacgcaacaucgcacaucaagaagucuuacuuaagaagggcaugauucaucuucuccuaaaugacauccuguucuaucagcgaccccucaaaauaaagaaaagccugauagauaauuguccguaugaaaacuauaaauacguagacaaaaagucuggggauauaaaaguaaaaagcauaaaaugcauagccaaaucaaauccauucuuccaagaauuuaggcucuggcaauucgugaguaaccuuagacuauacagaaaaucagaugacaaagacguuacaagcgaacacuuaguaacgacagacgacuacgccaaccuuuuuaccuaucuaaacaaucgaaaagacauaaaacaaucuguacuucucaaggaauacuucaaaaucaagaaaguuaaaacaaucaacggggcugaauauccuguccgguggaauuauauagacgacgauaauaaaacauacccguguaacgaaaccagauaugauaucuuacacgcacuuucuaaaacggaauuaaaauccgaaugguugacaccggaacgaaccuauagguuauggcacuuauuguacucuauagaaaguaaagaggaaacaaagaaagcccugaauaaauuaaauuuaucagacgauuucacagaggcuuuucucaccauuaaaccuuucaagaaagaauacggaaguuauucagagaaagcaauuaagaaacuacugucauuaaugagaaugggauacuuauggagugaagacgaagcaauaaaacaaguaggugcggaaauagagaaaacaauagaaggagaacuaccggauuacguguuacaaagauuagaaaagagccaacacaauuauaauaaaauaucagacuuuucaggccuuccacuaugguuagcaucuuacauuaucuauggaaggcacucagaagccaaagaaauaauucacugggauaacccagaauccaugauggccuauauaaaagauuuuagacaacacucaaugaggaacccaauaguggaacaauguguacuagaaacuuuaagaacaguccacgacaucuggaaagaaauaggacacauagacgaaauucauauagaauuagguagagaaaugaaauccacuucugaacaacguaaagccaucacacaaaacguacuccauaaucaaaacacaaacauaagaauaaaauugcuacuacaagaacuuaaaaacgauaacaacauaacagggguccguccguacaguccgaugcaacaagaaauacuacguauauaugaagaaggagcacuacaaggccuaaccaaagaagauaaggacuauaacgauauauuaaagauaagccaaacagcgcaaccaacaaguaaugaacucaccagauauaaacuauggcucgaacaaaaauaccgaagcccauacacaggaaaagcaauuucgcuaaguaaacuauuuacaucagcauaccaaaucgaacacguuauaccacaaucccgauacuuugacgauucacucucaaacaaaguaauaugcgaaucggaaguaaauacauuaaagaaagccaugcuagguauggaauuuauaaaaacauguggaggacaaaaaguccauugcacgcuacuaggagacguagaaauauacaacgaagaagauuauaaagccuucgucaaugaacauuauagcaauaauagaacuaaaagaaauaaacuuuuaauggaagauaucccacaagaguucaucaaccgacaacucaacgauagucgguauauaucuaaaauggucaaacaacuuuuaucagcaaucguuaggggacaagaagaaguagaagcaacaucaaaauucguaauaccaugcaccggcggaauaacagaucgacuaaagaaagacuggggacuaaaugauauuuggaacaauuugguaaguccacgauuucaaagaaugaacgcacuaacaggcucugaauacuucgggcacugggaaaauaaagaaggcaaaagaguauuucaaacuacaaugccuauucaacuacaacaagguuucaguaagaaaagaauagaccauagacaucaugcaauggacgcccuagugaucgcaugcgcaucuagaaacauaaucaguuacuuaaauaaugaaacagcacaagauaccgaacgaagaagagacuuacgacaaaaacuuugugacaaaggggguucuguaagaaaacccugggacaguuuuacacaagauacccaauaugcacuaaaagauaucauagucaccuucaaaaacuacguccgcauuauuaacaaagcaaccaauuauuaugaacacuacaaaacugacggaaagaaagguaugauuucacaaaaaggugacgaacucugggcgauaagaaaacccaugcacaaagaaacgguauucggaaaagucaaccuaagaagacccaaaagagucucacuuucaaaagcuauagauucaguagauguaauuuguaaucgaaaauugaaaaaguacauaaaagcacgacuaaacgagggccuacaaaagaaacaaauauuaaacauuuucaaagaaguaaauaacguaugggaaggcaucgacgucaacaaaauagacaucugggagaugucaaacgauaaagaaccaaugguggcgacaagaaaacaacucgacacuagcuucgacgaaaagaaaauccgaucaauuucagacacaggaauacagaaaauauuauuaaacuaccugauuacgaaaaacaauaauccugaacuugcauucacaccugaagguauucaagaaaugaacucuaauauaucagaauauaaugaccacaagaaacaccaaccaauauauaaagugcgcgucacagaaccucuuggagcaaaauauccaaucggaacaauggggaacaacccaaagaaauucguggaagcacaagcagggaccaaucuuuauuucgccauauacgaggauaaagaagguaaucgaaacuacgacacaauccccuuaaacaucgcagcagaaagauuaaaccaacaacuuagcccaguccccgaaaccaacgaaaauaauacuccacuaaaauucuaccuaagcccaaaugaccucguauauguaccuagcgaggaagagaggcauagugguaacaacauacaacuagauaaaaaccgcauauacaaaaugguaucaagcaccaguaagcaaugcuucuuuauacaccaccguguggcaauauccuuaguagauaagaaagaauuuagugcacaaaacaaaauggaacgaucaauagacaacgaacaaguaaugauuaaaucaguauguuggaaacugauuacugauagacucggaaauauuauaaaagucauaaaauga

SEQ ID NO: 5723 - RNA, 4458 nt, Artificial Sequence
  Cas9 variant
augaaaaacauauuaggacuugaucucggaaccaauucaauuggaugggcaaaaauaaguauagaugauaacgguaaauacauaaaagauagcauuaaacuaggaucaagaaucauaccaaugucucaagauguccuaucaaacuuuagcaaaggcgucacucuuucacaaacaagcgaacgcacaucauuuaggggagccagacgccuccgggaaagaacucuauugcgaagagaacguuuacaccgcauuuuacauuuauuaggguucuuaccgaaacauuacgaaaaagcaauaggaugggacagaaacgacaacaaaacauauggcaaauucauaaaccacgcugaacccaaacuagcaugguguaaagacaacaauggcaaaaugagauuuuuauuuauggauagcuuucacgauaugcuaucggaauuuuccgaaaaacaucccgaauuauuggcaaacgggaaaaaaaucccucuagauuggaccauauacuaccuucgaaaaaaagcucuauacaaggcuauuacuaaagaagaacuagcauggauacuacuaaacuuuaaccaaaaaagaggcuacuaccaacuacgcggcgaggaagauagagacucugaggcaaacaagaaagaguacuuagaauuaaaaguaauaggagucgaagcaacaggagaaaaaaaagguaacgacaucugguacaacauacaccuagagaauggcuggauuuaccgaagaucuucgaagaaccccuuaaacgacuggcuuggcaaaguaaaaagcuuuauaguuacaaccgauuuagacgcagauggaaauccaaaaaaagacaaagacggaaacauaaaacgaaguuuccgugcccccuccgagggagauuggacacuaauuaaaaagcgaacugaaagcuuauuagaaaauucaggucagacaguuggacaauuuaucuauaaucauauccuagaagagccaucagcaaaaauaagaggaaauuuuauccggacaauagaacgaaaauauuauaaggacgaacucaaagcaauacuugaaaaacaaaaagaauuucaccaugaacugucgucugagucauugcuaacagaaugugcuaaagaacuauacaagcgaaauauugcucaucaagaaguuuuacuaaaaaaaggaauaauucaucuuuuacuaaacgacauauuauucuaucagagaccacugaaaaucaaaaaaucgcuaaucgauaacuguccauacgaaaacuacaaguauguggacaaaaaaaguggagauauaaaagucaagucuauuaaaugcaucgcaaagagcaacccauuuuuucaagaauuucgacuauggcaauucguauccaauuuaagauuauaccgaaaaagugacgacaaagacgugaccuccgaacauuuaguaaccacagacgauuacgcaaaucuauuuacauaccuaaacaauagaaaagauaucaaacaaagcgugcuacuuaaagaauacuucaaaauuaaaaaagucaaaaccauaaauggagcugaauauccaguuagauggaacuacauagacgaugauaauaaaaccuauccaugcaacgaaacuagauacgauauucuacacgccuuaucgaaaaccgaacugaaaagugaauggcuaacuccagaaaggacauacagacuauggcauuugcuauauuccauagaaaguaaggaagaaacuaaaaaagcgcucaauaaauuaaauuuaagugaugacuucacggaagcauuucuaacaauuaaaccauuuaaaaaagaauacgggaguuauagugaaaaagccauaaagaaauuacuaagccuaaugagaaugggguauuuauggagcgaagacgaggcuauaaaacaagugggagcugagauugaaaaaacaauugaaggagaacuuccagauuauguccuacaaagacuagaaaaaagucaacauaacuauaacaaaauaucagauuucucuggacuaccccuauggcuagcgagcuacauuauuuacggaagacacuccgaagcaaaagaaauaauacacugggacaaccccgaaucaaugauggcauacauaaaagacuuucgacaacacuccaugcgaaauccaauuguagaacaaugugucuuagaaacacuuagaaccguacacgauauuuggaaggaaauaggacacaucgacgagauacauauagaauuaggccgagaaaugaaaucgacaucagaacaacgaaaagccaucacacaaaacgucuuacacaaccaaaacaccaauauaagaauaaaacucuuauugcaagaauuaaaaaacgacaacaacauaacuggagucagaccauauagccccaugcaacaagaaauauuacguauauacgaagagggagcacuccaaggauugacaaaagaagauaaagacuauaaugauauacugaaaauaucccaaacagcucaaccgacaagcaacgaauuaacccgcuauaaacuauggcuagaacaaaaguacaggucuccguacaccggaaaagcaauaagcuuaucuaaauuauuuacaucagcauaccaaauagaacacgucauaccacagucaagauacuuugaugacucacugucuaacaaaguaauaugcgaaucagaaguaaacacacuuaaaaaagcuaugcuaggcauggaauuuauaaaaaccugcgguggacaaaaaguccacuguacauuacuaggagacguugaaauauauaaugaagaagauuacaaagcauuuguaaacgaacauuauuccaacaaccgaacuaaaaggaauaaacuacuaauggaggauauaccacaggaauucauaaaccgacagcucaacgauagcagauauauaucaaaaaugguaaaacaacugcuaucagcuauaguacgaggacaagaagaggucgaagcaacgagcaaauucguuauacccugcaccggaggaauaacagacagacuaaaaaaagacuggggcuuaaacgauauuuggaacaauuuaguaagcccucgcuuccaacgaaugaacgcucuaacagguagcgaauacuucggacacugggaaaacaaagaagguaaacgaguauuccaaacgacgaugccaauacagcuccaacaaggcuuuucuaaaaaacgaaucgaccaccggcaccacgcaauggaugcuuuagucauagcuugugcuagucgaaauaucaucaguuaccuuaacaaugaaacagcucaagacacggaacguagaagagaccuucgccaaaaacuuugcgauaaagggggaucagugcgaaaacccugggacucauucacacaggacacacaauacgcccuuaaggauaucauagucacuuucaaaaacuauguacguauaaucaacaaagcaacaaauuauuacgaacauuacaaaaccgacggaaaaaaagggaugaucucacaaaaaggcgaugaguuaugggccauacgaaaaccaaugcacaaagaaaccgucuucggaaaaguuaaucuccgcagaccaaagcgaguaucgcuaagcaaagccaucgacucagucgacauaauaugcaaccgaaaacuaaaaaaauauaucaaagcgagacuaaaugaagggcuacaaaaaaaacaaauacugaacauauucaaagaacugaacaauguaugggaagguauagacguaaauaagauagacauaugggaaaugucaaaugacaaagagccuaugguugcaacccgaaagcaacuugacaccaguuuugacgaaaaaaaaaucagaucaauaucagacaccgggauacaaaaaauacuucuuaauuaucuaauuacgaaaaauaacaacccugagcuagcuuucaccccggaaggaauacaagagaugaauucaaacauuucagaauacaacgaccacaaaaaacaccaaccuauauauaaaguuagaguuacagagccccucggcgcgaaauaucccauaggcacgaugggaaacaauccaaaaaaauucgucgaagcacaagcaggaacaaaccuauauuuugcaauauacgaagacaaagaaggcaagaggaauuacgacaccauaccgcuaaauauagcagccgaaagacugaaucaacaauuaaguccgguuccugaaacaaaugaaaacaauacaccacucaaauucuaucucucucccaaugaucucguauauguacccagugaagaggaacgucacuccggcaauaacauucaacucgacaaaaacagaaucuacaaaaugguuucuagcacuucuaaaagaugcuucuuuauucaucacagaguagcaauuucauuaguugacaaaaaagaauuuucagcacaaaacaaaauggaacgaagcauugauaacgaacaagucaugaucaaaagcguaugcuggaaacuuaucacagacagguugggaaauauaauaaaaguuaucaaauga

SEQ ID NO: 5724 - RNA, 4458 nt, Artificial Sequence
  Cas9 variant
augaaaaacauacuagggcuagaucuuggaacuaacuccauugggugggcaaaaaucucaaucgaugacaacgguaaauauauaaaggacaguaucaaacucgggaguagaauaauaccgaugucacaagacguacuaucaaacuucagcaaaggaguaacacuuucucaaacaucggagcgcacaagcuuucgaggagcaagacgucuacgcgaaagaacacuuuuaagaagggaacgacuacacagaauacuccaccuccuagguuuucugcccaaacacuacgaaaaagcaauaggaugggauaggaaugauaauaaaacauauggcaaauuuauaaaucacgcagaacccaagcuagcauggugcaaagauaacaauggcaaaaugcguuuuuuauuuauggauagcuuucacgacaugcuaucugaauuuagugaaaagcacccugaacuacuagcgaacggcaaaaaaaucccacuugauuggacaauauacuauuuaagaaagaaagcuuuauacaaagccauaacgaaagaagaacucgccuggauucuacuaaacuuuaaucaaaaaaggggauacuaucaacuacgaggagaagaagaucgagacagugaagcaaauaagaaagaauauuuagaguugaaagugauuggaguagaagcaacaggggaaaaaaaaggaaaugauaucugguacaacauacaucuagaaaacggcuggauauacagaagauccagcaaaaaccccuugaaugauugguuaggaaaaguaaaaagcuucauagucacaacagacuuagacgcggacgguaacccuaaaaaagauaaagaugggaacauaaagagaucauucagagcaccaucagaaggcgauuggacacugauaaaaaaacgaaccgagucauuauuagaaaacucaggacaaaccguuggccaauucauauacaaccauauauuggaagaacccagcgcaaaaauaagagggaauuucauaagaacaauagaacggaaauacuauaaagaugagcucaaggccauacuugaaaaacaaaaagaguuccaccacgaacuaucaucggaaucgcugcucacugaaugcgcaaaagaauuauacaaacgaaauauagcccaccaagaaguauuacuaaaaaaaggaaugauacauuuacuauuaaaugauauuuuauuuuaccaacguccacuaaaaaucaaaaaaucuuuaauagauaacugcccuuacgagaauuacaaauacguagauaaaaagucaggugauauaaaaguaaagagcauaaaaugcauagcgaaaucaaacccauucuuucaggaauucagacuauggcaauuuguuagcaaccuuagauuauauaggaaaagcgaugacaaggacgucacuucggaacaucuugugacgacagaugauuacgcgaaucuauuuacauacuuaaacaacagaaaagacauaaaacaaucaguacucuuaaaagaauacuucaaaauaaaaaaagucaaaaccauaaacggcgcugaguauccagucagauggaacuacaucgacgaugauaauaagaccuacccaugcaacgaaaccagauacgauauacuacacgcacuaucuaaaacugaacuaaaaucggaaugguuaacccccgaaagaacauacagauuauggcauuuauuauacucuauagagagcaaggaagaaacuaaaaaagcuuugaacaaauuaaaucuaucagaugacuuuacugaagccuuucuaacaauuaaaccuuuuaaaaaagaauaugguucauacuccgaaaaagcaauaaaaaaacugcucagcuuaaugcgaaugggcuaucuaugguccgaagacgaagccauuaaacaaguaggugccgaaauagaaaagacaauagaaggugagcugcccgacuaugugcugcaacgauuagagaaaucacaacacaauuauaauaagaucagugauuuuucgggguuaccgcuauggcuugcauccuacauaauauauggaagacacagugaagccaaagaaaucauucauugggacaauccagaaaguaugauggcguacauaaaggacuuuagacaacacaguaugagaaauccaauaguugaacaauguguucuagaaacccuaagaacaguacaugacauauggaaagaaaucggacacauugacgaaauacauaucgaauuaggcagagaaaugaaaagcacgagugagcaaagaaaagcuauaacacaaaacguauuacauaaccaaaacaccaacauacggauuaaacuacuucuccaagaauuaaaaaacgacaauaacauaacaggaguacgacccuauagucccaugcaacaagaaaucuugaggauauacgaagagggagcccuacaaggguuaacaaaagaagauaaagacuacaaugauauccuaaaaauuucacaaacagcucaaccaaccagcaacgaauugacacgauacaaauugugguuagaacaaaaauaucguuccccauauacgggaaaagcgauuuccuuaagcaaacuauuuacuucugcguaccaaaucgaacauguuauaccacaaagucgguauuucgaugacucauugagcaacaaagucauaugugaaagugaaguaaacacacucaaaaaggcuauguuggguauggaauuuauaaaaaccuguggaggacagaaaguacacugcacacuccucggugacguagaaaucuauaaugaagaagacuacaaagcuuuuguaaaugaacacuauagcaacaaccgaaccaaacgaaauaaauuacuaauggaagacauuccacaagaauuuauaaauaggcaauuaaaugauagccgcuauauaaguaaaaugguaaaacaguuauuaucggcuauaguaagaggucaggaagaagucgaagcaaccucaaaauucguaauaccaugcacggggggcauaacagauagacucaaaaaagauuggggucuaaacgauauauggaacaaccuaguaagcccuagauuucaaagaaugaacgcacuaacagggagugaauauuucggccacugggagaacaaagaagguaaacgggucuuccaaacaacaaugcccauacaauuacaacaaggauucaguaaaaaaagaauagaccacagacaccacgcaauggaugcacuuguaauagcaugugcaagucguaauaucauaucauaucuaaacaacgaaacggcgcaagauacggaaagaagacgagauuugcgacaaaaacuaugcgacaaaggaggaaguguuagaaaacccugggauucauuuacacaagauacacaauacgcauuaaaggauaucaucguuacauuuaagaauuauguacgaauaauaaacaaagccacaaacuacuacgaacacuauaaaacugacggaaaaaaaggaaugauaagccagaaaggcgaugagcuaugggcaauuagaaaaccaaugcacaaagaaacaguauucgguaaaguaaaccugaggagaccaaaaaggguuagucuaaguaaagccauugauaguguugacgucaucugcaauagaaaauugaagaaauacauaaaagcaagauuaaacgaaggacuucaaaaaaaacaaauauuaaauauauucaaagaacucaacaacgugugggaaggcauagacgugaauaaaauagacauaugggaaaugaguaaugacaaagaaccaaugguagcaacaaggaaacaacuugauacaucuuuugaugagaaaaaaauaagaagcauaucugauacggggauccaaaaaauauuauuaaacuaccuaauuacuaagaacaauaauccagaacuagccuuuacaccagaaggaauucaagaaaugaauaguaauaucagugaauacaacgaucauaaagaacaucagccuauuuauaagguaagaguaacagaaccacuaggagcaaaauacccuauuggaacaaugggaaauaaaccaaaaaaauucguagaagcacaagcaggaaccaaccuguauuucgcaauuuacgaagacaaggagggcaacagaaacuacgacaccauaccucucaauauugcagcagaaagauuaaaucaacaacuaaguccggucccugaaacgaacgaaaacaacaccccauuaaaauuuuaccucaguccaaacgaucuuguauacguaccaucagaagaagaaagacauagugggaauaauauccaauuagacaaaaaccgaaucuauaaaauggucagcagcacuucaaaacaaugcuuuuucauacaccacagaguagccauaucguuaguagauaaaaaagaauucagcgcccaaaacaaaauggaacgaucuauagauaaugaacaaguuaugaucaagucuguauguuggaaguuaauaaccgauagacucgguaacauaaucaaaguaauaaaguga

SEQ ID NO: 5725 - RNA, 4461 nt, Artificial Sequence
  Cas9 variant
augacaaaaauuuuaggauuagacuugggaaccaacagcauaggaugggcaaucagagaagacgaaaaugaaggcguaaaucaaaucauagacaaaggaguacguauauucucagaaggggugaaaucagaaaauggaaaagaaauaagcagagcugccgaacgcacggcuuauagaucggccagaaaaaucaaauauagacgcaaacuacgaaaauaugaaacccuaaaagugcuaucaguaaauggaauguguccacuaagcguggaagaaguagaacaauggaagaaaagcggguucaaagaauacccacuaaacccggaauuucuaaauuggcuaagaacaaaugaagacaaaaauaucaauccuuacuucuuuagagauaaagcauccaaacaaaaaguaacacuguuugaacuugggagagcccuauaucacauagcacaacgacgaggauuccuaagcaaucgcuuagaucaaagcgcagaagggguuuucgaagaacacaauccucaaauucaaaauuuaauagaagaucuagacucaagcaacacgauacucaacgaacuaaaagaauauuauauaaaucugggaauaauagaugaaucagaaaaaucuggauucaagaaagaucuugacgagggagagaaaaaucucaagaaauuguauacgagcuuagugucgauaaccaagaaaaaugcaaaugacauagaaaccugcaaacaagaauuaauugccaggcuaaacaagaaagaagaccuagguaaaguuaaaggagagaucaaagauaucucucaagcaaugcucgacggcaacuucaaaacgcuaggacaauacuuuuucaguuuauauaacaaaacccgaauacguaaucaauauaccagccgagaagaacacuaccucgaagaauuuauaauaaucugucaaacacaagggaucgaagaaauaaauacaaaugaaaaauuaccagagaagaaauucaccgguuuagcaaaagaccuuuaucgagccauauucuuccaaagaccauugaaaagccaaaaaggacuaauaggaaaauguucauuugagaaaaauaaaaguaggugcgcaguaucacacccagauuaugaagaauuucguauguggucauaccuaaacaccauaaaaauaggaacccaaagugagaaaacacuacgauuuuugacacuggaagaaaaacuaaaacuugucccaaaauucuaucgcaaaaacgauuuuaacuucgaaguucuagcaaaggaauuaguagaaaaaggagcaaguuucggauauuauaaaucguccaagaaaaacgaauuuuucuacugguuuaauuacaaaccaacagauucaguauccgcauguguuguaagugccagccuagaaaaugcaauagguaaagacuggaaaacuaaaacauuugaauaucaaacaucaaauacaaagaaagaagagguaaccaaaucuguaaauuacaaagacuuauggcauuuacuaucaguagcuacaucggauacauaccucuacgacuuugcgauagaaaaacuuaaauuagaacccaaaaacgcaaaagccuucuccaaaaccaaauuaaagaaagauuuugcaagccuaaguuuagccgcaauagcaaaaaucuuaccauacuuaaaacaaggacugcuauauucacaugccguauucaucgccaauauugagaacauaguggacgcugauauauggaaagacaaagaacaacaaaaauuuauacaauccaaaauaguagaccucauugacaauuaccucguagaaaaaucaaaauuagaaauaauaaacugccuacucaaaauauauaauacagaagauaucgagggccgcaaaguuuauuauucaaaagaggccgaaucuuuauucgaagcagacuuacguaagaaacucgucccguucuauaaagcaaacacaauaagcgaacagcaagaacaagaaaucauauucaaagaccuauuuccagucuuaauagaacaauugaagaaacaagaguucauaaaaauuguucguuuagacaagaaaauagaagccuuccugaaaggagaaaacgaagaaggacaaauauuuuguaauuauccagaaaaauuuaagaaacuauaccauccuucagacauagaaguguuuaaaaagaaaauaauaaaagaugaauggggcaaugaaaaaguaguccucgguucaccuuuaacuacuuccaucaaaaauccuauggcuaugagagccuuacaccaacuacgcaaaguuuuaaauacacuaauauuagacggacaaauagacgagaaaacaaggauccacauagaaauggcuagggaauuaaacgaugcaaauaaacguaaagguauacaagauuuccaaaaagaaagagaagaacuguauaaaauauaugaagcaaaaauuaaagaacuuuaccaagucaaaacugggaaagaacuacuacacguuacugaugaagacuuacaaaaauucgaaugggcgcucgaacaaacaaaggacgguagaauaauuacuaaagaagaguuaauaaaauacaaaauaugggaagaacaaaaccacaucugcauauauacagguaaaacaauaaguauagacucauuucucggcggaaacccgaaauucgauaucgaacauacaauaccgagaucaaucucccaagacaacagcuuaaugaauaaaacccucugugacaaagacuuuaaccggucagugaaagggaagaaaaugccgguagaacuuaguaacuacaacgaaauccucccaagaauagcccacuggaagaaacaagcagaagaacuaacacgacaaaucgaaacuauaucgcgcagcaucaaaagcgcagcaacaaaagucgccaaagauaaaaacauaagaaagagacacuaucuaacacuaaagagagacuacauucaaggaaaauacgaccgcuuuaccuggggagaaccaaaaguuggauuuaaaaauucucaaauaccagacaccggcauuaucacuaaauaugcacaagcauacuuaaaauccuauuucaaaagaguugaaucagucaaaggaggagcaguugccgaauuucgaaaauuaugggguauacaagaaucauucauagaugaaaauggcuucaaacacuucaaagaaaaagauaggucaaaacauacacaccacacaaucgacgcaauaacuauugcaugcaugccaaaggacaaauacgaucugcucgcacacgcauggcguuuagaagaugaacaaaauaaaaaggcagccaaagcucucauugaacaggcaaaaccguggaaaaccuucaaagaggauauagagaaaauagaagcggaaauucuuguaagccacuucacaccagauaaugucaagaaacaagccaagaaaauucuacggguacgaggcaagaaacaauacguugcagagauagaacgcaacgcuaacgggaaagcaauccccaagaaagaugccuccgguaaaauaauauauaaauuaaaugagagaggcaauaaaauaccuauauuacaacaaggagauacaauucgaggauccuugcaucaagacuccauuuacggagccauuaaaaauccacuaaauacuaacgaaauaagauacgucauaagaaaagaccuagaaagccucaaggccaaugauaucgaaaacauugucgacgagaaugucaaagcaaaaguaaaagaagcuguagcaaacaaaauacuacuuauuucuucgaacccucaacagaaaaacaaauucgccgaggguaagaauguauggaugaaugaagagaagaaaauaccaauaaauaaagucagaauauacgccaauuccgucaaaaacccaauugagaucaagaaacauucaacguuaucaaaaaguaaacaugaacauaagcaaacuguauacgggcaaaacgacgaaaauuaugcaauggcucuuuacgaauuagacggaaaacgagaauuugaauuaauaaacaauuucaacuuggcuaaacuacucaaacaaggacaagguuacuaccccuugcauaaagaaaaagaaauaaaagguaagaaaguucuuauucccauagaaaaacggaacaacagagacguaguacuuaaaagaggacaacaaguagucuucuaugacaaaacaguagaaaauucgaaagacauaagugaaauagucgacuuccgaggaagaguauaccuuauagaagguuuaaccauacaaaggcagaaggauaagaaaacaggaaaaguuaaugaauauggaaucauacaacuccguuauuucaaagaagcuagaaagucagaagaaauaagcaaagauucauuuaaaccugacggagaguucaaaauaaacgaaaacaaaccgacaagaaaaaugaaccauaaucaauuuacagcguucguugaaggaauugauuucaaaguacuaccaaguggcaaauuccagaaaauauga

SEQ ID NO: 5726 - RNA, 4464 nt, Artificial Sequence
  Cas9 variant
augaaaaacgugcuaggacuugacuuagguucaaauagcguugguugggcgcucguuaaaacggaagauaacgguaauccuauaggguccauaaaaaugggaucccguauuauaccuaugucacaggauauacucggaaguuuugaaaaaggagacacaguaucacaaacugcucaacgaacacuauacagaggcaaaagacgcuuaauugaacgacauguccuccgaagggaaagacuuugcagaguacuacauauuaugaacuuucuaccagaucacuucgacaaauuacuagguugggacaaaacggacaauaaaacuuauggaaaauuuauagaugauagcgaacccaaauuagcauggcgccaaaauaagaaugagaaagagaaaauggaauuugucuuuauggauaguuuucaugaaaugcucagcgacuucgcgaaacaccaaccgcaacucauagccaauggcaagaaaguacccuuagauuggacuaucuacuacuuacgaaagaaagcccuaacccaguugauuucaaaagaagaacuagccuggauuuugcuaaauuuuaacaagaaacgaggauauuaccaguugcgcggagaggaagaagaggaacaaccaaccaagaaagaagaauacaaagugcucaaagugauuagcguagaugcggaugaaggccaaaaaggaaacggcauaugguacaauauacaccuagaggaugguggaauuuacaaacgaaaaagugacacuccauuauaugacuggguaggaaaaacacuacaacuaauugucguaacgauauacgaaaaagacggaaaaacaccuaaaauuuuugacucagguaagcaaaauccauccuacagacucccaaaagaagacgauugggggcuaauaaagaaaagaacggaaucgcaaauacaauccucaggaaaaacuguaggggcguuuauauaugacaauauucuaagcaaaccggacgacaaaauacgaggaaauuuaguaagaacaaucgaaagaaaauacuacaaaaaggaacuuauagaaauuuuacaacaacaagcaaaguaccaugacgaacuacacaaccaaaauuuacuggaaucgugugcgaaagaauuguacgcacauaacgacguaagauauaacgaaguagucaaaaguaacaugauccaccucuuaguugacgauauaauauuuuaccaaagaccauuaaaaaguaagaaaucucuuauagcuaauugcaaauaugaaaguuaugaauacguagauaaagaaacaggagaaguaaaagaaaugccaaucaaaugcauagcaaaaagcaacccuuacuaucaagaguucagacucuggcaauucauacacaaccuuagacuaucugacguaguaacaagagaagauguaacugcgcaauaccuaucaacuccccaagacuacuguaacuuauuuacauacuuaaaugauagaaaagaaauuaaacaagacauacuacucaaagacuuuuucaaaauaaagaaagugcaaauugacaaagaaaaaguauucccgauagaauggaauuacauaaaagacgcuacgaaaacauacccaugcaaugaaacacgauaugaacuacuguccgcucugaaaagagcaggcauggacaagcaauggcuggaugacacaccuaacaugcaauacagacuauggcaccuacuauacucagucgaagaacaagaagaaagcgcgaaggcuuuaagaaaacuauacgacaaugacaacuucguaucgucauuccuuaaaauaaaacccuuuaagaaauguuacggcgcauauagcgaaaaagcuauuaaacggcucuuaacauuaaugagaaugggcaaagcaugggacgagcaagcuauagaugcuaaaacgcucaaauguauacaacaaauaauaacaggaaauaucgacucaaaauuaaaagagaaaauugaugacaguagauauguauuacaucacguaucagauuuucaaggucuuccaacauaucuugcuaguuacguaauuuacggccgacacucagaaguaaccgacauaagauguugggauacaccgaaagaccuacucaaauuuauauguggcuuuccacaacauaguuuacgaaacccaauaguagaacagguuauacuugaaacauuaagaguagucuacgauauauggaaagcggaaaaacacauagacgagauucauguugaaguugcaagagagaugaaacuuacagcacaacaaagaaaugaagcaaaucucaggaaucuaaauaacgaagcaacaaaccuaagaauaaaauaucuauuagaagaacuuaaaaacgauacauuuauaaaagacguaaggccauuaagcccgaugcaccaagaaaagaugagaauuuaugaacaagccguacucggaaauuuaaauaaacaagacaaggacuaugacgacauaaucaaaauaaguaagaaagaacgaccaacaucagcugaacuuauaagauauaaacuuuggcuagaacagaaauauugcucaccauauaccgguaaagcaauuagccuaaguaaauuauuuacuacagcuuaccaaaucgaacaugucauuccacagucgagauauuuugauaauagcuuuaauaauaaaguaauuugugaaucagaaguuaauaaagagaaagauaaaaugcugggguacgaauuuauaaaaggucgcggaggagacagaauauacuguaccgcacacggaaaagaaguuacaauacuaaaagaagaagaguauaaacaauucguaaacgaacacuaugcacauaauaaaagaaaaagagacaaccuacuugcagaaaauauacccgaauccuucucaucgagacaguuaaaugacacccguuacauuacaaaaacaauaaugucauuacuaaguaauguaguccgacaacaaggcgaggaagaagcaacagccaagaauuuauuaccgaguucaggagcagucacagacaaguuaaagaacgacuggggauuaaaagacguauggaacacaauagugacaccacguuucgaaaggcuaaacaaacuaagugggacaaacgacuuuggagaaaugaaagaagagaacggcaaccgauacuuucaaacuaacguaccuagcgaauacgaaaaaggcuucaaaaagaaaaggauagaccacagacaucaugcaauggaugcacuggugaucgcauguacaacuaggaacaugguaaacuauaucucuaauguuaaugcuaauagcccuaaacagcgagaagauuugaggcaacugcuaugugauaaaaauaggauaauaaauaaacccuggaacacauucacccaagaugcacuaaaagcauuaaaugauauaguuguguccuuuaaaaacaacguucgaauaauaaaucgggccacaaaccgcuaccaacgauacgauaaaaauggaaagaaaaugauuuguucacaaaaagguaaugauaugugggcaauccgaaaaucuaugcauaaagagaccguuuucggacgagucaaccuuauuaggaaagaagcacuaccuaucgcaaaagcauuagauaauauaucugccauaugcaaugcucaacuccgcgcauacguaaacgaccugguagacaagcacuuuaauaaaaagcaguuaguugcccauuucaaaucauuagauuacaaauggaacagacaagacguaagcaaagucgaaguauggauaaguucagacgacaagacaccuaugguagcuguaagaaaaccccuagauacaucuuucgauaagaagaaaauagcuucuauaacagauacaggaauacaagcaauacuacuaaacuaccuugaaagcaaaggaggagacgcccucguggcauuugccccagaagggauucaagaaaugaacucaaauauagagcuauauaauaauggaaaagcacacaagccaauuaaaaauguucgacuaagugaaacuuuaggagcaaaguaccaagucggugaaagaggugcgaaaaccaagaaauacguggucgcugacaaaggcacuaaucucuucuucgcaauauacgaagaugaagaaggaaaaagguacuauuacaguguaccucuaagagaagcgauagaaagacaaaaacaaaaauuaucaccuguaccagaauauaaugaaaaaggaguggcacuaaaauucuaucuaagcccgaacgaccuaguauacguaccgaccgaggaagaacgcacgaugggaacaugucauaucgauaagacuagaauuuacaaaauggugucuagcucggaaaaucguugcuguuuuguaccgagcacuauagcaaaaguaauagcagauaaaguagaacuccuuucacauaacaaaaucgaaaaagcaaucacaggcgaaucuauaaaggaaguuuguuggaaauugaaaguagauagacucggaaacauccuuaacguaauaaaauga

SEQ ID NO: 5727 - RNA, 4464 nt, Artificial Sequence
  Cas9 variant
augaaaaacguacuaggacuagaccuaggaagcaacucuguaggaugggcacuggucaaaacagaggauaauggaaacccuauaggaucaauaaaaauggguucaagaauaaucccaaugucucaagacauauugggaucguuugagaagggugauacuguuucacaaacagcccaaagaacauuauaucgagguaaaagaagacuaaccgaacgacaugucuuaagaagggaaagacucugccgagugcuacauauuaugaauuuccuaccagaccauuuugauaaacugcuuggaugggacaaaaccgacaauaaaacauauggaaaauucauagacgauucagaaccaaaacuggcauggagacaaaacaagaacgaaaaagagaaaauggaauuuguuuucauggacucauuucacgaaauguuaucagacuuugcgaaacaucaaccacaacuuauagcaaauggaaagaaaguuccauuagacuggaccauauauuaucuaagaaagaaagcucucacacaguuaauuuccaaagaagaacuagccuggauacuacuuaauuucaacaagaaacguggauauuaccaauuaagaggugaagaagaagaagaacaacccacuaagaaagaagaauauaaaguccucaaaguaauuagcguagaugcugacgaaggccaaaaagggaacgguauaugguacaacauccauuuagaagacggaggaauauauaaaagaaaauccgauaucccacuauaugacugggucggcaaaacuuuacaacuaauuguuguaacaauauaugaaaaagaugggaaaacuccuaaaaucuuugauagcggcaaacaaaauccaucauaccgccuuccuaaagaggaugauuggggacuaauaaagaaacgcacagaaucacaaauccaauccucugguaaaaccguuggggcuuuuaucuaugacaacauacuaucuaaaccagcugacaaaauaagagggaaucucguaaggacgauugaaagaaaauauuacaagaaagaacuaauagaaauauuacagcaacaagcuaaauaccaugacgaacuacacaaccaacacuuacuagagucaugugcaaaagagcuauaugcucauaacgacguacgcuacaacgaaguagucaaaagcaauaugauacaccuccuaguagacgacauaaucuuuuaucagaggccucuuaaaucaaagaaaagccuuaucgauaacugcaaauaugaaucauacgaauacguugacaaagaaacgggagagguaaaagaaaugcccauuaaauguauugcaaaaucuaauccauacuaccaagaauuucgguuauggcaauuuauucacaaucuaagauuaucagacguuguaacaagagaagaugucaccgcgcaauauuuaucaacuccacaagacuauuguaaucuuuuuacauaucuaaaugaccguaaagaaaucaaacaggauauccuacuaaaagacuucuuucaaauuaagaaaguucaaauugacaaagaaaaaguauuuccaauagaauggaauuacauaaaagacgccaccaaaacauacccgugcaacgaaacaaaauaugagcuauuaucugcauuaaaaagagcgggaauggacaaacaauggcuggacgacacuccgaacaugcaauacagguuauggcaccuucuauacagcguagaagaaaaggaagaaagugcaaaggcccuaagaaaacucuacgaugaugacaauuucguuucuagcuuucucaagauaaaacccuuugaaaaaugcuauggagccuacucagaaaaagccauuaaaagauuauuaacacuuaugcgaaugggaaaagcaugggaugagcaagcaauagacgcgaaaacacugaaauguauccagcaaauaauaacuggaaacauugauaguaaauuaaaagagaaaauagacgauucgagauauguccuccaucacguaagcgauuuucaaggauuaccuacauaccuagcaaguuacguaauauauggaaggcauagcgaagugaccgacauaagauguugggauacccccaaagaccuacuaaaguuuauuuguggguuuccacaacauucuuuacgaaacccaauaguagaacaagucauauuggaaacauuaagagucguauaugacauauggaaagcggagaaacacauagaugagauucauguagaaguagcacgagagaugaaacuaaccgcgcaacaacguaacgaggccaaccuacgcaacuuaaauaacgaggccacaaaccuacgaauaaaauacuuacuugaagaacuuaaaaaugacacauuuauaaaagacguccgaccguuaaguccaaugcaucaggagaagaugcgaauauacgaacaggcaguacuuggcaauuuaaacaaacaagacaaagauuacgaugauauaaucaaaauaucaaagaaagaacgacccacaucagcugaacuuauuagauacaaauuaugguuagaacaaaaauacuguucacccuauaccggcaaagcaaucagcuuauccaaauuauuuacaaccgccuaucaaauagaacacgucauaccgcaaucaagguauuuugacaacucauuuaacaacaaagugauaugcgaaucagagguuaauaaagaaaaagauaaaaugcucggauacgaauuuauaaaaggaaggggcggagaucguauauauugcacagcccaugguaaagaaguaacuauauuaaaagaggaagaauacaaacaguuuguaaaugaacauuacgcacacaauaagcguaagagagacaaccuauuagcagaaaacauaccagaaucauucaguagucgucaauugaacgacacaagauauauaacaaaaacuauaaugagcuuacuuaguaacguaguuagacagcaaggagaagaagaagcaacugcuaaaaacuuacuacccucauccggagcagucacagauaaacucaaaaaugauuggggucuaaaagauguauggaauacuauaguaacacccagauucgaaagacuaaacaagcuaucaggcacgaaugacuuuggugaaaugaaagaagaaaauggaaauagauauuuccaaacuaacguuccaagugaauaugaaaaggguuucaaaaagaaacguauagaucaucgucaccaugcaauggacgcacuuguuauagcauguacaaccagaaacaugguaaacuauauauccaacguaaaugccaauucuccaaaacaaagagaggaccuaagacaacuccuaugugacaaaaaccgcauaaucaauaaacccuggaacacauucacacaagaugcccuaaaagcauuaaaugauauaguggugagcuucaaaaauaauguaagaaucauuaaucgcgcaaccaaccgguaucaaagauaugauaaaaauggcaagaaaaugauauguucacaaaaagguaaugauaugugggccauacgaaaaagcaugcauaaagaaaccguauucggaagaguaaaccugauucgaaaagaagcucuaccaauugcaaaagcacuagacaacaucucagcaaucugcaaugcacaacuacgcgcauaugucaacgaccuaguagauaaacacuucaauaagaaacagcuaguugcccauuucaaaucccuagauuacaaauggaaucgacaagacguuagcaaaguagaaguauggauaucaucggaugauaaaacacccaugguagcaguuagaaaaccguuagauacaucguuugacaaaaagaaaaucgccuccauuaccgauacaggaauccaagccauucuacuaaauuauuuagaaagcaaaggaggcgacgcucuaguagcauucgcaccagaaggaauacaagaaaugaacucaaauauagaacucuauaauaaugguaaagcucacaaaccuaucaaaaacguccgauuaucagaaacauugggggcaaaauaucaagucggugaaagaggggcuaaaacuaagaaauaugugguagcagacaaagguacaaaucucuucuucgcaauauacgaagaugaggaaggaaaaagguacuacuacucaguuccauuacgcgaagccauagaaagacaaaaacaaaaauuaagcccaguuccugaauacaacgaaaaggguguagcacuuaaauucuauuuaaguccaaaugaucuagucuauguuccaacugaagaggaaagaacaaugggaacgugccauauagacaagacacgaauauacaaaaugguuagcagcucagaaaacagaugcuguuucguaccuaguacaauagcuaaaguaauugcagauaagguagaacuacuuucacauaauaaaauagaaaaagcuaucaccggggaaaguauuaaagaaguauguuggaaauuaaaaguugacagacucgggaacaucuuaaacguaauaaaauga

SEQ ID NO: 5728 - RNA, 4464 nt, Artificial Sequence
  Cas9 variant
augaaaaacauauuaggacucgacuuaggauccaauaguguaggcugggcauuaguaaaaguggaagaaaaugggaacccaauagggagcauaaaaaugggaucaaggauaauaccaaugagucaagauauucuaggcucguuugaaaaaggcgauacaguuucacaaacugcacaaagaacuuuauauagaggaaaaagacgacuuauagaaaggcacguguuaagacgcgaaagacuauguaggguauuacauauaaugaacuucuuacccgcccauuucgacagauugcugggaugggauaagaccgauaacaaaaccuauggaaaauucauagacgacucagaaccuaaauuagcuuggagacaaaacaaaaacgaaaugggcaagauggaguuuguauuuauggauucauuucacgaaauguuaucagacuucgccaaacaucaaccucaacuaauagcgaacggaaaaaaagugccacuagacuggacgauauacuaucuacguaaaaaagcauugacgcagcucauuucaaaggaagaguuagcauggauuuuacuaaacuucaauaaaaaaagagguuauuaucaauuaagaggagaagaggaagaagaacagccaacuaagaaagaagaauauaaaguuuuaaaaguuauauccguagaugccgaugaaggacaaaaagguaacggaaucugguacaauauacaucuugaagauggagguauuuauaaaaaaaaaagugacauaccgcuguaugauugggugggaaaaaccuuacaacuaauaguaguuaccacauacgaaaaagacgguaaaacacccaaaauuuuugauuccggcaaacagaaccccaguuacagauuaccaaaagaagaugacuggggacucguaaaaaaaagaacagaaucgcaauuacaaucgucgggaaaaacagucggagcauucauauaugacaacauacuaucaaaacccgacgauaaaauuagaggaaaucuuguacgaaccauagaaagaaaauacuacaaaaaagaacugaucgaaauacuacaacaacaggcaaaauaucacgaugaauuacacaaucaaaacuuacuggaaagcugugcaaaagaacuauaugcacacaacgacguacacuacaacgaaguaaucaaaagcaacaugauaaaucuacugguaaaugacauaauauucuaucaaagacccuuaaaaagcaaaaaaucucuuauugcaaacugcaaguaugaauccuaugaguacguagacaaagaaacaggggaaauaaaagaaaugccaaucaagugcauagcgaagagcaauccuuauuaccaagaauuuagacuauggcaguucauacacaaccuaagguuguccgauguuguaacucgcgaagauguaaccgcgcaauauuuaucaacaccucaagacuauugcaaccuauuuacauaucugaacgauaggaaagaaauaaaacaagauaucuuauuaaaagacuuuuucaaaaucaagaaaguacagaucgacaaagaaaaggucuuccccaucgaauggaauuauauaaaagaugcaacuaaaucguacccaugcaaugaaacaagauaugagcuucuaagcgcacuuaagagagcaggaauggauaaacaaugguuagaugacacuccaaacaugcaauauagacuuuggcaucuucuauacagcguagaggaaaaagaggagucugcaaaagcucuaagaaaauuauacgaugaugacaaguuuguuacauccuuucuaaaaaucaaaccauuuaacaaauguuacggggccuacuccgaaaaggcaaucaaacgucuucuaacacuaaugcgaaugggaaaagcuuggaaugaacaggcuauugacgccaaaacccuaaaguguauacaacaaauuaucacagacaacguagacaguaaauuaaaagaaaaaauagacgauagucgauacguauuacaccaugucucagauuuucaaggacuaccaacuuacuuagcaucauacguuaucuaugggaggcauuccgaggucaccgacauccaaugcugggacaguccugaggaccuacuaaaauuuauacgagacuuuaaacaacauucauuacggaauccaauaguagaacaagucauuuuagaaacacuuaggguuguguaugacauauggaaggcagaaaaacacaucgacgaaauccacguagaaguugcuagagaaaugaaauuaacagcucaacaaagaaaugaagcaaaucuuagaaaucugaacaaugaagccacuaaucuacgaaucaaauaccuacuagaagaauuaaaaaacgauacauuuauaaaagaugucaggccucuaagucccauccaccaagaaaagaugcgaauauaugaacaagcgguccucggaaacuuaaauaaacaagacaaagauuacgacgauauaauaaaaauaucaaaaaaagagcauccaaccaacgcggaacuaauuagauauaaacugugguuggaacaaagauauugcaguccauacacgggaaaagcaauuucuuuaaguaaauuauuuacaaccgccuaugaaauagaacacauuauuccacaaucaagguacuuugauaacucauucaauaauaaagugauaugcgaagcugaagucaauaaagcaaaaggaaauaugcugggauacgaauucauaaaaaaacaaggaggacaaaagauauacuguacacaacuagguaaagcagucacaauauugaaggaagaagcauauaaacaauucguaaaugaacauuacgcacacaauaaaagaaaaagagacaaccuucuagccgaaaauauaccagaaucauuuaguucucgacaauuaaacgacacgagauacaucaccaaaacaaucauguccuuauuguccaaugugguacgccaacaaagugaagaggaagcaacugcaaaaaacuuacucccgaguucaggaagcgucacggauaggcucaaaaacgacuggggcuuaaaagacguuuggaacaccauaguaacacccagguucgaaagacuuaacaaacuaaguggaaccaaugacuucggagaaaugaaagaagaaaaugggaacagauauuuccagacaaauguaccacuggaauaugagaagggcuucaaaaaaaaacgcauagaccauagacaccaugcaauggacgcuuugguaauagcauguacaaccagaaacaugguaaauuauauaucaaacgcaaacgccaacucacccaagcaaagagaagacuuaagacagcuauugugcgauaaaaauagaauaaucaacaaacccugggacacauuuacgcaggacgcacuaaaagcacuaaacgauauuguaguaaguuucaaaaauaacguacguauuauaaaccgagcaacuaacagauaccaaagauacgauaaaaauggcaagaaaauuauauucagucaaaaaggagacgacaugugggcuauuagaaaaagcaugcauaaagaaacagucuuugggcguguaaaucuaauacgaaaagaaguacuaccaauagcaaaagcgcuagauaacaucucagccauuugcaaugcacaacuaagagcauacgucaaugacuuaguugacaaacacuuuaauaaaaagcaauugguagcacacuucaaguccuuaaauuacaaauggaaucgacaagacguuagcaaaguagaagucuggauuaguucagauaauaaaacacccaugguagcaguucgaaaaccacucgauacaagcuucgacaaaaaaaaaauagcauccauuacugacaccggcauacaaaccauacuacuuaacuacuuagaaagcaaaggaggagaugcuaguguagcauucgcaccagaaggaauacaagaaaugaauucuaacauagaauuauacaacaauggcaaagcucauaaaccaauaaaaaacgucagauugucagaaccccuaggcgcaaaauaccagguuggagaacgcggggcaaaaacaaagaaauacguggaagcagauaagggaacuaacuuauucuuugcuaucuaugaagacgaggaaggcaaaagauauuauuacagcguacccuuacgugaagcaauagaacgacaaaaacaaaaauugaguccaguuccagaauacaacgaaaaaggcguugcauuaaaauuuuaccucagcccaaacgauuuagucuacgucccuacggaagaggaacguacaaugggcacuugccauaucgacaaagcuagaauuuauaaaaugguaagcucaacagguugcagcugcuacuuuguaccaaguacauucgcaaaagugauaguagacaaaguagaacuccaaaguuuaaacaaaauggaaaaagcaauuacugaugaauguaucaaagaaguaugcuggaaacuaaaagucgacagacuaggcaauauaauaaacguuauaaaauga

SEQ ID NO: 5729 - RNA, 4485 nt, Artificial Sequence
  Cas9 variant
augaaaaacauccucggauuagaucucggaaccaacagcauuggcugggcucucauagauaacgaaagucauagaauaauaaaaucaggcagcaggauaaucccgauggaugccgccacaaugggagauuaugaaaaagguaacuuaaaaucggccgauuggaagagaacgagcuuucgcggcaugcgaagacuauacgaaagagccaaauuaagaagagaacgauuauugcggguauuaaacauuuugggauuuuuaccugaagaguucagaagacagauagacuucgaacaccauccaggacaauuuaucgacggaaaagaaccauuaauagcguaccaccaugacgaaaauggacagagaguauucucauacaugucagcuuuugaagagaugcuaacagauuucagagcuacucagucagagcuaguuagagauggcaggcgaguaccauaugauuggacgauuuacuaccuacgucauaaagcccuaacucaaccaguaaccaaggaagaacuagccuggaucauacugaauuucaauacaaaaagggguuauuaucaacuuagaucugaaucugaagaagucacgacuaauaaaaacgaagaauacgcugaauuaaaaguugucucaguagagaaaacaggcgaagauaagaaaagagcuggauacuacugguacacaaucacauaugauaaugaagcggaacagaaaaucacaaguaccauacccccgcgacaaaucggagauaaaguugaauuaauaguaacaacagcaagagacaaagcaggagaaauaaagaaaucaguucgcucaccaaaagaagacgauuggacacuaaugaagaaaaggaccgagcacaauauagaagaggaagaaugcacuguagggucauacauauaccaacauaucuuagcagacccaacaguaaaaguaagaggaaaacugguacacacgauugaacgaaaauucuauaagaaagaauugaaacaaauacuaaacaaacaaaaagaauuuauuccagaacuacaagacgcauccuuauacgaagcaugcauaaaagaauuauauagaaacaaugaagcgcauauccaaucaaucgcaaacaaggauuuuacagaucuauuuguaaaugacaucauauuuuaucaaagaccucuuaaaaguaagaaauccaccauuucaaacugcccauacgaaucauacuauuacaaaaauaaagaaaccggcgaacuaauaagaaaaccuauaaaaugcaucgcuaaaucaaauccauuauaccaagaguuccgacuauggcaauucguucacaaccuaagaaucuauaagaaaagugaagaaguaaguggacgccugcaaacagauguugacguaacagaccgauuuuugacaacgccagacgauuaugcuaaacuauuuucuuggcucaacgauagaaaagaaauuaaacagaaagaauuacuuagauaugaagccuuuggcuuaagcaaaaguuauggagauuauagauggaacuucguagaagauaaaccuuaucccugcaacgaaacacuucaugaaauaaaucgcagaaugaaaucgauauuaucagacaagaaacuaucaucagaagccuaccaacaguuauggcauauauuauauuccauugacgacccuauugaaauacgcaaagcgcucacaaguuucgcacaaaaucaagaaauaaacagcgacgacuuuguaaacgccuucuaucaguauguaccugagaaaacuaaaagcuacggagcauauagugaaaaagcuauaaagaaacuacuaccccuaaugaggaggggguccuacugggccauagggaauauugaugagaaaacucaccgacgacuagauaacaucauaaacgggguagcagaugacucgauaucaacauguaccagagaaaaauuaaacaaucuaacugauauaacuaugugccaaggaaugccauuauggcaagcaugcuacgcaguauaugacagacacucggaagcagccgauaccaccaaaugggaacaaccugacgacauagacacuuaucuaagcaccgaacucaaacaacauucacuaagaaacccaauugucgaaacaguaauuagcgaaacauuaagaguaguacgcgacauuuggaaagcguacggacggccagaagagauacacguugaauuagguagaaaccuaaaacaagacgccaaaucacgaaaacaagaugcaaucaggauggcggaaaaugagcaaaccaaucuaagaauaagggcauuacugcaagagcucucgaaucccgaaugugguguagagaacgucagaccccauucucccagucaaauggaacuauuaaaaaucuaugagaaugaaguauuacaaagcacugaugacauaccugaagaaauaaguaacauaauaaaagaucuaggaaagacagauuccaaaaagagaccaucccuaagugacaucaccaaauaccgccuaugguuagagcaaaaauaccaauccccuuacacaggacacauaauaccucuauccaaguuauuuacuccggcauaccaaauagaacacguaauaccacaaagucgcuacuuugacgauuccauauccaauaaaguuauaugugaagcagaaguaaacaaagagaaagacagaaugcucgguuaugaguucauuauaaauaaagguggaagcauugucaaaggaucauucggucaacaauucaaaauauucgauaaaguacaauaugaagacuucguaaaacaaagauaugcacauaacaaaacaaaaaugaagaaacuucuaauggacgacaucccggauggauucauccaaagacaguuaaacgacuccagguacaugucaaagaaaaucaucucaauauuauccaauaucguaagagaagacggagaaaaagaagcgacuucuaaacacauaauaguaacauccggagcaauuacugacagauugaagaaagaaugggguauaaaagauguauggaacgacauaauugccccaagguucaaacgacuaaauaaacuaaccgacucaaacaacuacggcauggaaacugaaaaagaaggacgacaguauuuucaaauuaacguaccaacugaauuaucuacaggacucauuaaaaagcgaauagaccauagacaccaugcaauggacgcgaucauaauagcaugcacgacaagaaaucacguaaacuucuuaaauaacucgacggccgcuagugaucaaaaagauauacgucgagaccuucaacauacccuauguacaaaaacaaaaacugauucuaacgggaauuauguuuggcgauuuaauaaacccugggauacauucacucaagacacgagacaagaacucgaaggcauaauaguaucuuucaaacagaacuuaagaauaauuaacaaaaugucaaauuacuaccaacacuauguggacgggcggaaaaccauaucacgacaaaauaaaggggaugggugggcuauacgaaaaagccuucacaaagcuaccguuucaggaaaagugaauuuaaaaagaagcaaaacaguuggauucaaggaagcacuuaacgacuggagugccauaaaagauaaaaccagcaaagcaauauuacagaaaauaauugcucaauauaaaaacuacgacccaaaaacaauuuucaaauauuuuaaagauaggaacuucaaagucgaaggaaaagacuuuucaaaacuagaaguauacuacaacacgucagauaaagaaccaaugucugcccaccgaguuaauauugacacaacauuugacgaaaaagaaauaagaucaaucacagauacuggaauccaaaagauuauguuaaaacaucuacacacuuacgaugaugcacaaggaaaaacccaccccgaagcagccuucagcccagaagguauagagaaaaugaaccaaaacauucgaaugcucaacggaggcaaagaccauaaacccauauuuaaaguaagaaaagccgaaauccucggcaugaaauucgcagucggagaaagaggacacaaggacaagaaauggguugaagcagacaaaggaacaaauuuauucuuugcuauauacgaaucggaagaaaauaaacgaagcuacuccuccauaccacuaaaugaagccaucgaccguuugaaaagaggggaaaauauugcagacgaaagagaccaaaauggaaauaaauuguuauucguauuaucgccaauggaucuaguauaugugccagauccagacgaugcucauauagacgaaguuaaaggcaacaacaacauauuuaaaaugguuucaugcacggguacagaaugcuauuucguaccugaaacauaugcaaauguaauuugcaaaggaaaagaauuagaaagcaaaaacaaagucgaaucauaugaugggauaaauaucaagaaaaguuguuauaaaauaacgguagacagacuaggcaaaguaagaaaaauauuuaaaggauga

SEQ ID NO: 5730 - RNA, 4491 nt, Artificial Sequence
  Cas9 variant
augaaaacaauauugggacucgaucuuggaacaaauagcauaggcugggcaaaaguaugcguugaugauaacgggaauuauuuaagggauauaaaauuagggucuaggaucauccccaugagccaagauguucuaggaaacuuugacaaaggagucacagaaagucagacauccgucaggaccggauuucgcggagugaggagaauacgagaaagaaguuugcuacggagggaacgucuacaucgaguacuucauguauuagguuacuuaccaccacauuaugauagcgcuauagguuggaauaaaaaugaaccuagcacuuauggcaaguuucuaaaccauggggaaccuaaauuggcaugggaacacaaagaagacggaagcaugcgauuucuauucauggaguccuuucaugaaaugauggcagacuuugcaaaaagccaaccaucccuaguaagcgauggaaagaaaauuccuuuagauuggaccauuuauuacuuaagaaagaaagcauuaucccaaccuauaagaaaagaagaauuagcaugguuauuauuaaauuucaaucaaaaacguggcuacuaucaacuaagaggcgaagaagacgaugacaauccgacaaaaugugaagaauauuaugaacuaaaaguaguaggcauagaggcagacgaagaagguaaaaauggaaauacaugguacaacgucaaacucgagaacggauggaucuacaggagacaaagcaaaauuccccuagaugacuggaucgggaaaguuagagaauuuauaguaacgacagaguaugaaaaagacggaauuacauuaaagaaagacaaaaauggagacguaaaaaggagcuucaggucuccuucagaagaugacuggggccuaagaaagaaaaggacagagaaauuacuagacaguuccaaaaugacaguuggagccuuuguuuacgaccauuuauuagcugagccaagcgauaaaauaagagguaaauucauucguacuauagaaagaaaauauuacaagaaagaacuuuacgccauacuaugcgaacaaaguaaauaucaugaagaauuaagauccggcgacuaucuaaauaaaugugcagaagaauuauauaaaaauaaucaaccacauagaaauucgcuccuuaccaaagauuuggcguacuuauuauuggaagaucuuauauuuuaccaaaggcccuugaaaacaaagaaaucuuuaauagcugaaugcccauaugaggcuuauaaauauguggauaaagaaacaggugaaauaaaacgucaagggauuaaauguauagcuaaaucaaacccauacuaucaagaauuuagacuauggcaauuuauuagcaaccuacguuuauuuaauaaagcugaugacaaagaagucacggccgacuauuugccaacacaagacgacuacgugcgauuguuugcuuacuuaaaugaucgaaaagaaauaaaucaagaaacuuuacugaaagaguucuuuaaacucaagaaaauaacagucaauucggaaaaaguauuucccauuagauggaacuauaucgaagacaaagaaaagaaauacccgugcaacgaaacaagacacgaacuacuucuagcacuagauagagcgagaauagaucacuccugguuagaaaaaccaggucaggaauaccggcuauggcaccuacuuuacaguguagaaagcaaagaagaaacaaaagaagcgcuaagaaaauuaaaagacgacgacgcauuuguggaaucauuucugaaaguaaaaccuuuuaaaagggaauauggagccuacucugaaaaagccauaaagaagcuacuagcaguaaugagaaugggaaguuuauggagagaaacugauauaugugacacgaccaaaggaaacauaacaaaaauucugcaaggugaaauagacgaaaaauuaaaagaaaagauuagcgcaaguguaagcagcuacaaucaacuaagcgacuuucaagguuugccaguauggcuagcuuguuauguuguuuaugggcgccauucagaagccgcagaaauacaacauuggaaaacaccagagucauuacuagcauacaucaauggauuuaaacaacacagucuacgaaauccaauaguagaacaaugcauacuugaaacauuacgcacuguucacgauauauggaaagaaguaggacauauugaugaaauucacgucgaauuaggaagaaauaugaaauccacugccgaccaaagagcaagaaucagugaaaacgugcuaagaaaugaaaauacaaaccucagaauaaaaucauuacuacuugaacuuaagaaugaccccaauauaaaagacgucagaccauauagccccaugcaacaagaaaaauugagaauuuaugaagaaggcguacuccaagaauuaacaaaagaugauaaagacuuuacagagauuacuaaaauaucaacaauggcgcaaccaucagcaaaagagcuacaaagauauaaauuauggcuggaacaaaaguauagaucaccauauacaggcaaaucaauaucguuaacaaaauuauuuacaagcgcguaucaaaucgaacacguuauaccacaaagccgauauuucgaugauucauuuaguaauaaaguuauaugcgagucagaggucaacucauuaaaagauaacauguuaggauaugaauuuaucaagaaucacggcggagaaauaauccacuguaccaugcucggcgaugugaaaguacuuucagaaagugaauacaaagcguuuguaaaugaucacuaugcucauaauaaacgcaagagagaaaaucuuuuguuagaagauauaccacaagaguuccuaaaucgacagaugaacgacagcagguacauuuccaaaguaguaaaagcucucuuaaguaacaucgucagagccgaaggagaagaagaagcaacaucaaaauucguaguuagcuguagugggggcaucacagauagauuaaagaaagacuggggccuuaacgauguguggaauaaaauuguauacccuagguuugaacgacuaaacagguuaacagggaccgaggcuuuuggacaaugggaaaacaaagacggaaaaagaguuuuccaaaccgccguaccucuagaauuacaaagaggcuuuaauaagaaaaggauugaccaccgacaucacgcaauggacgcgcuagugaucgcaugcacuagcaggaauauaauuaacuaccuaaacaaugaaagugcaaacaacccuaagaaaagagaagacuugcgacaaaaauuaugugauaaaaauaggacuauacgcaaaccaugggaaaccuuuacccaagacgcaacagcagcauuagaagauguaauaguaucauucaaaaauuauguacguauuauuaacaaagcaacaaacuacuaugaacgauacgaugucgaagguaagaaaguaauagcagaacagagaggcgaugacaugugggcaauaaggaaaccaaugcaugaagcaacauacuacgguagaguaaaucuucgaaggaaaaagaaaguuaaucuaagagucgcccuggaaaacauaagcaguauuugugacaauaaacuacgaaucuauauaaauggucuaguagaaaaaggauuuaacacaaaacaaauccucgauaaauucaaaaacacuaaugaucauuucaguaugcagaaaaucgauaaaguagaaauuuggcaauucacaaaugaagaagaaaaauuagucgcuacucguaaaccucuagauacgagcuucgauacgaagaaaauagcgagcaucacagacacuggaauacaaacaauucuacuaaauuauuuagaaaccaaaggaggugauucaaccauagcauucacaccagaaggaauaguugaaaugaaccaaaacauaucaaaauauaacaauggaaaagaacauaugccuauauuaaaaguaagacucuauaccaaauuagguaagaaaaucccaguaggacaaacaggauguaaagcaaaacaguucguaauagccgaagcaggcacgaaccuauacuuugcaauauaugaggaugaagaagguaaacgaucuuaucggaccauaccuuuaaacgaaguaguagagagauuaaaacaaggucuuucaccaguaccggagaaaaaugauaaagauguacaucuaaaauuuuaucuaagccccaacgaccucguuuacguacccauugaagaugaacacgagagcuuggcaaaagaccacauauacaaauucguagauucuuccggcacaacggcuaauuuuauuccccacagguccgcuaacguaauauuugaacugaauaagaaagacgcagaaaaauuuuguucaggaucaauaauacaaaaugaauauggcgucggaaguagccaaaguaaaaaccaaaaagcaauaacaggugaaaugauaaaagcaguuugucgaaaacuagaaguagauagauuagguaacguaauuaaaguaaucuga

SEQ ID NO: 5731 - RNA, 4497 nt, Artificial Sequence
  Cas9 variant
augaaacauauucuugguuuggaucuaggaacaaauuccauuggaugggcaguaauaagagcacaccaggaugcagacggccauacaacucuucaagauauauuagcagccggaucacgaauaauuccaauggaugccgcaacacugacagacuucgauaaggguaaugcuagaaguggcaccgcggaaagaaccagcuuuagaucgaugaggcgaagaagagaaaggcaauuacuuagaagagaacggcuucacagagucuuaaugcuacuaggauuuuuaccucagcacuaugcgaacucauuaacaagauacggagaguucgcagacaauagagaaugcaaauuaccauggguaaaagacgaaagugaugguaaauaucauuuccuuuuccaagacgccuuccacgaaaugugcgaagauuuuaggcaauuagcaccgcaauggguagccgacggaaagaaagucccuuaugacuggacccuauacuauuuaagaugcaaagcacuuucgcggaaaauaucaaaagaagaacuagccuggauccuuuuaaguuucaaccagaaaagaggauacuaucaagcacgagacgaagaagaugaaguuaccaccaauaaauuagaagaauauuaugcugggaaaguaguccguguagaugacacaggagaacgcaaagggaaaaacgucuacuaugauauaaccuuggaaaauggauggguauaccgauaugcugcacgaauauaucccgacuggguaggacaagucaaagaguucauuguaacaacuacacucaauccagaugguacuccuaaaacagauaaagcuggagaagugaaacgaucauucagaaugccuaaagaugaugauuggacgcuuauuaaaaagaagaaagaaagagacauagaccgaucacaggaaacaauaggacaauauauuuaccacgcacuauuaaaagaucccucacagaaaauacggggaaaacuaauaggaaccguagaaagaaaauauuauaaagaugaauuaagaagaauccuagaucgacaaauucaauuccacccagaauugcgcgauagggaauuauauuacgcaugccuucaagaacuauauccgucuaauguugcauuccggaacacucuaguaaaucgugacuucacauaucuuuuccuagacgacauccucuuuuaccaacgaccacuaaaaucaaagaaaagucaaauaagcgauuguccuuaugaagaacacuucuauaccgauaaagaaaccggugaacguauaagcgucccuguuaaaugcauagccguuucacauccacuauaucaagaauacagacuauggcaauuuauacaaaaccuuagaauauacugcagagaagcucggauugauggcaaccuaaugauugacugggaaguaacaaaugaacuauugcaaaccgaagaagacaaaacagcacuauuugauuggcuaaaugauaaagaaucaguuaaacaaccagagcuaguugcuuuccuucuuggaggaaaagcaaacaagaaacaaauaaaagccuacagauggaacuacauggacgaugauacaaaaggcuacccuugcaacgaaacacgggccucuuuacuuaaauacuuacgcgaagcucaaacagacucuaguuuucuaacacgugaacgagaagaagcacuauggcauauauuauacucaauaagcgacaaaggagaauugaaaucagcauuaggcaaauucgccguuaaacauggacuaaacgaaagauucguuacagucuucucuaaauuuccaccuuucaagaaagacuaugggucauacagcgcaaaagcucucaagaaacugcuaccacuaaugagaaugggacaccauuggcaagaagccucauuuauaccuaguacgaggcaacgcauggaaaaauucauaaauggcgaauaugacgauucaauagacaaacgcacuuaugaaaaacucgaaagucuaacugaaguaagccaauauagaggacuaccagguugguuggcauguuauguaguauaugaccgucauagugaaggacgagauauagaaagauggacaucuccaucagauauagacuccuauuuggcucaauucaaacaacauagucuucauaaucccauaguagaaagggucguacuagaaacauuaagaacaguacgugauaucuggaaacaaguagaucauauugaugaaauucauaucgaacucggcagaaauaugaaacugccagcagauaaaaggagacaaaugacagaacaggcuuggaaaaaugaacaaacaaaccuacgaauaaaggcuuuacuauuagaguucgcaagacccggauacgauauagaaaaugugcgaccauacucacccuaccaacaagaucaauuacgaaucuaugaagaagcaguauuaggagcaaacgaaugcccagacgacauaucagcaauacugaagaaauucaacggauuaaacccaccaacaagugcugaaguauuaagauauaaauguuggcuagaacaaaaauauaggucgccauacacagguaggacaauuccauugucaaaacuuuuuaccagugccuacgaaauagaacauauaaucccaaaacaaagauauuucgacgauucauuuagcaacaaagucauaugugagagugaaguaaacaaaaagaaaggagcaaugcuuggauacgaguucaucaaaucauaccauggagcuaguauaacacuuaauagagguggaacagcaucaauauuuagcguagaagcauaugaaaacuucgugaaagagcauuaugcacauaauaggggaaaaaugaagaaacuacucauggaugacguucccgauucguucauaucaagacaauuaaaugauaguagauauauaaguaaauuaaugaaaucaauccuaucaaaccuaguacgcgaagaaggagaaaaagaagcuauaagcaaaaauuuaauaguuugcacuggagguauaacggaccggcuaaagaaagacuggggaauacacgauguguggaacgacaucaucuuuccgagauucaaacgacucgacgaaauggauucaagucauacauauauaacuuuaaauacacacaggcauccaauccccucaaugccccuagaguuccaaagaggcuucaguaagaaaagaauagaccacaggcaucaugccauggaugcaauuguaauugcaugcgcaacacgaaauauaguaaauuacuuaaauaacgaaucugcacggcaugacgcaaaaacuucgaggauggacuuacaaagauuauuauguacagccaacagaaaacuaauagauaaaccauggaaaacuuuuacacaagauacuuguaaaguacuagaagauaugauaguuagcuuucaacgaacauuaagaauaauuaacaaaacuaaaaacuacuaccucagguucgaagacgguaagaaacgacgaguucuacaaacaaaaggggauaauugggcuaucagaaaaccacuacauaaagaaacauucuauggagaaaucaauuuaaggcggauagaaacacuuuccuugaauaaagccuuggaacgaauaccugauauaguggaaagagacuuacggaagaaacuaagugaacuacuaucccugggauacaacgccaaaagaauuaaaggguauuucgaggaacacaaagaagaauggucagauguuaaucucaguaaaauuaaggcuuauuacuucacaaaacagaaaaacaaaagauacuuugcugcucgaaccgaguuggacacuucguuuaacaaagauaaaauagaaaacaaaauagcugauacggcuauacagaaaauccuacuucaacaccucgaagcauacggaaaugacguagaacaagccuucagccccgaggguauagauacaaugaaucgcaacauucgucaauugaauggcggucggucacaccaaccaauauacaaaguuagaguauaugaagaagcgacaaaauuugccguuggccgaagaggcaacaaaaguacaaaauucguagaggcagcgaaaggaaccaauuuauuuuucgcaauauaugaaaucucgcaaguagaugguaauggaaauagacaaacaucgaggacuuuuucauccauuccauugaauguugcaguagaaagguugaaacaaggucucccaccagucccagaagaugaagaaggaaaugcucccaaauacguauuauccccgaaugaucugguauaccucccuacugaaaaggaacucaaaagaagagaaauagcaaugccaauagacaagucuagaauauauaaaaugguuucuugcacugguaaagauuguuucuuuauaccagcaaacacagcgguaccaauagucgaucgauaugaauacaguagcaugaacaaaauagguagagcacugacuggagaaaugauuaaagaaaucugccuaccauuaaaaauagacagacuaggucaaaucauagaaauaucuacuuucuga

SEQ ID NO: 5732 - RNA, 4506 nt, Artificial Sequence
  Cas9 variant
augaagaaaauccucggauuagauuuaggaacgaacuccaucgguugggccgucauaaauaaagcagaaaaugaaggaaaagacgugcuauguggaauagaagcagcagguucaagaauaauaccaauggacgcuacaauaaugggggacuuugaaaaaggaaauucaguaagucaaacaaaagaccggcgugaacauagaucaacaagaagacuauaugaaagggggaaauuaagacgcgaaagauugaaccgaguccuaucagucauggguuuucuuccagaucauuacgugagucaacuagauagauacgggaaauuccuaucuaauaccgaacccaaauuagcauggguaagaaacgcagacugcaaauaccauuuccuauuuauggacaguuucagcgaaauguuacaagaauuuaaaacaaacucaccacaauauauuucggaagaaucaaaaguaccuuacgacuggaccuuauacuacuuaagaaagaaagcauuaacucacaaaguuacaaaagaagaauuggcauggauccuauuaaauuuuaaccaaaaacgaggcuacuuucaacuaagagacgaaucagaagaagagaagaaaccauccaaaauaagacaauacuuugaacaccaaaaagugguagacauuauagauaccaacgaaguuuauaaaggccuaaaaguccugaucguaauucuugcuaacgggauaucaggcaaaaucuuuaagaaagaaauaccggacuggaucgggguagaaaaagacauaauagucaaaguagacauugauaaagacggaaaagacaaauucaacgaagauggaagccuaaguuguagauucaacauacccacagaagcagaaugggacacugaaugggaacuuauaaaacagaaaacacaaaaugacuuggacgcaucagguaaaacggucggagaguacauauuugacacauuauuaaggaaccccgaacagaaaauaagaggaaaacucguuagaaccauagaaaggcguuacuauaaagaagaaauaaacgcuauccuaaagaaacaaaaagaauuucaccccgaacugucugauagggccuuauaugaaaaauguguugaagaauuauacccaaacaaucccgcacauagaaacaugaugcuuauacacgaccuaaguuacuuucuaguaaaugauauacuauuuuaccaaagacccuuaaaauccaagaaaucccuaaucgacgaaugcccuuacgaaucccaucuauauauagacaagaaaucuggagaacgcaaaccuguagcaguuaaauguauagcaaaaagucacccauuauaccaagaguuccgguuauggcaauuuauaucaaaccuucgaauauaccagaaaacgaaagaaguggguaacucacuaaaaguugaugucgacguaacaaacgaguuuuuaaaaggagagaacgauuauguggaauuguuugauuggcuaaauacaaagaaagaaauaaaacaagaggacuuuuuaaaauacaaaccauucgguuucacuaaagguaacauuaauaauuauagauggaacuacguagaagauaaaauauauccaugcaacaaaacccacuauacuauauuaaaaggcuuggaaaaagcagauauuacuuucgacgaguucaucucccaugauucacuagcagaagaaaaucuguggcauauucuauacucaguaucaucaaaagaagaacuaaaacacgcuuuagaguccuuugcugauaaacgagggcuaaguauaaaauucguagaugcauucauaaacacaccagcuuucgaaaaaucguacggugccuacucugcaaaagcaaucaagaaacuacuaccacuaaugagaauggguaaauacuggaaagaagaaaacauaugugauucaacaagggaaagaaucgauaaaauaauaacaggagaauaugacgaaaauauccgagacagaguuagagagaaaagcauaaauuuaacugacauaacauuauuuagaggucuaccauuaugguuagcaugcuauguaguguacgaucgacauuccgaagcaggaaauacagaaagauggaccagccccucagauauugaccacuacauuagaaaauuuaaacaacacucauuaagaaacccaaucguagaacaaauaguacuagaaacacuaagaacuguacgcgacgucuggacagaaguaggaggaauagacgaaauacauguagaacuuggacgagaaaugaaaaauccaucugacaaaagacggaaaaugucgcuacaaaugcaagaaaaugaaaacacgaacuuacgaaucaaagcacuacuugcugaauuuauaaauccagaacugggcauugaaaacguacgaccauauucuccaucccaacaagaccuacuacguuuguacgaagaaggcgcauggaauagcccagaaauugacgaaaaacaaguagacgaaauguuagcuauucucaagaaauucaacgaaacagacaguucaaaaagaccaaccaaaagcgaaauaaaacgauauagauuaugguuagaacaaaaauauaggaguccauauacaggaacgcccauaccucuaaguaaauuauucacaaccgcauaugaaauugaacaugucauaccuagaagcagauuuuucgacgauucacuaaccaacaaaguaauaugcgaauccgaaguaaacaaacuaaaaggaaacauguuagguuacgaguucauuaaaucucacuauggagaaaaaguacaauuaucgagcggaucugaaguacaaauauuuagugucaacgacuacgaaaaauucgucaaagaccacuacucuaaaaacaaagcgaaaaugaagaaauuauugauggaugacauaccggaaaaauucaccgaaagacaaaugaacgauucaagauauauuucacggcuaauaguuucauuacuauccaauauaguacgagaaaaaggggaacaggaaagcauaaguaaaaacgucuugguuugcacaggaggggugacagacaggcucaaaaaugauuggggaguuaaugacgucuggaauaaaaucauucuaccacguuuuaaaagaaugaaugaaauaacagacucaacugauuacacaucagucaacacuucagggcauauaauuccggcaaugccucuucacuuacaaaaaggcuuuaauaagaaaagaauagaccauagacaucacgcaauggaugccauaguuauugcaugugcaggaagaaacaucguaaacuaucuaaauaaucaaucuaguaaaagcgacguuagccgacacgacuugcgaaaucuucuuugcgaaaaagauaaaagcgaccgaaaagaacuaauaauaaaaccgugggauacuuuuacccaagacgucuacaguguacuaucaucaauaaucguaucaauaaaacaaaaccucagaguaauaaauaaaaccaaaaauauuuaucaaagaaaagaagaugguaagguaaucaucaguaaacaagagaacaauauaaacuggugggcuauucgaaaaccgcugcauaaggaaacaguuaguggggagguaaacuugagaaaagaaaccacaauaagucugaaggaggcaaucgacaacccggcuagaauaauagauaaagauuucaaaaagaaacuaagagaauuaauucuaaugggauacaacgaaaaacuaauuaagaaauauuucuacgacaauaacgaauccuggcaagauguaaaccucaagaaaauuccagcauauuacuuuacgaaagauacuaacgaucgauauuucgccagucgcucacuguuagacgagaauuuugacaaaaagaaaauagaaaacaaaguuacggacaccggaauacgaacaauccuauuaagacacuuggaaguagagggcggagacucaaaaguagccuucaguccagaaggucuagaaagaaugaacaagaauauagaaauacuaaauggaggaaagaagcacaagcccauauacaagguaagagaauacgagaaagcggaaaaguuugcaguuggcaugagaggaaacaaggcuucaaaauucguagaagccgcgaaggguacuaacuuauucuuugcaguuuacgacaacggaaagaaacgcagcuuugcaaccguaccccuaaacgaaguaauuagacuacaaaaagaaggacucccaucagccccugcaaacgaagaggguuuacuacccaaauucgugcuuagcccaaaugacuuaguuuacguacccaccgaagacgaacucagaucaggacuauuacccgagaacccugcacccgaaagaaucuacaaaaugguuucguguacagguuaccaaugcuucuucauacacuuuucgguaucaggaguacuuugugacaagaaagaauuuaguucauuaaauaaaauggaaagagcaaucucaggcgaaaugaucaaagagauuugcaucccauuaaaagucaacagacuugggaaaauuauguauaacuuguga

SEQ ID NO: 5733 - RNA, 4506 nt, Artificial Sequence
  Cas9 variant
augaaaaccauacucggacuggaucuagggaccaauuccauaggaugggcaaaaauuucaaucgacgauaauggaaacuaucuaagagacauccagcucgggagcaggauaauucccaugucacaagacguucuaggaaaauucgacaacggggucacugaaucucaaaccgccguuagaacuggauucagaggguuaaggagaauacgagaaagaagccuauuaagaagagaacgucuacaucgaguacuacacguaaugggcuuucucccuccacacuaugacucagcgauuggcuggaacaaagaagaaccaucuacauacgggaaauucuuaaaccauggggaaccaaaauuagccugggagcgacaaggcgacggcucuaugagauucuuauuuauggacagcuuucauaaaaugauggaagacuucgcgccucaucagccugcacucguagcagaugggagaaaaauaccuuuagauuggacauuauacuaccuacgaaagaaagcacuaacacagccaauaaagaaagaagaacuugccuggauccuacuaaacuuuaaucagaaaaggggguacuaucaauuaagaggggaagaagaggaagaaaacccaaccaaacgugaagaauaucaugaauugaaagucguaucugucgaagcugcagaggaagggaagggaggcaauacgugguauaacguuaaacuagaaaacgguuggauuuaucacagaccaucaaaaauagaucuaucagauugggucggcaaaaccaaacaauucauuguaacgauggaauaugaggcagaugguauaacauuaaagaaaaacaaagagggggaaguaaaaagaucauuuaggguaccggacgaagaugacuggggacuaaggaagaaaagaacagaaagucaauuagaagcaagugggaaaacaguaggugcguuuauauaugaucaccuucuagcagaacccgcagacaaaauaagaggaaacuucauucguacgauagaaagaaaauacuacaaacaggaauuagcagauauacuacgugaacagucaaaauaccacgaagaauuacaaaguaagaaaauauuagccgacugugccgaggaacuauaucgaucaaaucagccccauagagauagucuacucaagaaagauaugguauacuuacuacucacagaccugauauucuaucaacgaccauuaaaaaguaagaaaagccugauagcaaauuguccguacgaguacuacgaauauguugauaaagaaacaggugagaucaaacgacagggcauaaaaugcguagcaaaaaguaacccauacuaccaagaguucagauuauggcaauucgucuuaaacuuaagacuuuaugacagaacggaagauaaagaaguaaccgcagaauacuuaccaaguaaagaagacuacgcacguuuguucguauauuuaaacgaccgcaaagaaauuaaucaggaaacauuacuaaaagauuucuuuaaacuaaagaaaguuaaacaacgaucugaaaaagaauuuccaguucgauggaacuacauagaagauaaagagaagaaauauccuugcaacgaaacaagacaugaacuucuaauggcauuagacagagcaggaauggaacgaagcuggcuagaugacacagcaaggcaauacagauuauggcaucuauuguauucaauugaggugaaagaugaagcagaacgagcgcuaagaaaauuaaaagaugacgacgaguucguaagcgcauuccugaaagucaaacccuuuaagaaagacuacggagcauauagcgaaaaagcugucaagaaacuccucgcaguaaugcgaauggguucacauuggugcgaagaugacauaugcaaagaaacaaaagaaaggauugaacacauauugcagggcgacguagaagagaaaaucaaagaacgaaugaaccacacagcauacuccuuaggagaauuaucagacuuccaagguuuaccagaguggcuagcguguuacguaguguauggaagacacagugaagcaacggacaucaaacauuggaaaacuccagaaagccuuauggcauacauuaauggauucaaacaacacucacuaagaaacccaauuguagaacaaugcauacucgaaaccuuaaggacuguacaugacauauggaaagaagcaggucauauagaugaaauacacgucgaacuuggaagaagcaugaaaucaacgucagaucagagggcgagaaugacagaaaacauacuacgcaacgaaaacacgaaucuaaggauaaaaagucuucuaauggaacuaaagaaugaugcagacaucaaagacguacguccguauucuccuaugcaacaagagauacuacguaucuaugaagaaggcgcguuacaagaauuaacaaaagaagauaaugauuacgaagaaauuuuuaaaauaaguaaaauaccacaaccaucagcuaaagaauuacuaaaauauaaauuguggcuggaacagaaauacagaucuccauacaccggaaaaccaauuagccugaguaaacuuuucacuagcgccuaccagauagaacauauaauaccgcaaaguagauauuuugaugauucauuuaauaacaaaguaauaugcgaaagcgagguaaacgcacuaaagucaaauaugcuuggauaugaauuuauuaaaaaucaugggggcgaaauaguccauuguacacuauuaggugauguaaaaguccaaaaugaauccgaauauaaggcuuuuguuaccgaacauuacgcaaacaauaaauacaagaaagaaaaacuccuaauggaggauaucccacaagauuucuuaaaucgacaucuaaaugauaguagauauauaaguaaaguugucaaaacccuacuuaguaauauuguccgaacagaggaugagauggaaacuacuucaaaauuuguagucucgugcacuggugguauaacagaucgauuaaagaaagacugggguuuaaacgacgucuggaacucuauagucuauagccgauucgagagauuaaaugaacuaacaaaaucagacgcauucggacgaugggagaauaaagaagguaaaagaguauuucaaacuucaguaccuuuggaauuacaaaggggauuuaacaagaaacgaauagaccacagacaccaugcaauggaugcucugguaauagcaugcgcaucaagaaacauuauaaacuauuuaaacaacgagagcgcuaauucccccaagaaacgagaagaccuaagacaacaauuaugugauaaaaaucgaauuauccgaaaaccaugggaguccuuuacccaagaugcacgagcagcccuggaagacgugguaguaucauucaaaaauuauguaagaguuauuaacaaaacaacgaacuacuacgaaagguauggagcagacggcgagaaaaccauagccaaacagaaaaacagugaaaugugggcaguccgaaaaccaaugcaugaagccaaauacuauggcaggguaaauuuacaacggaaaacagaaguacguuuaaaagcugcauuagaagacauaccaagcaucuguaauaaagaauuaagggauuacauuaaucgccuaguaaaauccggauuaaaugcaagacaacugcuugcucauuucaaaucaacugauuauuguuggaauaaacaaaauguggauaaaguagaaguauggcgauucucugaugaaaaagaaccauuaguagcaauacgugaaucccuagacacuucguucgaugcaaaaaggaucgauacaauaacagacacugguauacagaaaauucuuuuaaauuauuuggaagcgaaagguggggaucccgcaauagcauucacuccagaaggaauagcagaaaugaaccaaaauauggccuuguauaacaauggaaaaaugcaucaaccaauacucaggguacgacugucuaagaaaaggggaaagaaauaccaaguuggacaaacagguuguaaagcaaaacaauuuguaaucagcgaaucgggcacaaauuuauauuuugcaaucuaugaagacgaagacagaaacagaacguacaacacaaucccauuaaaugaaguagcagaacguuuaaaacaaggguuauccccuguaccagagaaaaacgaaaaagaaguuccauuaaaauucuaccuaagcccaaaugacuuagucuauguucccacagaagaagaaauucugaugaaagaaugcaaacuaaacaaaaaccggauauauaaauuuauagauucaagcggaacuacagcgaauuucguaccacacagaucagcuagucuaauuuacaauguagauaagaaauuggccgaagccuuuugcaacgaugaaauaauacagaaugaauacggcgucggaucgccucaaucgaaaaaccaaaaagcgcuaacaggagaaaugaucaaagccguauguuggaaauuagaaguagaccgucugggaaauaucauaagaguaaucaaauga

SEQ ID NO: 5734 - RNA, 4515 nt, Artificial Sequence
  Cas9 variant
augaaaaauauugugggucuagaucucggcacuaacucaauagguugggcaguaguaaacgggaacauaaaugaugauggaagcgaacaacucgugaaaauacaagccucaggaucaagaauaauuccaauggaugcugcuaugauaggggacuuuaacaaagguaauucaauaagucaaacagcagaacguacaagacucagaggaauuagaagauugucagaaagguauuuauuaagaagagaacgacuacauagaauacucgacauacuuggguucuuacccucacacuucgcacgagacuuagacagauacggcaaaaucguuaaagacaaagaaccaaaacuggcauggaggaaaaacgaagcaggacaguuugaauuuauauuucaaaauagcuuuaaagaaaugcuugaagauuucaaauuaaaucacccgaacuuaauuacggacgauaagaaaguucccuacgacuggacgauauacuacuuacgaaagaaaggucuaacaucaaaaauaucaaaagaagaacucgcauggaucuuacuuaacuuuaaucagaaacgaggauacuaucaacuucgaggugaagaagaagaagaaaauaaaaauaaacaaguagaauuuuaugcuuuaaaagugauagcgguagaagauuccggagagaagaaaggaaaagacacaugguacaacguacaucuagaaaacgguuggauuuauagaagaacaucaaauaugccauuagacuggguuggaaaaacgaaagaauuuauaguaacaaccgauuuagaaaaagauggcacaccgaagaaagacaaagaaggaaacauaaaaagaucauucagagcaccuaaagaagaugauuggagcuuagugaaaaagaaaacggaagcagacaucgaucaaacccacaaaaccguaggcacuuacauauaugauacucuacuugguaauccaagucagaaaaucagaggcagguuaguacgaacuauugaacgaaaauauuacaaagaagaauuaaaacugauucuugacaaacaaaaagaauuucauccagagcuacaagacagagcuuuauaugcagcauguguggaagaacuuuauacaaucaacgaagcucaccgaaacaacaucggaaacagggauuucacuuaccuguucuuagaagacauccuguuuuaucaaagaccacuuaaaaguaagaaaucucuuauugacaacugcccauacgaagaaaaucauugucucgauaaagaaacuggagaaauaaaauucuuuccagucaaaugcauugccaaaucgcauccgcuauuucaagaauuuagacuuuggcaguucauagucaacuugcgcauauauaggaaaggguuggcacaagacguugacguuacaaacgaauuguuaaaaacugaagaagacuaugucgcucuauuugacuggcucaacggcaagaaagaaauagaccaaaaagccuuucuaaaauacccgccauuugggcuuaagaaagaaguagaaaacuacagauggaacuauguacaagauaaaagcuaccccugcaaugaaacacguagccuuauguuagcucgacuagaaaaaugugacauaucaaucgaauuuuuaacaaaagaaaacgaagaagcacucuggcacauauuauacucaguagaggacaaaaacgaaauuguaaaagcauuacaaaaauucgcggauaaacauaauuuaaaugcuucauucguugacguauuccagaaauucccaucauuuaagaaagaauacgggagcuacuccgccaaagcaaucaagaaacuccugccauugaugagaauggguaaauauuggucggaagauucaauagacaaaggcacacgagaacgaauggacaaaauuauaacaggagaauacgacgagaaaauagaaaauaggguaagggaaaaagcaauucaucuugcggacauuuccgaauuuaaaggacucccucuaugguugguaugcuauaucguauauggaaggcacagcgaaucuaaagagauugcuaaaugggaaagcccggcagauauagauucauaucuuaaaaguuucaaacaacacucguuaagaaaccccauaguagaacaaauuauuauagaaaccuuaagaguugugagggauauauggaaacaagugggcaauauugacgaaauacacguagaguuaggaagggaaaugaaaaacccagccgauaaaagacgaaaaaugacacaacaaauaagugaaaaugagaacaccaaccuaagaauuaaauauuugcuuacugaguucuuaaauccugaguacgaaguggaaaacguaagaccguauucaccaagccaacaagacauacuaagaaucuaugaagaaggaguguuaaauuccguguccaauuuaccagaagagauaucagacauacuuaagaaauucacagaaaccgaucuaaagaaaagaccgucacguagugaagucuuaagauacaaacuuuggcuagagcaaaaauaucgaucaccauauacaggagaggugauaccacuuggaaaauuauucacgccugcuuacgaaauagaacacguuauaccacaaucaagauauuuugaugacucauucucaaauaaaguaauaugugaagcagagguaaacaaacuaaaaucuaacuuacuuggucacgaguucauaguaaaacaccacggagaaauuguggaacuaccuuucggaaagaaaguaaaaauauuuacuguagacgaauacgaacaguuuguuaaagauaacuacuccagaacaaggggaaaaaugaagaaacuauuaguagaugacauaccagaagaguucguagccagacagcugaaugauucaagauacaucucaaaagucguaaaaucucuucucucaaauaucguacgugaaaaaggggaagaggaagccaucagcaaaaacguaaucccaugcacugguggaguaacugauagauuaaagaaagacuggggagucaacgacguauggaauaaaaucaucuuaccaagauuucaacgccuaaaugaauuaacagguaccaauaaauuuacuacaaugucacucaacaaccaugaaauaccugcaaugccuuuagaacuacaaaaaggcuucaacaagaaaagaauagaccaucgccaccacgcgauggaugcaaucauaauagcuugugcgaacagaaacauaauaaauuacuuaaacaaugaaagcgcgacagcaaaagcagaacucucacguuacgaucuacaacgacuauuaugugauaaagccaaaacggaugacaaugguaauuacaaauggguaauaagaaagccaugggcuucauucacacaagacguacauggcguacuggaggacauaauagucagcuucaaacaaaacuugagagucauuaauaaggcuacaaaccauuuucuacauuauaaugaggaagguaagaaaauuuuuguuaaacaggaaaaaggugacucaugggcaauacgaaagagcaugcauaaagacacaguguucggagaagucaaccuaagaagaauaaaaacaguagcucuaaaugaagcuaugaaaaacccacaaucaauuguagucaaggacuuuaaaagaaaauuacuagaguuauuaaacuuaggcuuugaugcgaaaaggauaaagaaauacuucgaagacaacagagagacauggucugacaucaauuuaaguaaaauaacaguuuauuauuucucuaaagauacgaaagauagauucuuugcaacaagaaagccacuagauaccucauuugacagaaagaaaauagaaaacaacauaacagauacugggauccagaaaauauuacugagacaucucgaacuaaaagauaauaaucccgacauagcguucagcccagauggaauagacgaaaugaaccgcaauauaauacaacuaaauaauggcaaauaccaccaaccuauaauaaaaguaagaugguacgaacaggcagacaaauuugcggucggacagaccggaaauaaaucaucaaaauucgucgaagcugcgaaaggcacaaacuuauucuuugcaguauacgaaucaaacauacuggaugagaaaacaaacaccauaaucaagaaacgaaauuaugcuacaauaccucuuaacguagcaauugaaagacaaaaacagggauuaucagucgcaccugaagaggaaaauggaaacgaccccauauuugucuuaucuccuaaugauuuaguauacuuaccaaccacagacgaguuagcaaacggaguagucgcccaaccuuuagauaaagagagaauauauaaaauggucucguguacaggaaaugaaggacauuuuaucccagcaagaauugcaaauccgauacuacaaacaauagaacucggaucaaauaauaaagcgcaaaaagcauggaccgacgagaugaucaaagaaaucugcaugccuauaaaaguggacagacuggguaacauucucgaaucaaguucacuacacaagaaauga

SEQ ID NO: 5735 - RNA, 4515 nt, Artificial Sequence
  Cas9 variant
augaaaaacauagucggacuggaccugggcacaaauucaauagguugggcuguaguuaacggaucagucaacgaugacgguucugaacagcuaguaaaaauacaagcaucaggcagccgaauuaucccgauggaugcagcuaugauaggcgauuucaauaaaggaaauagcauaucucaaacagcagaaagaacacgauuaaggggagucagaagacugucagaaagauaucuuuuaaggagagaacgauuacauagaauucuagauauauuaggauucuuaccguuucacuuugcacaagacuuagaccgucaugguaaaauaguaaaaggcaaagaaccuaaauuggcuuggcgaaaaaacgaagcaggacaauucgaauuuauauuucaagauuccuuuaaagagaugcuggaagacuuuaaauuaaauuaucccaaccuaauaacggaugacaaaaaaguuccuuacgacuggacuauauauuaccuacgaaaaaaaggccuaacuaguaaaauaucuaaagaagagcucgcguggauauuacuuaauuuuaaccaaaagagaggauauuaucaacuacgaggugaggaagaagaagaaaacaaagauaaauugguagaauucuaugcacuuaaaguuguagccguugaagacucaggagaaaaaaaaggaaaggacauaugguacaauguacauuuagaaaaugguuggguauacagacggacauccaacaugucauuagauuggguaggcaaaacaaaagaauuuaucguaacaaccgaccuagaaaaagauggaacacccaagaaagacaaagaaggaaacgugaaacguucauuuagagcaccuaaagaagacgacuggucauuaguuaaaaaaaagacggaagcagacauagaccaaacacauaaaacaguaggagcauauauauaugacacacuuuugggcaauccuucucaaaaaauaagaggcagauugguaaggaccauagaaagaaaauauuacaaagaagaauuaaaauuaauccucgaaaagcaaaaagaguuccaucuagagcuacaagaccgagcacucuacgcagccuguauagaagaguuguacccaauaaaugaagcccacagaaauaacgucgggaaccgcgacuuuacauauuuguuucuagaagauauacuauuuuaucaaagaccauuaaaaucuaaaaaaagccucauagacaauugcccuuacgaagagaaucaaggauuagauaaagaaacaggagaaauuaaaucuuuuccagucaaauguauagcaaaaucacacccccucuuucaggaauucagacuauggcaauucauaauuaauuuacgaauauaccgaaaagaccuagcacaagacgucgacguaacaaacgaacuccuaaaaacugaagaagauuacguagcucuauuugauugguuaaacggaaaaaaggaaauagaucaaaaagccuuucucaaauacccugucuuuggguugaaaaaagaaauagaaaacuaucgauggaacuacguccaagauaaaccauaccccuguaacgagacuagaucacuaaugcuagcgagacucgaaaaaugcgauauuagcaucgaauuucuaacaaaggagaaugaagaggcccucuggcauauucuuuauagugucgaagauaaaaaugaaauagucaaagcacuacagaaguucgcugauaaacacgacuuaaaugcauccuuuguugauguuuuucaaaaauucccgccauucaagaaagaauauggcucauauucagcaaaagcaauaaaaaaacuccuaccguuaaugaggaugggaaaguacuggucagaaaauuccauagauaagggaacgagagaacgcauagacaagauaauaacuggugaauaugacgaaaaaauagaaaacaggguacgcgaaaaagcuauccaucuugccgaugugucagauuuuaaaggacuaccauuaugguuaguauguuacaucguauacggaagacacucagaagcaaaagaaauaauucaguggaaaucaccagcagauauugauucauaucugcgaucauucaagcagcauucacuaagaaacccaauagucgaacaaauaaucaucgagacgcuaagggugguuagagauauuuggaaacaaguaggaaauauagacgagauucacgucgaauuaggcagggagaugaaaaauccugccgauaaaagaaaaaaaaugacccaacaaaugagugaaaacgaaaauaccaauuugaggauuaaauaucuacuaaccgaauucuuaaauccggaauaugaaguagaaaacguccgacccuauucuccuucucaacaggacauacuccgcauauacgaggaaggaguauuaaauagcgugucagauuuacccgaagaaauuagcgauauacuaaaaaaauuuacagagacagauuuaaagaaaagaccaucaaggagugaaguauuacguuacaaacuaugguuggaacaaaaauauagaucaccauauacaggagaagucauucccuugggaaaacucuuuacccccgcuuacgaaauagaacauguuauaccacaaucaugcuacuuugaugauagcuucucaaacaaaguuauaugugaggcugaaguuaauaaacuuaaaucuaauuuauuaggacacgaauuuauaguaaagcaucauggggaaauaguagaacuuccauuuggaaaaaaaguaagaaucuucaccgucgaugaauacgaacaauuuguaaaggacaauuacaguagaacaaggucgaagaugaaaaaguuacucauggacgacauaccagaagaauucguaacaagacagcuaaaugacucaagauacauaucgaaaguaguaaagagucuacuaagcaacauuguucgagaaaaaggagaagaagaagcaauaucaaagaauguaaucccuugcaccgguggagucacagacagacuaaaaaaagauuggggaauaaaugaaguauggaauaaaauaauauugccacgcuuucaaagauuaaacgaauuaacaggaacaaacaaguucacgacgaaaaaugucggaauucaagaaauaccaacaaugccacuagaauuacaaaaagguuucaauaaaaaacggaucgaucaucgacaccaugccauggaugcuauaauaaucgcaugugcaaacagaaauauaauaaauuauuuaaacaaugaaucagcaaccgcgaaggcggaauuaucacguuaugaccuccagaaaaugcuuugugacaaagcaaaaacagacaauaauggaaacuacaaauggguaauuaggaaaccuugggccaguuuuacacaagauacuuaucuugcuuuagaaaacauaaucgucucuuuuaaacaaaacuuaagagugauaaauaaagcaacaaauagauucuuacauuauaaugaagaaggaaaaaaaauauuuguaaaacaagguaaaggagacaauugggcgauaagaaaaucaaugcauaaagauaccguuuucggcgagguaaaccucagaagaaucaaaacgguagcguuaaacgaggcaaugaaaaauccacagucaauaguaguuaaagacuuuaaaagaaaauuguuagaacuauggaaccuugguuuugacgcgaaacgcauaaaaaaauauuuugaggacaaucgagaaacuuggucagauaucaacuuaaguaaaauagaaguauacuacuuuuccaaagauaccaaagauagauucuuugcaacuaggaaaccccuagauacuuccuuugaccgcaaaaaaauagaaaauaacauaacagauacaggaauacaaaaaauacugcuaagacacuuagaauugaaagauaauaauccagauaucgcuuuuucaccugacggaaucgaugaaaugaaucgaaauaucauacaacuaaacaauggaaaguaucaccaaccaauaauuaagauaaggugguacgaacaagccgacaaguucgcgguaggacaaaccggaaacaaaucgaguaaauuugucgaagcggcaaaagggacaaaccuuuuuuucgcaguauaugaaucaaacauauuggacaaaaaaacaaacacaauuauaaagaaaagaaauuaugcgaccauuccuuuaaacgucgccaucgaaagacaaaaacaaggacuaccaguugccccagaagaugaaaauggcaaugauccaauauucguccuaucaccaaacgaucugguuuaccuaccgacagaugacgaacucgcaaauggaaucauagcacaaccauuggaccgcggaagaauauauaaaaugguaucauccucaggagaacaaugcuuuuuuaucaagcauauaguagcgaaugugcuaguagacaaauuugaauucucaccccugaacaagauggagagagcauuaacgggggaaaugauaaaaaugauaugcauaccaauaaaggucgauagacuuggaaauguacucgaaucaagcuccaguuacaaaaaauga

SEQ ID NO: 5736 - RNA, 4515 nt, Artificial Sequence
  Cas9 variant
augaagaacauaguaggauuagaucuaggaacaaacuccauuggaugggcuguaguaaauggcagcguaaaugaugauggaucagagcaauuagucaagauucaagcaagcggcucucgcauuauacccauggacgcugcaaugauaggggauuuuaauaaaggaaauuccauuagccaaacagcagaaagaacaagacuaagagguguacgaagacuaucagaacgcuaucuacuaagaagagaaagauuacauagaauauuagauauccuaggauuucuaccauuccauuucgcacaagaccuagauagacacggaaaaaucguaaaaggcaaagaaccuaaacuugcauggcguaaaaacgaagcaggacaauuugaguucauauuccaagauucguucaaagaaaugcuugaagauuuuaaauuaaaccauccaaacuuaaucacagacgacaagaaaguaccauacgacuggacuauauacuaucucagaaagaaaggccuuacuucuaaaauauccaaagaagaacuggcuuggauuuuauuaaauuucaaccagaaaagaggauauuaucaacuuagaggagaagaagaggaagaaaauaaaaauaaauuagucgaguucuaugcauugaaaguaguagccguugaagacucuggagaaaagaaaggaaaagacauaugguacaauguucaccuugaaaauggauggguauacaggcgaacaucaaauaugccacuggauuggguuggaaaaacgaaagaauuuaucguaacaacagaccuagaaaaagacggaacaccgaagaaagacaaagaaggaaacguaaaacgaucuuuccgagcccccaaagaggacgauuggucauuggucaaaaagaaaacagaagcagauauagaccagacccauaaaacaguaggugcuuacaucuaugauacuuugcucggaaauccgagucagaaaauucgugguagauuaguaagaacaauagaaagaaaauauuacaaagaagaacugaaacaaauauuagaaaaacaaaaagaauuucauuuagaauuacaagaucgagcguuauaugcagcaugcauagaagaacucuauccaauaaaugaggcccauaggaauaauguuggcaauagagacuucacuuaucuguucuuggaagacauacuguuuuaccaaaggccauuaaaaucuaagaaaagucuuauagauaacuguccuuaugaagaaaaccaaggauuagacaaagaaaccggcgagauaaaaaguuuuccaguaaaauguauugcaaaaucacauccauuauuucaagaauuucgacuauggcaauuuauaauuaacuuaagaauauaccguaaagauuuagcucaagacguggaugucacaaacgaacuacucaaaacagaagaagacuacguugcacuauuugauugguugaacggcaagaaagaaauagaucaaaaagccuuccuuaaauacccgguguuuaggcugaagaaagaaauagaaaauuauagauggaacuauguccaagacaaaccauacccaugcaaugaaacaaggagucugaugcucgcaagauuagaaaaaugugauaucucaauugaguuccucacaaaagaaaacgaagaagcacuauggcacauacuuuacucuguagaagacaaaaaugaaauuguaaaagcacuacaaaaauuugcugacaaacaugaucuuaaugcuucauucguagacguuuuccaaaaauuuccaccauucaagaaagaauauggaaguuacucugcaaaagcuaucaagaaacuauuacccuuaaugcgaauggguaaauacugguccgaaaacagcaucgacaaaggaacacgcgcacgaauugauaaaaucauaacaggagaauacgaugagaaaauagaaaacagaguaagagaaaaagcaauacaucuggcagaugugucagacuuuaaaggccuaccccuauggcuaguauguuauauaguauacggaagacauagugaagcaaaagaaaucauucaauggaaaaguccagcagauauagacuccuaucuucgcucuuucaagcaacacucguuacgaaacccuauaguagaacaaaucauaauugaaacacuaagaguaguucgagauauauggaaacaagucggaaauauagacgaaauacacguagaacuaggaagagaaaugaagaacccggcggacaaaagaaagaaaaugacacaacaaaugucugagaaugaaaauaccaaucuacgaauuaaguacuuauuaaccgaauuucuuaacccagaauaugaaguagaaaaugugagaccauauucgcccagucaacaagacauauugcgaauauaugaagaaggcguauuaaacagugugucagacuuacccgaggaaauaagugauauacuaaagaaauucacagaaacugaucucaagaaacggccauccagaagugaaauccugcgcuacaaacucugguuggaacaaaaauacagaucgccauacaccggcgaagucauuccacuugggaaacucuucacaccagcauaugaaaucgaacauguaaucccacaaagcuguuacuuugaugauucuuucucaaacaaaguuauaugcgaagcagaagugaauaagcuaaaauccaaucuccuagggcacgaguucaucguuaaacaccauggggaaauuguugaacuacccuuugguaagaaaguuagaauauuuacaguagaugaauaugaacaauuuguuaaagauaauuacagcagaacucgcuccaaaaugaagaagcuacuuauggacgauauaccggaagaauuuguaacucgacaauuaaaugacagucguuacauuagcaaaguaguaaaaucauuacuauccaauauaguaagagaaaaaggugaagaagaagcuauaucuaaaaaugucauuccaugcacaggugguguaacagauagacuaaagaaagacuggggaauaaaugaaguguggaauaaaauaauacuaccgagauuccaacgauuaaaugaacucacaggaacgaacaaauucacaaccaaaaacguaggauuacaagagauaccuacaaugccauuagaacuccaaaaaggcuucaauaagaaacguauagaucaccgacaccaugcgauggaugcuaucauaauagccugugcaaacaggaacauaauaaacuacuugaacaaugaaucagccacagccaaagccgaguuaucuagauacgaucuacagaaaauguuaugugauaaagcuaaaacagauaacaacggaaauuacaaauggguuauacgaaaaccaugggccucuuucacacaagacaccuauuuagcacuagaaaacaucaucgucucauucaaacaaaacuugaggguaaucaacaaagccacaaacagauuccuacacuacaaugaagaaggaaagaaaauauucgugaaacaaggaaaaggggauaauugggcuauuagaaaaucgaugcauaaagacaccguuuuuggagaaguaaaucuacggagaauaaaaacuguugcauugaaugaagccaugaaaaacccucaaucaauaguaguaaaagacuucaaaaggaaacuauuagaacucuggaaccucggcuucgacgcaaaaagaaucaagaaauauuucgaggacaauagagaaacauggucagacauaaacuuaaguaaaaucgaaguauacuacuucucaaaagacacaaaagaucgauucuuugcaacucgaaaacccuuggauacgucuuucgaccguaaaaagauagaaaacaacauuacagacaccggaauccaaaagauacuccugagacaucuugaacuaaaagacaacaauccggauauagcauuuuccccagauggcauagacgaaaugaacagaaauauaauacaacuaaauaacggaaaauaucaccagccaauaauaaaagucagaugguacgaacaagcagacaaauuugcuguuggacaaacaggaaauaaauucucaaaauuuguagaagcagcuaaaggaacgaauuuauucuucgcaguauaugaaucgaauauauuagauaagaaaaccaauacaauaauuaagaaaagaaauuaugcaacaauaccccucaacgucgcuauagaaagacaaaaacaaggauuaccgguggcgccggaagacgagaacggcaacgaccccauauucguccuaagcccaaaugaucuugucuacuuacccaccgaugacgaacuugcaaauggaaucauagcucagccccuggaucgaggaaggaucuacaagaugguuuccucaagcggggaacaaugcuucuuuauaaagcacauaguagcaaauguauuaguugacaaauuugaguucucgccacuaaauaagauggaacgugccuuaacaggagaaaugauaaaaaugauauguauaccaauuaaaguagaccgacuaggaaauguauuagaaucguccucaucccauaaaaaguga

SEQ ID NO: 5737 - RNA, 4515 nt, Artificial Sequence
  Cas9 variant
augaaacguauauuaggacuagaccuaggaacuaauucaauagguugggcgcuaauagaaaacgacuucaaucgaaaagaagggaaaaucgaagcacucggaucgcgaauaauaccuaugucucaagauauacuagguaaauucgacaguggagucacagugagucaaacggcagcaagaaccaauuauagaggaaucaggagauuguaccaaagggacaaccucagaagagagaggcuacaucggguuuuaaacauccuaggauuccuaccaaaacacuacgcagaaucaauagauuuugaagauagguuaggacaauucaaaccagaaacagaaguaaagcuacccuacagaaaagauucugaugauaauuaccacuucauauuucaagaaucauuuaaugaaaugguagaagaauuucaauuuaaaaacccaucauuauuuuacacaaaagcaaacggagaacaaucgaaaauaccuuacgauuggacauuauacuaccuacgcaaaaaagcccuaagcaaaaagauuucaaaagaagaacuagcauggaucuuacuaaacuucaaccaaaagcggggauauuaucaauugcggggagaagaagaagccgacaguaaagauaaacuagaggaauaccaugcacuaaaaguaagcgauguacaggcaaccgaggauacuaacgcuaaaggaacuugguacaauguaauccuugaaaacggauggaucuaccgcagacaaucaaaagacagcuuauucgacuggaaaggaaaaacaagagaauuuauaguuaccacaucacuugagaaagguggagcagucaaaaucgacaaagaaggaaaugaaaaaagaucauuccgggcuguugacagugaaaaggauuggauugcaauaaagaaaaaaacagaaaacgaucuggcuaaugcuggaaccaccguaggaguauacauuuacgagacauuacugcguaaccccgaucagaaaaucagaggaaagcuuauaaaaacaauugaacgaaaauauuaccuggaagaauugaaagcaauccuagcaaaacagauucaagaacaugccgaauuacaaaaccgaaguuuauauaaagacugcauagaagaacuauaccaagguaaugaagcucacaagaacaacauaaaggagaacggauucgauuaccuauucuuagaagauaucauauucuaccaaagaccacucaaaagcaaaaagaguacaauauccaauuguccauaugaaagcagaguauucaucaaagauggcaaaaaggaaauacaaccaauaaaauguaucucgaaaagcaacccuauauaucaagaauuuagacuauggcaauucauacacaaucugaaaaucuaugaaaaagaagcuaucgacgaugguaagacaguaauaaauaaagacguaacuaccgaauuccuuaacacacaagaggcauaugcagcacuauucgaauuuuuaaaugacaaagcggagaucucucaaaaugccuuacuaaaauauuuuaaacuaucaacaaauacacauagauggaacaacguagaagauaaaaaauacccauguaaugaaacaagaucagaauuuauaaaaagguuauccaaaauggacgguauugaccuaggcaagacacucuccccugccuuugaaaagagucuauggcauauaaucuauucuguaaaagauaagaaacaauacgugagagccuuagaaacauucgcuaugaaaaacggacuagauauaaaccaauucagagagaacuuugaaaaauucaaacccuacgauucagccuacggagccuauuccgaaaaagcguuaaaaaaaguccuuccacuaauaagacgaggaacguacuggaaaaaagacgcaaucccagcagcgguccaggagagaaucguaaauauaaugaaaagaaucgaaagcgucgauuuuaaccuagaaaaaauagaaaauuucgcagaugaugacauccccaaacaguuacuuaaaucauucgcaaaaggaaaggacccaaugcaaggccucaacacauaucaagcgugcuacgcaguauacaauaggcacucugaaguaucagauauccaacuauggaagagucccgaggacauuacgaaauauuuggauuccuuuaaacaacacucccugcgcaaucccaucguagaacaagugguaauggaaacacuuagaguagucagagacauauggcaguauuacgguaauggagcuaaagacuuuuucucugaaauucauguagaauuaggacgcgaaaugaaaaaugauaaaaaaacacgagaaaggauaaguaaauccauaacugaaaacgaaaacacuaacgaacggauaaagaauauauuaaaagaacugaugggagacgaagccuuacaaggagacauacgaccauauagcaaaggucaccaagacauucucaaacuguaugaagaaggagucuuugcaaacgcuccugaaacauauaaaaacauaaagauagacgacauagaaaaaauucguaaaaauaauucuccuucuaaaucagacauagugaaauacaaacugugguuagaacaaggguacauaucgcccuacacaggaagcccuaucccucuauccagauuauuuacgacagauuaccaaaucgaacauauaauaccaagaucaagauacuucgacgacuccaugggcaacaaaaucaucugugaaucggcagucaacgaagaaaaaacaaauaagacagcguaugaauuuauuaaagaaaacgcaggucgaaucauugaucuaggacaggggaagcaagucccccuguucgauuuagaagcauacgaaucgcacugcagaggguauuucaaaggcaauacaaaaaaauuaaaauuucuguugagugaagacaucccugaaggauucauuaaucgacaacuuaacgacagucgcuauauaucuaagguggucacuucguuacuauccaauguagucagagaggaaggagaacaggaagcaacaagcaaaaacuuaguuccucuaguagguacgauuaccucaaaguuaaaaaaagacuggggacuggaagcaauaugggaugaucugauugcuccaagauuugaacgaaugaaucaacuaacaaaaucuaccgacuuucgaaaagaagugauugacggucaugggaacagauauuuuauaaacacggucccugacgacauaaaaaaaggauucaguaaaaaaaggauagaccaucgucaccacgcauuagaugcccuuguaauagcuugcacuacuaaagaccacguaaauuauauaaccucacuaaacacacaaaggaauaauagaucucuuguuagcaaauuaagaaaaaucgaagaaaaaaccauaaaagauaaaagaacagggcagccaaaaacaauuaaaauagcaaaagcuuaucacaaaccuuggcccaacuucacaaaagaaacuuuugaaaaacucucaaaaacuguuguaaguuucaaacaaaaccagaggaucauaaauaaaacgaacaauaagacgugggguugggaaaaaguagacgguguaaugaaaaaaguucucaaaaaacaagaaaagagaaauugggccauaagaaagcccauacacaaagaaacuuacuacggcaaaguuaaaggguuugacaguccaaaaggaaaaauaacaacggcuacaagaaagucacuccgagaaaucacaaacgaacgucaauuaaacacaauuacagauuccggcauuaaaaaaauucuaaacaaucaccuuaaaacuuucauagaugaauccgguaaaauaaauuuugaaccugcauuuaaccaagacggaaucgaccuucuuaauaaaaauauacaacaacucaaugaaggaaaaaaccaucagccaauuuacaaaguaaggauguacacacauaacacaauguuuaguguuggggaugaaggcaauaaaucgacaaaauauguaauaccagaauccggaaccaauuuauuuuuuaauguauacugggaugaagaaaauaacaaaagaaacuuugagacaguuccacuaaauagagucauugccuuucaaaaacaaaccucccauauaccgaggaaagaccgaacugacgucccgaucgauaauaccuuaggaagauuuuuauucacacuaucgccagaugacuuaguuuaccucccaacggacgaggaaagcgagucuuucacuaccuuugaaauagacaguuugaacucaaaacaaguagcaaacauuuauaaauucguagacggaagcggaacaacaggaaacuuugucccagcagaagcagccaggguaauagcaaacauaaaagauaaaaaaguacgaucuaacuucugcaaacgcaacaaucuaagcgauaaacaacuaauaaaaaaugaauuuggauugggaucaccucaacuaaaaaaucagaacucauuagaugggaggcaaauaaaauccaucugcuggaaacuggagauuaacagacuaggaaaaauuauaaaggugauaaaguga

SEQ ID NO: 5738 - RNA, 4515 nt, Artificial Sequence
  Cas9 variant
augaaaaaaguccuaggacuagacauaggaacuaacucaguaggcugggcaguagucaaccaaaacgauaaaggcgaauuccuuuccauugaaaaaauugguagcagaauaaucccaaugagucaagacgucauggauaaauuuggagcagggcaaaccgagagcaguaccgcacaaagaacacaguaucguggagucagaagacuuagagaaagaucacuguuaaggagagaaagauuacacagaguguuacacauacuacacuuccuaccccaacauuaugacgcugcaaucggauggaacaaaaaagaaaauaaaacauauggcaaauuucucccuggcguagaaguaaacauaccaugggucgcgacagaucaaggacaccaguucauauucauggauucauacgcagagaugcuaaaagaucuaaaacaacaccaaccacaccuauucgaaaaaucaucuacaccuguuccccuagauuggacaauauacuaucucagaaaaaaagcguuaacccaagcaauaucgaaggaagaguuagcauggaucuuacuaaacuuuaaccaaaaaagaggauauuaucaacugcgcggugaagaagucgaagacaauacaaaaagagaagaauuuuaugcuuuaaaaguaguaaaaguagagcuagacaaagauaacacaagcgcuaaaacgugguauaaagugcaccuagaaaaugguuuuauauauccaugcccaagugauacuccaauugacucaugggugggcauggugaaagauuuuaucgucaccacaacacuagaaaaagaugguucagagaaacgaaccgcugacggggaaauaaaaagaagcuuucgagccccaaaagaggacgauuggacauuauuaaaaaaaaaaacggaauccgaacuugaaaaaagcgguaaacaaguaggcgcuuucauauacgauacuuuguuauccaacccugaucaaaaaauaauaggcggacugauuaaaaccauagaacgaaaauauuauaaaaaagaauuagaacaaauauuagaaacucaacaaaaauuuauagcagaacuuagcgacaaaaaacuuuuccaagcgugugccgaagaacuauacccucuaaaugauagucaucgugaaaacuuauuagaaagagauuucaaacaccuauucguccaagauauaaucuuuuaucauagaccacuaaaaacuaagaaaagccuaauaucaaauugcacauacgaauauagaacauuuuauaaaaacggagaaaaacaaauaagcccaauaaaauguauugcaaagucuaauccauuauuccaagaauuuagaguauggcaauucgugcaaaauuuaaggauauuacaacgacaaaggucagagggugauucuauaaaauauaacgucgaugucacugcggaauuucuaaaagaugagaacgacauagcaaaccuauucacaugguuaaacgaaaggaaaguaauaaaacaggaucaacuauuaaaauccuacuucaaacuaaagguuaauaaagaaacaaaagaauuagacuacagauggaauuacguagaugauaaaaacaaagaguacccuugcaaugcaaccagaacacacauucugucauuuuuagaaaaauguaaagaagagaaacguauagaagacgauagauuugucuauucauuauggcaucuucuauauagcguuguagagccaauugaacuacguggcgcguuagcaaaauuugcugagagagaacaccugcauccaucauucgucgacguuuuugcacaguucccucccuuagaaaaagaauauggaucauauucagaaaaggcgauaaaaagauuauuaccacuuaugcguaugggagauuacuggcacgaagacaaaaucgacguaaaaacaaaacaaaggauacaacgaauaauugacggagaagcagacgaugacauaacacaccguagcagagagaagguagagaacuuacguucuauaacagacuucaaaggacugccuuuauggaaagcgggauacguuguuuauaauaggcauucugaauccggugaacuaacgaaauggaaaaccccucacgaguuaaguaauuacauacaaaacgaauuuaaacaauacucccuaagaaacccaauaguggaacagauaguccuagaaacgcucagaguuguacaugauuuauggguaaaacauggugauuucucagaaauccacuuagagcucgguagagauauaaaaaacuccagugauaaaagaaaaagaauggcggagcgacaacaagaaaacgagaauucacgacaaagaguacuagaaauguugauugaccugaaaaaagaagcagccuuugccgauuuaaacccuuauucuccaucucagcaagaaaaacuacggauuguagaagaugguguccuaagguccaacauagaaaucccaaaagauauagaaaagauaacaaaaucagcaaaaccaacuucacgugaauuaacaaaauauagguuauggcuagaccaaaaguaucgauccccuuacaccgggcaacccauaagucucgcacaacuauuuacuucaaaguaugaaauagaacacgucauaccacaagcaaaauauuucgaugacuccuucaccaauaaaguaauaugugaaagcgaagucaacaaagagaaaggaaguauguuagcacacgaauuuauuuuaaaaaacggaggaaguacuguaaaugucggaggaagacaaguacaagugcuaaaaaaugacgcauacguagaauuaauaaaccgacuauauggaaaaaacaacccggucaaagcaaaaaaauugcucgcagaagacaucgaugaaguaguuggcgacuucucugagcgccaauuaaacgacacaagguauauaagccguguaguucaaaaauuacuaaguaacauuguuagagaagaggacgaacaagagaguacuucaaagcauguaauagggugcaguggccaaguaacuacagcguuaaaaaaagauuggggccuuaacgacauauggaauaaaauaauucaacccagauucgaacguuuaaacgagaugacagcuaccgaagauuacggcguguggcaaaguccaaaucacuuucaaauaaggguaccagaagaaauccaaaaaggauuuacgaaaaaaagaaucgaucacagacaccaugcaauggacgcauugguaauagcuugugcgacucgaagucacaucaacuauauaucgaaccguucaggacaagauagaaaugcgaaauuugaaaccacgagaaccgauuuaagaucaaaacuuugcuauaaagaaaauucgaguggaaacaacuacaacuauauauucaauaagccaugggauacguuuacacaagacgcccaccgagcucuagaaaauauuguuguaagccauaaacagaacuuaagaguguuaacaaaaacaaauaauuauacgcaauucauaaacaaagacggcaaaaaagaucuacaaaagcaggucaagggugaccacuuugcaguacgaaaaccaaugcaccaagaaacaauauacggaaggguuagcauuaggaguauuaaggaagucgcccuaaaaaaagcgcuggagaauuggaaacagauaguagacaggacccuuaaagacaagauaagagaacugauaggagccuacggaaaauaugacgcacaaacaauauuaaaauauuuuaaagauagggacuacaaauuuaacaaccugaagauaaaccgaguugaaguuuaugaauacgaucacaacugcgccgcuguaaggaaaucaauaggagacgauuugacuauaaaacaaauagagaggaucaccgaugaaucaauaagaaaaauucugaugaaucacuuaucaaacuacgaugauaacuuaaaagaagcauucucacccgaaggguuaauggaaaugaauaaaaacauaaaagaacugaacggaggcaaaaaucaccaaccaauuuauaaaguaagacuauuugaggaucuagguaguaaguuuccauuaggagucucacauaacaaccccgauaaauacgcuauagccgccaaaggaacgaaccuauuuuuugguaucuacgaagaucaagaaggaaaacgaauguucgauucuauuccacuaaacauaguaauugaucgauuaaaggagaaaaaaucaccaguccccgaaaccuacaacgaaucuaaauugaaauuccaccucaguccaaaugaccuaguauaugucccuacagacgaagaacaaaagcaaccugagcuagucgacguagaucacuuaucagaugaacaaaaaggucgaguguacaaagcggucucauucacugggaauagagcauuuuuuguaaaucacagaguaaguaaaguaauacaugauuacguagaauucgggacaaaaaauaaaaucgaaaacgacgacgacaaacgaagucuaaaacacauaugcuggaaauugaaagucaacagauugggggaaauaacggaugucaaacgauga

SEQ ID NO: 5739 - RNA, 4515 nt, Artificial Sequence
  Cas9 variant
augaaaaacauaguuggacuggaucuaggaacaaauagcauuggaugggcuguaguaaacgguucgguaaacgaugaugguucagaacaguuagucaagauucaagcaucaggcaguagaauaauccccauggaugcggccaugauaggggauuuuaauaaaggaaauucgauaagccaaacagcagaaagaacuagacuacgaggcgucagacgcuuaucugagcgauauuuacuaagacgggaacgauuacauagaauauuggacauucuaggauuccucccuuuucauuucgcacaagacuuagauagacaugguaaaauaguuaaagguaaagaaccuaaauuagcuuggagaaagaacgaagcaggucaauuugaauuuauauuucaagauagcuucaaagagauguuagaagacuucaaacuaaauuacccgaaccuaauaacugaugauaaaaaggucccauacgacuggacgauuuauuaccuacguaaaaaaggguuaacuaguaaaauaucgaaagaggaacucgcauggauauuauuaaacuuuaaucaaaaacguggauauuaccaacuaagaggagaagaagaagaggaaaacaaagauaaauugguagaauuuuaugcccuaaaaguagucgccguagaagacaguggagaaaaaaaaggcaaagauauuugguauaacguacacuuagagaauggauggguauaccggagaacaaguaauaugucacucgauuggguaggaaaaacaaaagaauuuauaguaacgacagaccuagagaaagauggaacaccgaaaaaagauaaagagggaaacguaaaaagaucauuuagagcucccaaagaagaugauuggucauuaguuaaaaagaaaacugaggcugauauagaucaaacacacaaaacaguuggagcuuacauauaugauacacuucugggaaacccaucacaaaaaauaagaggaagacucguaagaacaauagaaagaaaauacuacaaagaagaacugaaacuaauccuggagaagcaaaaagaauuccaucuggagcuccaggaucgcgccuuauacgcggcuugcauagaagaacuguacccaauuaaugaagcacauagaaacaacguaggaaaccgagacuuuacuuaccuguuucuagaagauauucuauucuaucagaggccacuuaagaguaaaaaaagucucauugauaacuguccguaugaagaaaaccaaggccuugacaaagaaacaggagaaaucaaaaguuuuccaguaaaaugcauagcaaaaagccacccauuauuccaagaauucagacucuggcaauuuaucaucaaucuaagaauauauaggaaagaccuagcucaagacguagacguaaccaacgaauuacuaaaaacugaagaagauuauguagcauuauucgacugguuaaauggaaaaaaagaaauagaucaaaaagccuucuugaaauaccccguuuucggccucaaaaaagagaucgaaaacuauagguggaauuacguacaagacaaaccauauccuuguaacgaaacacggagcuuaaugcuagcucgauuagaaaaaugugacaucucaauagaguuuuuaacuaaagaaaaugaagaagccuuguggcacauccuauauaguguagaagauaagaacgaaauuguuaaagcauugcaaaaauucgcugauaaacacgaucuaaacgccucuuuuguggacguauuccaaaaauucccuccuuuuaaaaaggaguauggaaguuacagcgcuaaagcaauaaaaaagcucuuaccacuaaugaggaugggaaaauacuggagugaaaacagcauagacaaaggaaccagagaaagaauagacaaaauuauaacaggagaauaugaugaaaaaauagaaaacagaguacgagaaaaagcaauucaucuugccgaugugagugacuucaaaggucuaccacuauggcucguauguuacauagucuauggaagacauagugaagcgaaagaaauaauacaauggaaaagcccagcagauauagauaguuacuuacguagcuucaaacaacacuccuugcgaaauccaauagucgaacaaauuauaauagaaacucuucgagugguuagggacauauggaaacaaguaggcaauauugacgaaauacacgucgaacugggccgagaaaugaaaaauccugcagauaaacgaaaaaagaugacacaacaaaugucagaaaaugagaauacaaaccuaagaauaaaauaccuauuaacugaguuuuuaaauccugaauacgaagucgaaaauguaagaccauauuccccaucacaacaagauauauuacgaauauacgaagaaggaguauuaaauuccguuagugauuuacccgaagaaauaucagacauccuaaaaaaguuuacggaaacagaccucaaaaaaagaccuucucggucagaaguucuaagguacaagcuauggcucgagcaaaaauacagaaguccauacacuggcgaaguuauuccauuaggaaaacucuuuacgccagccuaugaaauagaacacguaauaccacagaguuauuauuucgaugauucauuuucaaacaaagugauuugugaagcugaagugaauaaauuaaaaaguaaucuucuaggacaugaauuuauaguaaaacaccacggagaaauaguagaacuuccuuucggaaaaaaagugagaauauucacaguagaugaauacgaacaauuuguaaaagauaauuauucgcgaacaagaucaaaaaugaagaaauuauugauggaugacaucccggaagaauucgucaccaggcaacuaaacgacucaagauauauuaguaaaguagucaaaagccuacucuccaacauaguuagggaaaaaggcgaagaagaagcaauaucaaaaaauguuaucccauguacagggggagugacagauagacuaaaaaaggacuggggcauaaacgaaguuuggaacaaaauaauacugccacguuuucaacgauuaaacgaguuaacaggcacuaauaaauuuacaacaaaaaauguaggaauccaagaaaucccuacaaugccacuagagcugcaaaaaggauucaauaagaaaaggauugaccaccgucaccacgcuauggaugccauaaucaucgccugugcuaauagaaauauaauaaacuacuuaaacaacaaaucagcuacagcuaaagcagaauugucacgauacgaucuacaaaaaauguuaugugauaaagcaaaaacagauaacaaugguaauuacaaguggguaauaagaaaaccaugggcgucauuuacacaagauacauaccucgcacuagaaaacauaauaguaucguuuaagcaaaacuuacguguaauaaauaaagcaaccaaucgauuucuacacuacaacgaagaaggaaaaaaaauauuuguaaaacaaggcaaaggugacaauugggcaauacgaaaauccaugcauaaagacacaguauuuggagaaguaaaucuacgacggauuaaaacggucgcucuaaacgaagcaaugaaaaauccacaaaguaucguagucaaagacuucaaacgaaaauuacuagaauuauggaaucuaggcuuugaugcuaaaagaauuaaaaaauauuucgaggacaaccgcgaaaccuggucggacauuaaucugagcaaaauagaaguauauuauuucucaaaagauaccaaagaucgcuuuuuugcuacccguaaacccuuagacacuagcuuugaccgaaaaaaaauagagaauaauaucacugacacgggaauacagaaaauauuauuacggcaucuagaacugaaagauaacaauccagauauugcauucucaccugauggaauagaugagaugaauagaaacaucauacaauugaacaacggaaaauaccaccaaccaauaauuaaaauucguugguacgagcaagccgauaaauuugcaguaggacagacagguaauaaaaguagcaaauuugucgaagccgcaaaggggacuaauuuauuuuuugcuguuuaugaguccaauauacuagacaaaaaaacaaacacaauuauaaaaaagagaaacuaugcaacaauuccccuaaacguggcaauagaaagacaaaaacaaggcuuaccgguagcgcccgaggacgaaaauggcaacgauccaaucuucguauuaaguccuaacgauuuaguauaucuaccaacggaugaugaauuagcaaauggaaucaucgcccaaccucuagauaggggaagaauauauaaaaugguaagcaguucgggcgaacaauguuucuucauaaaacauauaguugcuaauguacucgucgauaaguuugaauuuuccccgcuaaauaaaauggaaagagcucuaacgggagaaaugauaaagaugauuuguauaccaaucaaaguugacagacucggcaauguuuuagaauccucaucgucauacaaaaaauga

SEQ ID NO: 5740 - RNA, 4515 nt, Artificial Sequence
  Cas9 variant
augaaaaauauaguaggacuagaccugggaaccaacucaauuggaugggcagugguaaaugguagcguaaacgacgauggaucagaacaauuaguuaaaauccaagcuagcgguaguagaauaauaccgauggacgcagcaaugauaggagacuucaauaaaggcaacucgauuagccaaaccgcagaacgaacucgacuuagaggcguacgaagacuauccgaaagauaucuuuuacgaagagaacgucuacaccgaauccuugauauacuugguuucuuaccguuccauuuugcucaagaucuugaucgccauggaaaaauugucaaaggaaaagaaccgaaacuagccuggagaaaaaaugaagcaggacaauucgaauucauauuccaagauucuuuuaaagaaaugcuagaagacuuuaaacucaaucacccuaaccucauaaccgaugacaaaaaaguacccuaugacuggacaauuuauuauuuaagaaagaaaggguuaacgucaaaaauaucaaaggaagaauuagcauggauuuuacuuaauuucaaccaaaaaagggguuauuaucaauuaagaggagaagaagaagaagaaaauaaaaacaaacuaguggaauucuacgcgcuaaaaguaguagcaguagaagacucaggagaaaaaaaaggaaaagacaucugguacaacgugcaucuugaaaauggguggguuuauaggcgcacauccaacaugcccuuagacuggguugggaaaacuaaggaguuuauaguaacuacugauuuagaaaaggacggaacaccuaaaaaagauaaagaaggaaauguuaaaagaucauuccgagccccaaaggaggaugauuggagccuucuaaaaaaaaaaacagaagcagacauagaucaaacacauaaaaccguaggagucuauauauaugacacauuacucggaaaucccucucaaaaaauacgaggaaggcuaguccgcacgauagaacgaaaauauuacaaagaagaguuaaagcaaauucuggaaaaacaaaaagaauuucaucuagaacugcaagacagagcacuauaugcagcuugcaucgaagaauuauauccaauuaaugaagcacaccgcaacaauguaggcaaccgugacuuuacauaucuguuuuuagaagauauccuuuuuuaucagcgaccacucaaaucuaaaaaaucauuaaucgauaauugcccauaugaagaaaaucaaggucuagauaaagaaaccggcgaaauuaaauccuucccaguaaaaugcauagcgaaaucacauccauuauuucaagaauuucgacuauggcaauucaucgucaaucuacgaauauauaggaaagauuuagcacaagacguagacguuaccaacgaauuacuaaagacagaagaagauuacguagcguuauuugauuggcuaaacgguaaaaaagagauugaucaaaaggcauucuuaaaauacccuguuuuuggcuuaaaaaaagaaauagaaaauuaccguuggaacuauguacaagauaaaccauaucccugcaaugaaacuagaaguuuaaugcuggcacgacucgaaaaaugugauauaucaaucgaauuucuuacaaaagaaaacgaagaagcacuauggcauauacuguacucaguagaagacaaaaaugagaucguaaaagcauuacaaaaauucgcugauaaacacgaucugaacgccuccuuuguggacguauuccaaaaauuuccuccauuuaaaaaggaauacgguagcuauagugccaaagcaauaaaaaagcugcuaccguuaaugagaauggguaaauauuggucagagaauaguauugauaaaggaacacgugaacgaaucgacaagaucauaacaggagaauaugaugaaaaaauagaaaauagaguuagagaaaaagcaauacauuuggccgacgucuccgacuuuaaaggacuuccacuuuggcucguauguuacaucguguauggcagacacucagaagccaaagaaauaacccaauggaaauccccagcugauaucgacucuuauuuaaggaguuuuaagcaacauucacugagaaaccccaucguagaacagauaauuauagaaacacuaaggguagucagagauauauggaaacagguaggcaacaucgacgagauacacgucgaacuuggaagagaaaugaaaaacccggcggauaaaagaaaaaaaaugacccaacaaaugucagaaaaugaaaauacuaaccuaagaauuaaauaccuccucaccgaguuccugaauccagaauaugaaguugagaacguaagaccauauucaccaagucaacaggauauacuaagaauauaugaagagggugugcuaaacucgguaucagaccuaccagaggaaauaagcgacauccuaaaaaaauucacugaaacagaccugaaaaaaagaccaaguagauccgagauauuacgcuacaaacuaugguuagaacagaaauaccgaucaccauacacaggcgaaguaaucccauuaggaaaguuauucacaccagcauaugaaauagaacacguuauuccacaauccuguuauuucgacgacucauucucgaauaaaguaauuugcgaagccgaagucaauaaacuaaaaaguaaccuauuggggcacgaauuuaucguuaaacaucacggcgaaauagucgaacuuccauuuggcaaaaaaguaagaauauucacuguugacgaauaugaacaauucgugaaagauaacuauagucgaacuagaagcaaaaugaaaaaauuacuaauggaugauauaccagaagaauucgugacgagacaacuaaacgacucaagauauauaucaaaaguaguaaaaagccuacuaucaaauauuguaagagaaaaaggagaagaagaagcaauaucaaaaaauguaauacccuguaccggaggagugacagaucgcuuaaaaaaagacuggggcauaaacgaaguauggaacaaaauaauacuaccacgcuuucaaaggcuaaacgaauuaacugguacgaauaaauuuacaacaaaaaacgucgggauacaagaaauuccgacaaugccacuagaacuucaaaaaggcuucaacaaaaagcgaauagaccaccgacaucacgcaauggacgcgauuauuauagccugcgccaaucgcaauauaauaaacuauuuaaacaaugagucggcaacggcaaaagcagagcuaagcagauaugauuugcagaagauguuaugugauaaggcaaagaccgauaacaaugggaauuacaaaugggugauaagaaaaccaugggcaucauucacacaagacacauaccuugcauuagaaaauaucauuguaucauuuaaacaaaaucuuagaguaauaaacaaagcaacaaauagauuucuacacuauaacgaggagggaaaaaaaauauuugucaaacagggaaaaggagauaauugggcaauaagaaaaaguaugcacaaggauacaguauucggagaagugaaucuuagacguaucaaaacagucgcacugaacgaggccaugaaaaacccacaaucuauaguugugaaagacuucaaacgcaaacuauuggaauuauggaacuuaggauuugaugccaaaagaaucaaaaaauacuucgaagacaacagagaaaccuggucagauauaaaucuuaguaagauugaaguauacuacuucucaaaggacacgaaagauagauuuuucgcaaccagaaaaccucucgacacuaguuucgacagaaaaaagauagaaaacaauauaacagauacaggaauccagaaaauauuacuuagacaucuagaauuaaaggacaacaauccggacaucgcauuuagcccagauggaauugaugaaaugaacagaaacauuauacaacuaaacaacggaaaauaccaccagccuauaauaaaaauacgaugguaugaacaagcggauaaauuugcaguaggacaaacagguaacaaauuuucgaaauucguagaagccgcaaaaggaacaaauuuauucuucgccguuuacgaaucaaacauacuggauaaaaaaacgaacacaauuaucaaaaagagaaauuacgcaacuaucccacuaaauguagccauagaaagacaaaaacaaggacuuccaguagcaccugaagaugaaaauggcaacgauccaauauuuguccuaucccccaaugaucuaguauaucuuccaacagacgacgaacucgccaacgguaucauagcacaaccauuagaucgagguagaauauacaaaauggucaguuguacaggaaacgaaggacauuucauaccugcaagaauagccaacccgauacugcagacuauagaacuaggcuccaauaauaaagcccaaaaagcauggacugacgaaaugauaaaggaaauaugcaugcccauuaaaguagaccgacuagguaacguauuagaaucaaguucaucguacaagaaauga

SEQ ID NO: 5741 - RNA, 4521 nt, Artificial Sequence
  Cas9 variant
augaaaacaauauuaggacuagacuuaggcccaaauucaauugggugggcaaaaguggaagucgacgaugaaggaaacuaccucaggaacauaaaacuuggaucacggauaauaccgaugacucaagacaugcuaggagauuuugacaagggagugaaggugucgcaaaccgccauuagaacagauuuuagaggcaacagaagacucauagaaagacaccuacucaggcgagaaaggcuucaucgagucuuacaugcauuaaaauuccugccuaaacacuacgaagaugccauaggaugggacagaaacgaaccagcaacauauggcaaguuuguaaauaacucagaaccaaaacuggcuugggaaagacaggaagacggcucaaugagguucuuauuuauggagucauucaacgaaauggucgcagauuuugcccagaaccaaccgucauuagucucagacgggaagaaaauaccauuggacuggacgauuuacuaucuaagaaagaaagcauuaacacgcccaaucaagaaagaagaauuagcauggaucuuacuaaauuucaaucaaaaacggggguauuaucaauuaagaggugaagaagaagaagacaaccuaacaaaacgaaaagaauauuauaaacuaaaaguaguaggaguagaagcagauggugcaccgaaaggugggaaaaccugguauaauauccaccuugaaaauggguggacagcacgcugccagucuaaaauaccacuagacgauugggucggaaaaguaaaagaauauauaguaacaacugaguaugaagacgacggcaaaacacccaaaugugacaaagaaggaaaggucaaaagauccuucaagagcccggagaaagacgacuggcaguuaaucaaaacaagaacagaaaaauuuauagaugauaguaacaaaacaguaggugcauucauauaugacuaucuacucgaaaaaccguucgauaaaauaagaggcaaauacauaaggaccaucgaaaggaaauauuacaaaaaugaacuaagagaaauauuaagagaacaaaccaaauaccaugagggauuacacagucuagaagcauuaaaaauaugcgcugaagaauuauauaaaaauaaccaacaacaucaagaauacuuauuaaagaaagacaugacauuuuuguuauuaaaugaccuaauauuuuaccaaagaccacuaaaauccaagaaaaguuugauagcggacuguccuuaugaaguuuacaaauaugacgacaaauuaacagguaagaaaggacaaaagaaaauaaaaugcauagcaaaauccaacccauauuaucaagaguuccgcuuauggcaauuuaucgccaauuuaagacucuuuucagucacagauggcaaagaagugacggcagaauaucuuaaaacggaagaagauuauguaagacuauuuuccuuuuuaaacgacagaaaagauauuaaacaagagaccuuuuuacgaucguuucuaaaacugaagaaagaauccauaggaucugagaaaauauacccaauaagauggaauuacauagaagacgcaaacaaaucguauccauguaaugcaacucgccaugaacuacuuuuggcauuugaccgggcagauauuccuagagaauuacuagaugucgaagaacgugaauacaggcucuggcacuuauuguauaguauagaagcuaaagaagaaacugaaucagcgcucaggaaacuaaaagcaaauaaagcauuuggagaucugaacauugacgaugcguuuguaaacuccuucuuaaaaauaaaaccauucgaaaaagaauauggagcauauucggagaaagccauaaagaaauugcuagccguaaugcgaagagggagccucuggaaagaggcagauauaugugaagcaacaaaacaaaacauagcaaaaauacuacaaaacgacauugaugaaaaauuaaagaagaaaauugaggcagcagucuccucuuuuaauaaauuaagcgacuuucaaggacucccaacauggcuagcaugcuacgucguuuacgguagacacucagaagcagcacaaauacaaugcuggcaauccccagaagaccuuaaaaccuauauaaauaaauuuaaacaacacagucuaagaaacccaauuguagaacaaugcuuauuagaaacguuaagaacuguuuaugauauauggaaagaugccggucaaauugaugaaauacacauugaauuaggaagaaacaugaaaucaacugcugaacaaagagcgcgcaaaacuaaagacauccuccgaaaugaaaauacaaaucuuagaauuaaaaacuuauuaguagaacuuaaaaacgacgauaaaauagaaaacguacgaccauauucuccgagucaacaagaaaucuuaagaauuuacgaagaaggugcgcugcaagaauuaucaaaagaagaugaaauguuugaagacauuaguaaaaucuccaaaauggcacaaccgucacccacagaauuaucgagguauaaacuaugguuagaacaaaaauauagaucaccauacacgggaagagucauaccacuaagcaaacuauucacaacagcguaccaaauagaacacauaauaccacaaucgcguuauuucgaugauagcuuuaauaauaaagucauaugcgaaucagaaguaaacucauuaaaagauaauaugcuuggauacgaguucauaaaagaauguggaggacggauaguccacuguacauuacuaggagaugugaagauuuucacgaaagaagaauauaaagauuucguaaccaaacauuacauagauaauacauauaaaagagacaaacuucuacucgaagacauaccacaagaguucagugcccgacaauuaaacgauucucgauauaucucgaaaaugguacaaacaguccuuagcaauauuguacgagcagaaaacgaacaagaagcaacaagcaaauucguaguuagcugcaauggcgcaauaacaaaccgacuuaaaaaggauuggggguugaaugauguuuggucaucaauuguguguccucgauuuaaacgucuaaacgaaauaaccaagacgaaugccuuugggcauugggaagacaaagcaggaaaacauguauuucaaacaacgguuccacuagaauuacaaagagguuuuaguaagaaaagaauagaccaccgacaucaugcaauggaugcacuggugauagcaugugcaucucgaaauauuguaaauuaucucaacaaugaaucagcuaacaguccagaaaagagggaagaucuaagaaagaaacuaugugacgaaaaacgaaaaauacguaaaccauggaaaacauuuacgcaagaugcaagagaagcguuaagcgaugucgucguuagcuuuaaaaauuacguacgcguuaucaauaaagcuacaaauuauuacgaacacuauagcucaucggguaauaaagucaugaucucccaaaaaggaaacgacaugugggcgauaagaaaaccacuacacaaagaaagcguuuuuggccgaguaaaucucugcagaaaaguaauuguaucacucaagaaagcacuggagaauauccccgcaauaugcgauaaaacacuacgagauuacaucaacgcuuuaguagaaaaacacuuuaacacaaggcagcuucuggcccacuuuaaaucaauaaacuaccgauuaaauagacaaugcguagaaaaaguagaaguauggcaauucuccgaugagaaaauagaaaugguagcaaggaggaaaucuuuagacacgucauuugacgauaaacaaauaucaaguaucacagacaccggcauacaaaagauuuuacuaaauuaucuucaaacaaaagacggcaaugcagaaauugcguuuacaccggaaggaaucgaagaaaugaacaaaaacauuuccuuguacaaugauggcaaggcucaucaaccaauacugaagguacgaguggcgaccccaaagggcaugaaauauccaguuggccaaacaggcaauaaagcgacaaaauuuguuguugcugaaaaagguacgaaucuauacuucgccauauaugaaaaugaacucggaguacguucauaugauacuaucccccuaaacauagucguugaaagacucaaagaaggcuuaucaccaguaccacaagccaaugaagcugauauaccccuaaaauuuuauuuaagucccaaugaucugguauacguaccaacaaaagaaaaugaagacgagcugugccgugauagaauauacaaauucguagauaguucaggaacaacugccaauuucguuccccacaccagugccaauacuauauacaauguagacaaagaguaugcagagaaaugcugcaacggugcuguauucuuaaacgaguacggauuagguucaccacaauccaaaaaccaaagagcauuaacuggagaaaugauaaaagaaaucugcuggaaauuaaaaguagauaggcucggaaacauaauaaaagugauaaaauga

SEQ ID NO: 5742 - RNA, 4530 nt, Artificial Sequence
  Cas9 variant
augaaaaauauaguaggacuagaucuggguaccaauagcauaggaugggcgguaguuaaugguaguguuaaugaugacgguagcgaacaauuaguaaaaauacaagcaucggguucaaggauuauccccauggacgcggcaaugauaggagauuucaauaagggaaacucaauaucucagacagccgaaagaaccagacugcgaggaguacgcagacugagugaacguuaucuccuaagacgagaaagacugcacagaauacucgacauacuagguuuuuuaccauuccacuucgcgcaagaucuugacagacauggaaaaaucguaaaaggaaaagaacccaaacuugcguggagaaaaaacgaagcuggccaauucgaauuuauauuccaagacucguuuaaagagaugcuugaagauuucaaauuaaaucaccccaacuuaauuacagacgauaaaaaaguaccauaugauuggacaauuuauuauuuaagaaaaaaaggucucaccagcaaaauaucaaaagaagaacuagcauggauauuauuaaauuucaaucaaaaaagaggcuauuaucaacugagaggagaggaagaaaaaaaaaaugauaacguaaugaucauuaauuccaagguuauagauguggucaaagcagagaaagauaagaaauaugaaaaauacugguacaacguuuuacuagagaacggcuuauuauaccgagcagcauucuauaaugauaucaguuucuggaaaggccauaccaaagaauucguacuaaaaaccaucaagcuaaaaagcggggggaccaaacaagaacuaaguuucuuaccaaguuuugacgaaauagaaaagauggaaaaaaaacaaaaagacaagauguacuuuaaaauaaaauuaaaaacagaagcugauauagaccaagcucacaaaacagucggaacuuacauauacgauacccuacuaggcaauccuucccaaaaaauuagaggcagauuaguccgaacuaucgaaagaaaauauuauaaagaagagcuaaaguuaauauuagauaaacaaaaagaauuccauccggaacuccaagauagagcgcuauaugcggcuuguaucgaagaacuauauccuauaaaugaagcccaucgaaauaacgucggcaaccgagauuucacguauuuauucuuagaagauaucuuauucuaccaaagaccguuaaaaaguaagaaaagucuaaucgacaauuguccauacgaagaaaaccaaggccuagacaaagaaacaggagagauaaaaucauuuccgguaaaauguaucgcuaaaucccauccacuguuucaagaauuuagauuauggcaauuuauaguaaacuuacgcauauacagaaaagaccuagcacaagauguagaugucacaaacgaauuauuaaaaaccgaggaagacuauguugcacuauucgacuggcugaacgguaaaaaagaaauagaccaaaaagcuuuccucaaauacccugucuuuggacuaaaaaaagagauagagaacuacagguggaauuauguacaagacaaaccauacccauguaaugaaacaagacuccuaauguuggcccgucuagaaaaaugcgauauaaguauugaauuuuuaacgaaagaaaacgaggaagcucuauggcauauauuauauuccguagaagauaaaaaugaaauagucaaagcacugcagaaauucgcggacaaacaugauuugaacgcauccuucgucgaugucuucagaaaauuuccacccuuuaaaaaagaauauggaucuuacucagcuaaggccauaaaaaaauugcuaccccuaaugcgaaugggaaaauauuggucagaggacucaauagacaagggaacacgaaagcgcauggacaaaauaauuacaggggaguaugacgaaaaaauagaaaauagaguaagagaaaaagugauacaucuagccgacguaagcgauuucagaggauuaccacuuugguuagucugcuacauugucuacggacgccacuccgaagcaaaagagauaacucaauggaagucccccgcggacauagauucauacuuaaaaucauuuaagcaacacucguuaagaaacccaauaguggaacaaauaauaauagagacauuaagaguagugagagauauauggaaacaaguugggaauauagaugaaauucauguggaacuuggaagagaaaugaaaaaucccgcagauaaacggaaaaaaaugacacaacagaugucagaaaacgaaaacacaaacuuaagaaucaaauacuuacuuacagaauuuuuaaacccugaauacgaaguugagaauguacgaccuuacaguccaucacaacaagacauauugcguaucuaugaagagggaguucuuaacucagugagugaucuuccagaagaaauaagugacauacucaaaaaauucaccgaaacugaucucaaaaagcgaccgucucggagugaaauauuacgauacaaauuauggcuagagcaaaaauauaggucaccauacacgggggaaguaauaccauugggaaaauuauucacccccgcuuaugaaauagagcacguuauaccacaaucauguuauuucgacgacaguuucaguaacaaaguaauaugcgaggcagaaguaaacaaacuuaaaaguaaucuccuaggacacgaauuuaucguuaaacaucacggcgaaauaguggaauuaccauuuggcaaaaaaguaagaauauuuacgguugacgaauacgaacaauuugucaaggacaacuauucacggaccagaggaaagaugaaaaaacuacuaauggacgacauuccugaagaauucguagccagacaguuaaaugacuccagauacauaucaaaaguuguaaaaagucuauugucaaauauuguccgggaaaagggcgaagaagaagcuauuucaaaaaacguaauaccuugcacgggagguguaacggauagauuaaaaaaagacugggggauuaacgaaguuuggaacaaaauaauacuuccucguuuucaaagacuaaacgaacucacaggaacaaauaaauucacaacaaagaacguaggaauacaagaaauacccacaaugccauuagaacuacaaaaggguuuuaacaaaaaaagaaucgaccaucgacaucacgcaauggaugcgauuauaauugcuugugccaauagaaacauaaucaauuaucuaaacaacgaaucggcgacagcaaaagcagaacuuucaagauacgaccuacaaaagcuccuaugcgacaaagcuaaaacagauaacaauggaaacuacaaaugggucauaagaaaaccuugggcauccuuuacucaagacacauaccuagcacucgagaauauaaucguuagcuucaaacaaaaucuaagaguuauaaacaaggcaaccaaucgcuuccuacacuacaaugaagagggcaagaaaauauucguaaagcaaggcaaaggggacaacugggcaauaagaaaaucaaugcacaaagauacaguauucggagagguaaacuuaagaagaauaaaaacaguagcauuaaaugaagccaugaaaaacccacaaagcauaguaguaaaagacuucaaacgaaaacuacuagaauuauggaacuuaggauucgacgcgaaaagaauaaagaaauauuucgaagauaaccgagaaacuuggagugauauuaaccucagcaaaauagaaguauauuacuucaguaaagauacaaaagaccgauuuuucgccacuagaaaaccucucgauacaucguucgacaggaaaaaaauagagaacaacaucacagauaccggaauccaaaaaauuuuacuuagacaccuagaauuaaaagacaacaacccagacaucgcauuuucacccgacggcauagaugagaugaacagaaacaucauucaacucaauaauggaaaauaucaccaaccaauuauaaagauacguugguacgagcaagcugacaaauucgcugucgggcaaacaggaaauaaauuuucaaaguuuguugaagcggcaaaagguacgaaucucuucuucgcaguauaugaaucaaauauauuagacaaaaaaacaaacacaaucauaaaaaaacguaacuacgcaacuauuccauugaacguagcaauagaaagacagaaacaaggauuaccgguugcaccagaggacgagaauggaaaugacccgauauucgugcuaaguccuaaugauuuaguuuaccuaccgaccgaugaugaacucgccaauggaauaauagcgcaaccacuugacagaggaagaauuuacaaaaugguuucuugcacagggaaugaaggucacuucauaccggcgagaauagcaaacccgauauuacaaacaauugaauuaggaagcaauaacaaggcccaaaaagcauggacagacgaaaugauaaaagaaauaugcaugccaauuaagguagacagauuagguaacguacuagaaucgucuucgucauacaaaaaauga

SEQ ID NO: 5743 - RNA, 4530 nt, Artificial Sequence
  Cas9 variant
augaaaagaauauuaggacuagaccucggaacaaauucgauaggcuggucgcugauagaacaugacuuuaaaaauaaacaaggacaaauagaaggccuagguguucgaaucauaccgaugucgcaagaaauauuaggaaaauuugaugcaggacaaaguauuagucagacugcagaccggacgaaauaccguggcguaaggcgacuauaucaaagagauaaccuacgacgugaacgauugcaccgaguacuuaaaaucuuagauuuccucccaaaacauuacagugaaucaauagacuuccaagauaaaguuggacaauuuaaaccaaaacaagaagucaagcucaauuacagaaaaaacgaaaaaaauaaacacgaguucguauuuaugaacagcuuuauagaaaugguuagcgaguuuaagaaugcacaaccagaacuauuuuacaauaaaggaaacggggaagaaacaaaaauaccguaugauuggacgcuauauuaucucagaaaaaaggcacuaacccaacaaauaacaaaagaagaauuagcauggcuaauucuuaauuucaaccaaaaaagaggauacuaccaacuccguggcgaagauauagacgaagauaaaaacaaaaaauacaugcagcuaaaaguaaacaacuuaauugacagcggugcaaaaguaaaaggcaagguauuauauaacguaauauuugacaauggauggaaauaugaaaagcaaauaguaaauaaagacgagugggaaggccgaacaaaggaauucauaauaacaacuaagaccuuaaaaaacggaaacauuaaaagaacguacaaagcaguagauucagaaauagauugggcagcaauaaaagcgaaaacugaacaagauauaaauaaagcaaacaaaacuguaggagaauacauauaugaaucacugcucgauaauccaagccaaaaaauccggggcaaauuggugaaaacuauagaaagaaaauuuuacaaagaagaauucgaaaaacuacuuucaaaacaaauagaacuucaaccagaauuauuuaaugaaagccucuacaaagcaugcauaaaagaacuguacccccgaaacgaaaaccaucaaucuaacaauaaaaaacaaggauucgaauaccuuuuuacggaagacauaauauucuaccagaggccgcucaaaucacaaaaaucuaauaucaguggcugucaauucgaacauaaaauauacaaacaaaagaauaaaaaaacuggcaaacuagaauuaauaaaagaaccaauaaaaaccauaucuagaucacacccauuauuucaagaguuccgcauuuggcaauggcuacaaaaucuaaaaauauauaacaaagaaaaaauugaaaacggaaagcucgaagauguuacaacccaacuuuuaccaaacaaugaagcguauguuacacuauuugauuuccuaaacacaaaaaaagaauuagaacaaaaacaauucauagaauacuucguaaagaaaaagcucauagacaaaaaagaaaaagaacauuuccgguggaauuucguagaagauaaaaaauacccauuuagcgaaacaagagcacaguuccuaucaagacuugccaaaguaaaaggaaucaaaaacaccgaagauuuucuaaacaaaaauacacaaguagguagcaaagaaaauucaccauuuauaaaaaggauagaacaauuauggcauauaauauacagcguuucagauuuaaaagaguaugaaaaagcacuagaaaaguucgccgaaaaacauaauuuagagaaagacagcuuucuaaaaaauuucaagaaauucccgccauuuguuucugacuacgcaucauacucuaaaaaagcaauaagcaaacuauuaccaauaaugcggaugggaaaauacuggucagaaucggcaguuccuacgcaagucaaagaacgaucucuuucuauaauggaaagaguuaaaguccugccgcuaaaagaaggauacagcgacaaagauuuagcugaccuccuuagccggguaagugaugacgacauaccaaaacaacucaucaaaucauuuauaagcuuuaaagauaaaaacccauugaaaggucuaaauacauaucaagccaacuaucuaguguacggacgacauucagaaacuggggauauucaacacuggaaaacacccgaagauauagauagguauuuaaauaacuucaaacaacacucccuacgcaacccaauaguugaacaaguuguaauggaaaccuuaagaguaguacgugacauaugggaacacuacggcaauaaugaaaaagacuucuucaaagaaauacacguggagcuaggaagagagaugaagagcccugcaggcaagagagagaaauuaucacaaagaaacaccgaaaacgaaaauacuaaccacagaauucgugaaguacuaaaagaacuaaugaacgacgcuagcguggagggaggcguacgagauuauucccccucccaacaggaaauacucaaguuauacgaagaaggcauuuaccaaaaccccaauacaaacuaccuuaaagucgaugaagaugaaauccuaaaaauaagaaaaaaaaauaacccaacccaaaaagaaauacaaagauacaagcuaugguuagaacaagguuacaucagcccguacacagguaaaauaaucccacuaacaaaacuguuuacacacgaauaccagauagaacauaucauaccccaaucacgauacuaugauaauagucuugggaacaaaauuauaugugaaucagaagucaaugaagacaaagacaacaaaaccgcuuaugaguaccuaaaaguagaaaaaggaaguauaguuuucggccacaaacuacucaaccuggaugaguaugaagcacacgugaacaaauacuucaaaaaaaacaaaaccaaguugaaaaaccuccuaagcgaagacauaccggaaggauucaucaauagacaauuaaacgauucccgcuacauaagcaaacucguuaaaggauuauuaucaaauaucguucgagaaaacggugaacaagaagcaacauccaaaaacuuaauaccaguuacagguguaguaaccucuaaacucaagcaagauuggggccucaaugacaaauggaaugaaauaauagcgccaagguucaaacgcuuaaacaaacuaacuaacucaaacgacuuuggauuuugggacaacgacauaaaugcauuuagaauccaaguacccgacagcuugauaaagggguuuucaaaaaagcgaauugaccauagacaucaugcguuagaugcacuugucguagcaugcacaucaagaaaccacacacauuacuuaagcgcacucaaugcagaaaacaaaaauuacucacuccgggauaaauuagucauaaaaaacgagaacggugacuacacuaaaaccuuucaaauaccauggcaaggauucacaauagaagccaagaacaaccucgaaaaaacaguggugagcuucaaaaaaaaucuucgcguaauaaauaaaacaaacaauaaauuuuggagcuacaaagacgaaaauggcaaucugaaccuaggaaaagacggcaaacccaaaaaaaaacuuagaaaacagaccaaaggcuacaacugggcaaucagaaagccuuuacacaaagaaacgguguccggcaucuacaauauaaaugcaccaaaaaacaaaauugcaaccaguguacgaacguuacucacagaaauaaagaacgaaaaacaccucgcaaaaauaacugacuuaagaauacgcgaaacuauccucccaaaucaccugaaacauuaccuaaauaacaaaggugaagcaaauuuuagcgaagcauucagucagggaggaauagaagauuuaaacaaaaaaauuaccacacuaaaugaaggcaaaaagcaucaaccaauauacagagugaaaauuuuugaagucgguaguaaguuuucaauaucagaagacgagaacagcgcaaaaucaaaaaaguauguugaagcagcaaaaggaacaaaucuauucuuugcuauauaucuagaugaagaaaacaaaaaaagaaauuaugaaaccauuccccuuaacgaaguaauaacccaucagaagcaagucgccggauuucccaaaucagaacgcuuaucaguucaaccugacucgcagaaagguaccuucuuguuuacauuaagcccaaaugaccuaguauauguuccuaauaaugaagagcuagaaaacagagaucucuucaaccuagguaaccuuaacguggaacaaaucucaagaauauacaaauucacagacagcucggauaaaacauguaauuuuauaccauuucaagucucaaaauuaauauucaauuuaaaaaaaaaagaacagaagaaacuagacguagauuuuauaauacagaacgaauucggauuaggauccccccagaguaaaaaucagaaaaguauagacgacguaaugaucaaagaaaaaugcauaaaacuaaaaauagacagacuggguaauauauccaaagccuga

SEQ ID NO: 5744 - RNA, 4530 nt, Artificial Sequence
  Cas9 variant
augaaaacaauacuaggacuagacuuagguacaaauaguguaggcugggcugucauuaacucaguuauaaaggaacaagcagaaagaaucuggaucgaaauggcuggaucacgaauaauaccgauggaugcagcagucuuaggagacuuugauaagggaaauucuauaucacaaacuucugaaagaacucgacuaagaggaguuaggagacucagagaaagacaauugcuuaggagagaacguuuacauaaaguauuaaauauacuaggauuuuuaccaaaccacuaccuagaguacauagauuucgaaaagcauccaggaaaauuuuuaagcgaugcugaaccaaaauuaccuuggguaaaggacgaacaaggaaaauacacauuucucuuucaagcugcauuugacgaaaugcuggcagauuuugccauacaccaacccagucugguaaguggugauaagaaaauaccauaugacuggacaauuuacuaucuucgcaagaaagcauuaacagaaaugauuucaaaagaagaacuugcauggauacuacucaacuuuaaccaaaagagagguuauuaccaacuaagaggagaagaagaagaagacaacgcaggaaaaucgguggaguucuacgcacuuaaaguacuuacaguugaagccaccgacgaaaagaaaggucgcgacguaugguacaacgugcaucucgaaaauggauggauauauagaaggucaaguagcguaccauuagacugggaaggucaaauaaaagaauuuauagugacuacugaucugaauccugauaguacaccaaaauuagacaaauauggugaagugaaacguucauuuagagcacccaaagaagacgauuggauguuaaucaagaaacgaacagaagccgauauagcuaacacucacaaaacuguaggcgcauauauuuacgauacauuacuucaaaaaccgcaacagaaaauuauaggaaaauugguaaaaacaguugagagaaaacuguauagagacgagcuaucuuuaauucuccaaaaacagugugcauuucaugcagaauugcaagaccgaacauuguacgcuagauguguugaagcgcucuauccaaacaaugaaguucaacgaagaaauauugcaaaucgagauuucguauaucuacuaauggaugacguucuguucuaccaaagaccacuaaaaacuaagaaaucucugauagcaaauuguccauacgaagaaaaugaauauguagaucgagaaaccggcgaaauaaagaaagcgccauuaaaaugcauagcaaaaagccacccauuauuucaagaauuucgcuuguggaacuucuuaagcaacauuagaauuuaccaaaaagagaaagagauuaaugggacucuacacuuagauguagauguaacagccgaauuucuuaaaacagaagaugauuacguagcucuuuuugacuggcucaauucaagaaaagaaauugaacagaaaacauuucucaaauauccgaaauucggccugaagaaagaaauaaguaauuaucgauggaacuauguagaagacaaacaauauccaugcaacgaaacaagacaugccauacuaucaagauuagaaaaagcuaacguaugcaucgauuuucuaucgaacgagaaagagguggcuuuauggcauauccuuuacucuguguccgauaaacaggagauagaaaaagcauugcgaaccuucgcugcuaaaaauggacuggaugaaaguuuuguagaagcauuuaagaaauuuccaccauucaaaagugaguauggugcauacuccgcaaaagcaaucaagaaauugcucccacuuaugagaugugggaaauauugggauguaucaucuaucgaugacacaacuaaagaaaggauaaagaaaauuguugcaggagaguaugaugaaagaauagcugugaaaguaagagauaaaguaaugaaucuuagcgacauaaguuguuuuaaacguuugccauuauggcuugcauguuacaucguauauaaucgccacagugaagacaaagaagcaguaaaaugggaaucuccagcagacauagaugcuuacuuagcaucauucaaacaacacucucuucgaaacccaauagucgaacaaguaauaacugagacccuaagagucguaagagacauauggaaacaaguaggacguauugaugaaauacacaucgaacuuggucgcgaaaugaaaaauccagccgacaaaagaaaaaggaugaccgcccaaauacucgagaacgaaaaugcaaaucuccgaauuaaagcauuacuggcagaguucaugaauccagaauaugaaauagaaaaugugaggcccuauucuccaagucaacaagaaauucuaagaauuuaugaagacauggugcuccacgcagaagaccaacuccccgaagaaauugacgccauacugaagaaauucaauaguucuaaaguaccaacaaaaucugaguuucuucguuacaaacuauggcucgaacaaaaauacagaagucccuauacgggagaacugauaccauuaggcaaacuauucacggcagcuuaugaaaucgaacacguaaucccacaaucaagauauuuugaugacuccuuuucaaauaaagucauuugugagagugcuguuaacaaauuaaaagauaaucaguugggauaugaauuuauuaaaaaucaccacggacaaaaaguagaaguaggauucggaaaaaguguugaaauauucuccgucgacucauacgaaagguuugucaaagagcaauaugcaaaaagcgcaguaaaaaugaagaaaauguuaauggacgauauaccagagcaauuuauagaaagacaacuaaaugacucuagauauauaagcaaaguuauuaaagguuuacuuaguaauauagucagggagaaaaaugauagcggcgaauaugaaccggaagcaguaaguaaaaacauaguuguguguaccggaagcgugacugauaggcugaaaagagauuggggaaugaaugaugucuggaacaguauaguuuauccccgguucgagcgauuaaauagccugacagacacacagagcuucggucauugggaaaacaaaucuggcaagaaaguuuuucaaacagagcuaccucucgaauaucaaaaaggcuuuagcaaaaagagaauagaucacagacaucacgcaauggaugccaucguuauagcaugcgcaacacgcaaucacguaaacuaccucagcaacgaaucagcaucaaggaaugccaagauaagccgauacgaccuccaaagacuauuaugugauaaaucaaggaccgaugacaacgguaauuauaaaugggucauuaagaaaccaugggauaccuucacacaagaugcuagagaaguacucucgaaaauuguagugagcuugaaacaaaaccuaagaaucauaaacaaaacaacaaacguauauagacauuuggaugccacaggaaacagaguuuaugaaaaacagaaaacuggugauagcugggccauaagaaaaccgaugcacaaagauacagucuucggcgcagucaacuuaagaaaaguaaaaguaguaagauugagcguagcacuagaugcaccaacaaugauuguagauaaacgagucaaaaauaaaguauucgaacuauuaaguuauaaauacgauaagaaacguauugaaaaauacuucaaagaaaaugcuguuuuauggaaagaacuggaccuagccagaguagcaguauauuauuucacugaggcaacuaccgaaccuuugguagcuguccggaaaccacuggacagcacauuuaaugaaaagaaaaucaaagagagcguaacagauacaggcauacagaaaauauuacucaaucaucuuugcacaaaagaaggaaaaccggaccuugcauuuucagcagaagggauugaagaaaugaauagaaaccuucuucaacuuaauaauggaaaacgacaccaacccaucuauaaaguaagaguuuaugaacccagagguaauaaauucaguguagggguauugggaaacaaaggaacaaaauggguggaagcggcuaaaggcacaaauuuguucuuugcgauauacauuacggaggacggaaaacgaacauaugaaacaauaccucuaaacaugguaauagagagagagaaacaaggucuagcaccaguaccagauaaaaaugaaaaaggagauaaauuacuuuucuggcuaagcccgaacgaucuagucuaccuuccaacagaagaagaacuugaguucgggagaauaaaugaaccaauagaccgaggaagaaucuauaaaaugguaucuucuucaggaaaucaaugcuucuuuauaccacaaagcauaucaaacgcgauaauuccgacaaaagaacuaggagcuaacaauaaagcagaaagguccugggacggagccaugaucaaaaauauauguauaccugucaaagucgauagauuaggacgaauuauagaagugaaauaucgaauaaacgaauga

SEQ ID NO: 5745 - RNA, 4530 nt, Artificial Sequence
  Cas9 variant
augaaaacuauauuaggacuagacuuagggacuaacucagucgggugggccgucauuaacuccgugauaaaagaacaagcggaacgcauauggauagagauggcaggcaguagaauuauaccaauggaugcagcaguauugggagauuucgacaaagggaacuccauaucucaaacgucagaacggacuagacugaggggugcccgucgccuacgagaaagacaacuacuaagacgagaaagauuacacaaaguuuuaaacauacuuggauuccuaccaaaccauuaccuagaauauauagacuuugaaaaacaucccggaaaauuccuagcagaugcagaaccuaaacuagcuuggguaaaagaugaacaaggaaaauacaccuucuuguuccaagcagcuuuugaugaaauguuagcagacuuugcaauucaucaaccuaguuuaguaucaggagauaagaaaauaccauacgauuggacaauauacuauuuacguaagaaagcauuaaccgaaaugaucuccaaagaggaguuagcuuggauccuacuaaacuuuaaucaaaaacguggauacuaucaauugagaggugaagaagaagaagauaacgcgggaaaaucgguggaauuuuaugcacugaaaguuuuaaccguagaggccaccgaugagaagaaagggcgcgacguuugguauaauguucaccuagagaacggauggauauauagacguucaucaaguguaccccuggauugggaagggcaaguuaaagaguuuaucguaaccacagaucugaacccagauggaaccccgaaacucgauaaauacggagaagucaaaagaaguuucagagcuccaaaagaagaugauuggauguuaaucaagaaacgaacagaagcagacauagcaaacacacacaaaacaguaggugcauauauauaugacacauuguugcagaaaccacaacagaaaaucauuggcaaguuaguuaaaacaguugaaagaaaauuauauagggaugaacuaucguuaauacuccaaaaacaaugcgcuuuccaugcugaauuacaagauagagcucuguacgcacgaugcguugaagcauuguaccccaguaacgaaguaagaaggaaaaauauagcaaacagagauuuuguauaucuccuuauggaugacauuuuauucuaucaaagacccuuaaaaacaaagaaaaguuuaauagcaaacugcccauacgaagaaaaugaauacguagacagagagacaggagaaaucaagaaaaccccauuaaaauguauagcaaaaagccacccccuauuccaagaauuuaggcuauggaauuuucuuagcaacauaagaauauaucaaaaagaaaaagaaaucaacggaacacugcaccuagacgucgacgucacagcagaauuuuugaaaacagaagaugauuauguagccuuguucgacuggcuuaauuccagaaaagaaauugaacagaaaacauuccucaaauacccuaaauucggacucaagaaagaaaucucaaauuaucguuggaauuacguagaggauaaacaauauccaugcaaugaaacacgacaugcgauacuaucaagccuugaaaaagcaaacguauguauagacuuccuaucuaacgaaaaagaagucgcacuauggcacauacuguacagugucagcgacaaacaagaaauagaaaaagcacuucgaacauuugccgcuaaaaacggguuagaugaaucguucguugaagcauuuaagaaauucccuccauuuaaaucagaauauggggcauacagcgcaaaagcaaucaagaaaauguugccucuaaugcguuguggcaaauauugggacguauccucuaucgaugauaccacaaaagaaagaauuaagaaaauaguaacgggagaauacgacgagaggauaucagucaaaguucgagauaaaguaaugaaucuaucugacaucaguuguuuccgaagauugccauuauggcuggccugcuauauuguguauaaucgacauucagaagauaaagaagccguaaaaugggaaucuccugccgauauagacgcauauuuagcaucauuuaaacaacacucacuccguaacccaaucguagagcaagucauuaccgaaacucuacguguagugagagacauauggaaacaaguaggaagaauagaugagauucacauagaacuaggcagagaaaugaaaaauccugcagauaaacgaaaaagaaugacagcacaaauucuagaaaacgaaaaugcaaaucuuagaaucaaagcauuacuagcugaauuuaugaauccagaguacgaaauugagaaugugagaccauauucuccaucgcaacaagaaauacucagaauuuacgaagacacuguauuacacgcagaagaucaacugccggaagaaauagaugcuauucuaaagaaauuuaauagcucaaaaguaccaaccaaaucagaauuucuaagauacaaauuauggcuagaacaaaaauauagauccccauauaccggagaacucauuccauuggggaaauuguuuacugcggcauaugaaaucgaacacgucauuccgcaaucccguuauuuugacgacucauuuaguaauaaaguaauaugugaaucagcaguaaauaaauuaaaagacaaccaauugggauacgaauuuaucaaaaaccaucauggacaaaaaguugaaguagguuuugguaaaaguguagaaauauuuagugucgauucauaugaaagauucguuaaagaacaauaugcaaaaucagccgugaaaaugaagaaauuacuaauggaugacauaccugaacaguucauagaacgacaacuaaacgacaguagauacauuaguaaaguaaucaaaggacuacucaguaauauaguuagagagaaaaaugacagcggagaauaugaaccagaagcuguuucaaagaauaucgucguauguacgggaagcgucacugauagacuaaaaagagauugggggaugaaugauguuuggaacucaauuguauacccaagguuugagcgacuuaauucucugacagauacucaaucauuuggacauugggagaacaaauccggaaagaaaguauuucaaacugaguuaccacuugaauaccaaaaaggauuuagcaagaaacgaauagaccacaggcaucacgcaauggacgcaaucguuauagcaugcgcaaccagaaaucauguaaacuaucuaucuaacgaaucugcaagucgaaacgcaaaaauaagcagauaugaucugcaaaggcuacuaugugacaaaaaccguacagaugacaauggaaacuauaaauggguuauaaagaaaccaugggauacauucacucaagacgcaagagagguauugucaaaaauaguagucucucugaaacaaaacuuaagaaucauuaacaaaacaacaaauguauauagacaccuugaugcgacuggaaacagaguguaugaaaaacagaaaacaggggauagcugggcuauucgaaaacccaugcauaaagauacaguauuuggggcaguaaacuuacgaaaagucaaaguaguaagacugucaguagcuuuagacacgccagcgaugauaguagacaaaagagucaaaaauaaaguuuucgaauuauuaucauauaaauaugacaagaaaagaaucgaaaaauacuuuaaagaaaacgcuuucuuauggaaagaauuagacuuagcaaaaguagcuguauauuacuuuacugaagcaacaacugagccucuaguagcaguaagaaaaccacuagauaguacguuuaaugaaaagaaaaucaaagaaaguguaacagauacagggauccagaaaauacucuuaaaccaucuuugcaccaaagaaggaaaaccggacuuagccuuuagcgcagaagggauagaagaaaugaacaggaaucuucugcaacuaaauaauggcaaaagucaucaacccauauauaaaguacggguuuaugagccuagaggaaauaaauucucuguuggugucuugggaaacaaagggacuaaauggguugaagcugccaaagggacuaaccuauucuuugcuauuuauauaacagaagacggaaaaaggacauacgagacuauaccauuaaauguuguaauagaacgagaaaaacaaggccuaguccccguacccgaccguaauaagaaaggggauaaacuauuauuuuggcuuagcccaaacgaucuaguauauuuaccaacggaagaagaacgagaauuuggaaggauuaacgaaccgauugaucgaggacgaauauauaaaaugguauccuguaccgguaacgaaggacacuuuauaccagccaauguagcuaaucccaucguuccuguaauugaacuaggcaguaacaauaaagcacaacgagcauggacaaacgaaaugauuaaagacauaugcauaccgauaaaagucgaucgauuaggacacauuauagaaguuaaguauagaaucgacgaauga

SEQ ID NO: 5746 - RNA, 4530 nt, Artificial Sequence
  Cas9 variant
augaaaaaaauuuuaggacuagaccucggcacaaauucaguaggaugggcaguuauaaacucagucguaaacgacgaaggaaaagaacaguuaguuaacauaaguaguugcggaaguagaauuauaccaauggacgccgcaacacuuggugacuuugacaaaggcaacucuaaauccccagucgcugaaagaacuaggcucagaggcguucgaagacuacuugaaagaucuuuacuaagacgcgaaagacugcauaggguacuaaguguaauggguuuccucccagaacauuacgcugcucaauuggaccgauauggaaaauuccuuccagaaacagaaccgaaauuagcaugguacaaggacgaaacuggcaaguauagauuuuuauuucaagauucauuuaacgagaugcuugaagauuuccacgagcaucauccagaauuagucgcagaaggaaaaaagauacacuaugacuggacaauuuauuauuuacgaaaaaaagcgcuaagucaaaaaauaacuaaagaagaauuagcguggauacuacuaaauuucaaucaaaaaagaggguacuaccagcuacgaggggaagaagagcaagaggauaacaaaaaaagugucgaauauuaugcauuaaaagugguagcaguagaagacuccggagauagaaaaggcaaagacauaugguauaacguaaaauuggagaaugguuggguauacagacgggcuucuggagucccauuagacuggguuggaaaaguuaaagaauucauuguaacaacugaccucgaugaaaagggcaauccaaaaaaagacaaagacgguaacguaaagcgaucauucagggcaccaaaagaagaugauugggggcuacuuaaaacgagaacacaagcacaaauagacgaaagcggacaaacgguagguacauacauauaugaaagccuauugaggaugccagaccaaaagauucgcggaaaauuaguaaggaccauagagcggaaauauuacaaagaugaacuaagaaaaauauuaauaaaacaaucagaauuccacacugcguuacaggaucacaauuuauuauuagcuugcauugaagaacuauacccaaauaacgaagcacauagaaggcuguuaaguacaagugauuucacauauuuuuuaguagaagauauuuuauucuaccaaaggccacuaaaaucccaaaaaggucaaauagaugacugcccuuacgaaagucauguauauagagacaagaaagauggauccuuacaacacguacccuuaaagugcguaucaaaaagucacccacucuuucaggaauuccguuuauggcauuuucucaguuuccuucgcauauaccaaagggaaaggaugaucgauggcucacuaaaauuagauguagauguaacaaacgaguuucuccaaaaugaagacgauuaugucaaacuuuuugacugguuaaacgaaaggaaagaaauagaucaaaaaacuauuuuagccuacaaacccuuuggccuuaaaaaaaaugaacaaucaaaguauagauggaauuauguagaagacaagucauacccaugcaauucuacacgggcagacaugaucuucagacuaagcaaagccggaguaccagaggaauucuuaacaagagaaaaagaagaggcacuauggcauauccucuauucuaucagcgacaaaaaagaacuaaccaaagcuuuaggaacuuuugcugaaaaaaauggccucaacgagacauucgucgaaaucuucagcaaaaugccccccuucgaaagcgauuacgcugcauauucccuaaaggcaauacgcaaauuacucgcauugaugcguaugggaaaauacugggacgaacaagcuauagacgaacauacaaggaguaggauagaaaaaauauuaaccggagaauacgacgaaacaauaagaacgaggguccgagaaaaagcaaugcaucuaacagacauuucuucauuccggggucuaccguuauggcuagcauguuauguuguauacgauagacauucagaagcuaaagaauuaguuaaaugggaaacuccagacgauaucgaucacuuccugaggaaauucaaacaacauagccugaggaacccaauuguagaacaaauaauuauggaaacauuaagaacaguacgagauauuuggaagcaagaaggaaaaauugacgaaauacauguugagcuaggacgugaaaugaaaaacccugcaaaggaaagagcgcgcauaacagcacagguauuagaaaaugaaaacacgaacuuaagaauaaaagcauuacuugccgaauuuaugaaucccgaauucgaaauagaaaaugucagaccauauaguccagcccaacaagagauacuccgaauauaugaagaaggaguacugucaggaguagcagaaaaagaccuaccagaugauauagcaucaauuuugaagaaguuuagagaaaacgauguaaaaaaaaggccaaccacaucagaaguucucagguauaaauuaugguuagaacaaagauauagaagcccauacacagggagaauaauaccacuagguaaacuguuuacacccgcauacgaaauagaacacgucaucccccaaucacguuacuucgaugacucuuucaccaacaaaguuauuugcgaaucagcaguaaacaaauuaaaagauaauugccuaggauacgaauuuguaaaaaaacacucaggcgaaaaaguagaacuuggcaacggggagacagcuacaauuuucuccguugaagaauaugaaagauucguaaaagacucauauuucaacaacucaaaaaaaauaaagaaacuacuauuagaagacauuccagacaauuuuauugaacgccagcuuaacgacaguagguauauaucaaaagucguuaaaagcuuauuaucaaacauuguaugugaagaaggggaacaggaaggaaugaguaaaaacguaauaguuugcacaggcggaguaacagacaggcucaaaaaagauuggggaguacaagauguauggaacagaauaauuuuaccacguuuucuuagacuaaacaaaaugacagacagaacagacuucacggcaguaucuaccaauggucaccuucucccagcgguaccuuugcauuuacaaaaaggguucaauaaaaaacguauagaccaucgacaucaugcaauggacgcaauaguaaucgcuugugcaggccgaaacaucguaaauuaucuuaacaaugcgucggcgagaaaggguucugaaaucucgcguuacgaucuacaacaucucuuaugugauaaaguaaagacagacgcaaauggcaauuauaaauggauauuaagaaaacccugggaaacuuuuacacaagacuuauaugcagcacuaacgaacauugucguauccuuuaaacaaaaccugcggguaauaaaucgaacaacgaaucauuaccaacauuauaacgaagauggagaaaaaaaaaugaucccgcaaacaaaaggagacagacucgcaauacgcaaaccaaugcauaaggauaccguauauggagaaguaaauuugagaaaagaaaaaaccuuaccacugaaagauguagugaaaaaccccucagcaguuguagacaaaucccuaaaaaauaaacuauaugaauuauuaaaaucgcaauaugaucuaaaggcaauaacuaaauacuucgaaacacaucaggaugugugggcagauguaaacuuaaaaaaaauaaaaguuuacuacuucaccaaagaaacuaacgaaagauuuuucgcaacaagaaaaucauuagauaguaguuucucacaaaaaaaaauugaagaagaaguuacagauacaggaauacaaaaaauuuuguuacgacaucuccagcaaaacgggaacaacccugacaucgcauucucuccagacggaguagaacguaugaaccaaaacaugacaauacuaaaugacggcaaauggcaucaaccaauauauaaagucagaacauaugaaaaggcagauaaauuugccguaggagagaaagggaauaaagugaaaaaauuuguagaggcugccaaaggaacuaaucucuuuuucgcagucuacgaaaguauacaagaagaugaagcgacaggcaaacaaguaaggaaaagaacauuugcaacaaucccauuaaacgaggucaucaagagaaaaaaacaaggcuugcccgcagcgccggaggacagcaaagguaauuuaccaauauuuguucuaucuccaaaugaucugguguaccuaccgacagaggaagaaaggaauucgggaaaaauaauccaaccauuagacagagagcgaauauacaaaaugguaucuugcacagaaggcgagugucauuguauaccugaauacguggcaaauccaauauuacaaacaauugaacuuggcucuaauaacaaggcacaaagagcuuggucaggugagaugauaaaagaaauauguguacccguuaagguggaccgucuugguaacguaucacuaauaaaaauauga

SEQ ID NO: 5747 - RNA, 4530 nt, Artificial Sequence
  Cas9 variant
augaaaacaauacugggacuagaucuaggaacaaauagugucgguugggcagucauaaacucuguaaucaaagaacaagccgaacgaauauggauugaaacagcagguagucggauuauacccauggaugcagcaguacugggggacuucgacaaaggaaauagcauaucucaaacaucagaacggaccagauuaagaggagcaagacgccuuagggagagacaauuauuaaggagggaaagacuacacaaagucuuaaacauccuaggcuuccuucccaaucauuaucucgaauacauagacuucgaaaaacacccaggaaaguuuuuagcggaugcagaaccaaaacuagcguggguaaaagacgaacaaggaaaauauacauuuuuauuucaagcggcguucgacgaaaugcuagccgacuuugccauacaccaacccagcuuaguuagcggugacaagaaaauaccauacgauuggacuauuuauuaccuucgcaaaaaggcccuaacagaaaugauaucaaaggaagaauuagcauggauauuacuaaauuuuaaccaaaaacgaggcuauuaccaauuacgaggugaagaagaagaagacaacgcagguaaaucaguugaauuuuaugcuuuaaaaguucuaacagucgaagcaaccgaugaaaagaaagguagagauguuugguauaauguccacuuagaaaacgguuggauauaucgacgaagcucgaguguaccacuggauugggagggccaagucaaagaauuuauuguuacaacagaucucaauccugacggcacaccaaaauuagacaaauacggagaggucaagcgaucauucagagcaccaaaagaagaugauuggaugcuuauaaagaaaagaacagaagcugacauugccaacacacacaaaacaguaggugcauacauauaugacacacuacugcaaaaaccgcaacaaaagauuauugguaaacucguaaaaacaguagaaagaaaacuauacagagaugaacucagucucauucuccaaaaacaaugcgcguuucacgcagaacuccaagauagagcacucuacgcaagauguguggaagcacuuuacccaucaaaugaaguaagacgaaagaauauagccaacagagacuuuguauaccuauuaauggacgacauacucuuuuaucaaagaccacuuaaaacaaagaaaagccucauagcaaauugcccguaugaagaaaaugaauacgucgaucgagagacuggagaaauaaagaaagccccuuuaaaauguaucgcaaaaagccacccucucuuucaagaauuuagacuuuggaacuuuuuaaguaauauaagaauauaucaaaaagaaaaagaaauaaauggaacgcuacauuuagauguagacguuacugcagaguucuuaaaaacagaagaugauuacguggcacuauuugacuggcuaaacagccgcaaagaaauugaacagaaaacguuucuaaaguauccuaaauuuggccuuaagaaagaaaucucaaacuauagauggaacuauguugaggacaaacaauacccauguaaugaaacaagacaugcuauauuaucaucauuagaaaaagcaaacguuuguauugacuuuuugaguaaugagaaagaaguugcacucuggcauauccucuauucaguuucugauaaacaagagauugaaaaagcauuacguacauucgcagccaaaaacggacuagaugaaucuuuuguagaagcauuuaagaaauucccaccauuuaaaagcgaguacggggcauauagcgcuaaagcaauaaagaaaaugcuuccauuaaugagaugcggaaaauacugggauguuucaagcaucgaugacacaacuaaagagagaaucaagaaaauaguuacaggagaauaugacgaaagaauagcagucaaaguccgagacaaaguaaugaacuuaagugauauaucgugcuuuagaagauuaccuuuauggcuagcuugcuacauaguuuauaacagacacucugaagauaaagaagcuguaaaaugggaaucccccgcggacaucgacgcauaucuagcuucuuuuaaacaacauucgcugagaaacccaaucguagaacaagugaucacugaaacuuuacgaguaguacgggauauauggaaacaaguaggaagaauugaugaaauacauauagaauuagguagagaaaugaaaaaucccgccgauaaaaggaaacgcaugacagcacaaauccucgaaaacgagaaugcaaauuuacgaauaaaagccuuacuagcagaguucaugaauccugaauaugaaauagaaaauguaagacccuauagcccaucucaacaagaaauuuuaagaauauacgaagacacgguacuacacgccgaagaucaauuaccugaagaaauagacgcaauauuaaagaaauuuaauaguucaaaaguaccuacaaaaagugaguuucuaagauauaaacuaugguuagaacaaaaauaucgaagcccauauacgggagaacuuauaccuuuaggcaaacuuuuuacugcagcauacgaaauagagcacgucauaccacaaucgagauauuucgaugauucauuuaguaauaaaguaauaugcgagucugcaguaaacaaacuaaaagauaaucaacuaggguaugaauuuaucaaaaaccaccacggacaaaaaguugaaguaggauuuggaaaaagcgucgaaauauuuuccguggauucauaugaacguuucguuaaagaacaauaugcuaaaucagcagucaaaaugaagaaauugcuuauggaugacauccccgaacaauuuauagaaagacaauuaaacgauucaagguauauuuccaaaguuauuaaaggauuacuaagcaauauaguccgagagaaaaacgauuccggagaauaugaaccagaagcgguuagcaaaaacaucguuguaugcaccggaucugucacugacagauuaaaaagagauuggggaaugaacgauguauggaauaguauagucuauccgagauuugaacgauuaaauucccuaacagauacacaauccuuuggccauugggaaaauaaaucaggaaagaaaguuuuucaaacagaauuaccuuuagaauaccaaaaagguuucuccaagaaacguauagaucauagacaccaugccauggaugcaauaguaaucgcaugcgcaacaaggaaccacgucaauuacuuaucuaaugagagugcaaguagaaaugcaaaaauaucuagauaugacuugcaaagauuauugugcgacaaaaaccgaaccgacgacaacgguaacuauaaauggguuauaaagaaaccaugggauacuuuuacccaagacgcucgcgaaguguuaucaaaaauaguagucucacugaaacaaaaccugcgaauaauuaauaaaacaacuaaugucuaucgccauuucgaugcaacuguuaacagaguauaugaaaaacagaaaacaggagauucaugggcaauaagaaaacccaugcacaaagacacaguguucggcgcagucaaccuaagaaaagucaaaguaguacgucuaucuguagcccuugacacaccagcaaugauaguugacaaaagagugaaaaauaaaguauucgaauuauugucauacaaauaugauaagaaaaggaucgaaaaauauuuuaaagaaaaugcauuucucuggaaagaacuagauuuagccaaaguagcaguauauuauuuuacggaagccacuacggaaccccuugucgccgucagaaaaccccuugacaguacguucaacgaaaagaaaauaaaagaaucagucacagauacuggcauucagaaaauauuacuaaaucacuuauguacuaaagaaggaaaaccagauuuagcauucucugcggagggaaucgaagaaaugaaccgaaaucucuuacaacugaacaaugguaaaagccaccaaccaauuuauaaagugaggguuuacgaaccgcgaggaaacaaauuuucagucggcgucuuagguaauaaaggcacaaaauggguagaagcagcaaaaggaacaaacuuauucuucgcuauauacauaaccgaggauggaaaaagaacguacgagaccauuccacugaauguaguuauagaaagggaaaaacaaggcuuaguaccaguaccagauagaaaugagaaaggggauaaacuuuuauucugguuaucaccuaacgaccuugucuaucuaccaacagaggaagaacgggaauuuggaagaauaaacgaacccauagauagaggaagaauauauaaaaugguaaguugcaccgguaaugaaggacauuuuauuccugcaaauguggcgaauccaauaguaccaguaauagagcuugguucaaacaacaaagcacaaagagcauggaccaaugagaugauuaaggacauaugcauacccauuaaaguagaucgguuaggccacaucauagaagugaaguauagaauugaugaguga

SEQ ID NO: 5748 - RNA, 4530 nt, Artificial Sequence
  Cas9 variant
augaaaaaaacacucggauuagauuuaggcacaaauaguaucggaugggcaguaauaaauagcaacauagacucagaagguaaggaaaaguuaguaggaauaucaaguugcgguaguagaauaauaccuauggaugcaacaacacucggagauuucggaaagggcaauacaaaaucacccguggcagaacgaacaagauuaagaggaauuaggcgacuuuuggaacggagccuccucagacgggaacgccuacacaggguucuaucagugaugggauuucuaccggaacacuacgcgucucaacuagacagguaugguaaauuuuuaccugagacagagcccaaacuagcaugguauaaagacgacucaggaagguaccaauuccuauuccaaaaaagcuuucacgagaugcuugaagacuuccgucaacaucaacccgagcuugucgcuggcgaaaaaaaaauucccuaugauuggacaauauauuaucuuagaaaaaaagcucugucgcaagaaauuacuaaagaagaauuggcuuggauucuauuaaauuucaaucaaaaaagaggguacuaucaauuaaggggagaagaggaacaagaagaaaacaauaaaucgguagaguaccaugcguugaaagugguaucuguagaagauucgggugaacgaaaaggaaaagauauaugguauaauguaacauuagaaaacggauggguguauagacgagcuaguaacauaccauuagacuggacugggaagguaaaagaauucguagucaccacagaacuggaugacgccgggaacccaaaaaaagauaaagaaggaaacguaaaaagaucauuuagagcuccuaaagaagacgacugggggcucuuaaaaacacgaacucaagcgcaaauagaugaaucuggaaaaacaguaggaacauauauauacgaaagcuuauuaugcaugccaaaccaaaaaauaagaggaaaauuaguacgcacaaucgaacggaaauacuacaaagacgaacuuaggcaaauauuagugaaacaauccgaauuucaugccgcccuacaggaucacaacuuauuauuaucauguauagaagaacuuuauccaaacaacgaagcucaucgacgucucuuaagugcaagcucuuuuauauauuuccugauugaagacaucuuauucuaccaacgcccacuuaaaucccaaaaagggcuaaucgacaauugcccauacgaaagccauauauacaaagacaaaaaagaugguucauuacaucacguaccacugaaauguguaagcaaaagccauccccuauuccaagaauuuagauuauggcaauuucuaucgaauuuacgaauauaucaacgagagaggaugauggauggaucacuaaaauuagaugucgacgucacccgugaauuccuuccauccgaggaagacuauguaaaacuuuuugauuggcuuaacgaacguaaagaaauuucacaaaaguucuuauuagcauauaaacccuuuggacuaaaaaaaaacgaacaagcaaacuacagguggaauuacgucgaagacaaauccuauccuuguaaugaaacgagagcggaaauuaaaaguagacucaguaaagccgggguaccggaagaauucuuaacagaagaaaaggaagaagcccuauggcacaucuuauauucuauaucagauaaaaaagaacuaacuaaagcacuagggacauuugccgcaaaaaacugucuuaacgaauccuucguagaaguuuuugcaaaaauaccuccauuugaguccaacuacgcggcauauaguuuaaaagcaauaagaaaacugcucgcguuaaugagaauggguaaauacuggaacgagcaagcaaucgaucgacaaacaagagauagaaucgaaaaaauacuaaccggagaauacgacgaaacgauaagaaguaggguuagagaaaaagcaaugcuauugacagacauaucuagcuucagaggauuaccucuaugguuagcuugcuacauaguauacgacaggcacucagaauccaaagaacuaguaaaaugggaaaccccggcggauauugaucacuuccuuaguaaguuuaaacaaaacucauuaagaaacccaauuguugaacaaguuauaacagagucguugcgaacugugagagacauauggaaacaagaagggaagauagacgaaauccacguagaacucggaagagaaaugaagaauccagccaaagaacgugcgcgaauaacagcccaaguacaagaaaaugaaaauacuaaucuucguauaaaggcacuacuagcagaauucaugaauccagaauuugaaauagaaaauguccacccuuauagcccuggacaacaagaaauacuaagaauauacgaagauggaguacucucgggaaucgcugagaaagaccugcccgaugacauuacagcaauuuuaaaaaaguucagagagaaugauguaaaaaaacgacccacaacuucugaaguacuucgcuacaaacuauggcuagaacaaagauaucguaguccauacacgggcagaguaauaccguuggguaaauuauuuacuccagcauacgaaauugaacacguaaucccccagucccgcuauuucgacgacucuauuucgaacaaaguuauaugcgaaagcgcaguuaauaaacugaaggauaauuguuuaggauaugaguuuauaaaaaaacauaguggagaaaugguggaacugggaaacggagagaccguuccgguauuuucagucgaagaauaugaaagauucguuaaagaaagcuauuucggaaauagcaaaaaaaugaaaaaauuacuacuagaagacaucccugauucauucaucgaaaggcaauugaaugauaguagauauauaucaagaguaguaaccucacuucuaucuaauuuagugugugaagaaggagaacaagauggacuuuccaaaaacguuauuguaugcacuggcggaaucaccgauagacucaaaaaagacuggggaguacaagagguuuggaacagaauuauauuaccacgauuccuccgacuuaaugaaauuaccggaaggacagauuuuacaaguacaagugucaauggccaucuacuaccugcucucccacucuaccuucaaaaagguuuuaauaaaaaaagaauagaccauagacaucaugccauggacgcgaucguaauugcaugcgccaacaggaauaucgucaauuauuuaaauaacaguagcgcgaggaaaaacucagagauuucacguuaugaucuacaacgauuguuaugcgaaaaaguaaagacugacgcaaacggaaauuacaaauggauccuaaggaaaccaugggaaacauuuacacaagacguauaugcagcucuuacgaacauaguaguaucauuuaaacaaaacuuaagagugauaaaucguacaaccaauuacuaccaacacuacaaugaagcaggagaaaaacguaugauaccucaaacaaaaggagacagaugggcuaucagaaaaccaaugcacaaagauacagucuauggcgaaguuaaccuccgaaaggaaaagacacuaccacuacgagauguaguaaaaaacccaagcauaguagucgacaaaagucuaaagaacaaauuauacgaacuccuuaaaucccaauaugacuugaaagccaucgccaaauauuucgagacucaccaagacguaugggccgacguuaaucuuaaaaaaauaaaaguauacuauuuuacaaaagaaacaaaugagagauucuuugcaacgagaaaaaguuuagaccccaguuucgaucaaaaaaaaaucgaagaagaggugacagauacuggcguacaaaagauacuacuacaucaccuacaacaaaauaauaaugaccccgacauggcauucaguccagaugggaucgauagaaugaaucaaaacaugacaauccuaaacgauggcaaguggcaccaaccuauauacaaaguaaggacuuacgaaaaagcagacaaauucgccgucggugaaagcggaaauaaagcgaagaaauuuguagaagcugcaaaaggcaccaacuuauuuuuugcaguauacgaaucaguacaagaagaugaagcuauugguaaacaaguauguaaacguacauucgcaacaauaccguuaaacgaaguaauaaaacguaagaaacagggauugccugcugcccccgaagauuuaaauggaaaucuaccaaaauuuguauugucaccgaacgaccuaguuuaccuaccgacggaggaagaaagaaauucaaguaggaucauacaaccauuagaccgagaaagaauuuauaaaaugguaaguucuaguggcucgcaauguuucuuuauaaaaguauucguagcaaacucaaucugggauaaaaaugaauacaguaguuuaaacaaaauggaaagagcaauuacaaaugaaaugauaaaagaaauuugcguuccuauaaaaauagacagguuaggaaaugucucucucauucaaauauga

SEQ ID NO: 5749 - RNA, 4533 nt, Artificial Sequence
  Cas9 variant
augaaaaggauacuaggauuggauuuagguacaaauucaauagggugggcauuaguagauagcgaagaacaaagaauauugggaaugggaaguagaauaauaccgauggaccaagguguguuagacacauucaguggagguaacccagucgagacacaaacagcugcccgaacuguauacagagguacaagacgguuacgcgaaagagcacuacuaaggcgugaacgccuaauuaggguacuaaauaugaugaaguucuuaccagaacacuaugcaucccaaauagacuucgagaagagacucggacaauucuucgacgagaaagagccgaaauuagcauggaaacagaacgacgaaggaagauuugaauuuauuuuccagcaaucguucaacgaaaugauagaagaauuuaaaaacaaaggcguagugagagaagacaagaaaauaccauacgacuggacuaucuacuaucucagaaagaaagcacuaagucaagaaauagaaaaagaagaguuagcauggauuuugcuaaacuuuaaccagaaaagaggauauuaucaacuacguggagaagaagaagaagaaaaucccaacaaacucgucgaauauuacagucuuaaaauaguugacguaauagcagacgaaaagccuaauaguaaauccgauauaugguauucauugcaccuugaaaacggcuggauuuacaggaggucgagcaaaauaccccucuuugguuggaaggauaaaaccagagacuucaucguaacaacggauuuaaaugaugauggcacaguaaagaaagauaaagaaggaauagaaaagcgcucguuucgagcacccagcgaaaaugacuggguucuauuaaagaagaaaacggaguccgacauagaaaaaucucacaagaccguaggggcauacguauacgaaacacuguuacaaaacccaaugcaaaaaguucgugggaagcuagucaggacaaucgaaagaaaauuuuacaaagacgaacuaaagcaaauuuuagaaaaacaacgugaauuucacccagaacugcgagaugaagacuuauacaaugacuguguaagagaacuuuauagaagcaacgaaacguaucaauuuauauugucuaaaagagacuucguacaucuauuucuagaugacauuuuauuuuaucaaagaccccugcggagucagaaaucagcaauaggagacuguauauuagaguucaagacauauaaagacaaagacgggaauaacauuaaagaauauuuaaaagucauuagcaaaucaaacccauuauaccaggaguucagaaucuggcaaugguuguauaaucucaaaauauauagaaaagaagaugaugaagaugugacucuacaauuuauagcaaauauugaagauaaagaacaacuauuugacuuuuuaucaaaucggaaaucaaucgaacaaaaaccuuugcuagaauaucucauaaaagccaagggccugaaaaagcaaguaaaaacugaggcuuauagauggaauuauguagaagauaaaauauauccaugcagcgaaacaaaaacuaugauaucaacucgauuagcuaaaguagaaaauaucccagauaauuucuuuacaaaagaaauagaacaaaaacuauggcauaucauauacucaguuacagauaaaaaugaauuugaaaaagcauuacguaccuucgcuaagaaauaugaucuagauauugccagcuucguagacaacuuuaagaaaaucccacccuuuaaaaacgaauacggaaguuucucugaaaaagccauaaagaaauuauuaccucuuaugagauuaggcaaauacuggaaauggaaugacauugauaacaauacgcaaaaucgcauaagcaaaauaauuaccggagaauaugaugaggaaaucaaagauauaguaagagagaaaaguauagcucuaacaaacgaaaaugacuuucaaggauuacaauuauggcuagcucaauaucuagucuaugguagacauucagaagcagauaucgcaggaaaauggcauucagucgcugaucuugaaaaauaucuaaacgaauuuaaacaacauucacuaaggaacccaaucguugaacaaauuauaacagaaacccuacgaguuguuagggacauauggaggaaauauggacaaggagcugaaaauuucuuuuccgaaauacacguugaacuuggaagagacaugaaaaauacagcagacgaacggaaaaagaucgugaacgucguaacagaaaacgaaaacacuaacuuacgaauaaaggcuuuacucauggaacugaaaaauaacuccgacgggaaauuagaaguugaaaacguuagaccauauucccccacacaacaagauauuuuaaaaauauaugaagaguacgcuauaucaacuggauuagauaaugaaaaagacgaaaaaguaaaagaagacauaaagaagaucagcaggguugcacaaccaacuacaaccgagcuacagcgauacaaauuaugguuagaacaaaaauauugcucuccauauacagggaaaguuauaccccuuggcaaacuauucacagaagaauaucagauagaacauauaauaccgaaaaguagauacuacgaugacaguuucucaaauaaagucauaugugaagcagcagucaauaaacuaaaagauaaaugcuuagggcucgaauuuauuaaaaauuaucacggacaaauaguagaaacgggauucggacaaaaaguaacuauauuugacgaagaagcauaccaaaauuucguuaaacaacauuaugcauauaaccacagcaaacgaacuaaauugcuauuagaagaaauaccagagaaaaugauagaaagacaaaugaaugacacuagauacauaagcaaauucgucuuacccuuacuuagcaauuuaguccgcgccaaagaaaaugauaauggugucaauaguaaaaacguguuaccaguaaacggaaaaauaacgaccauguuaaagcaagacuggggauuaaacgacguauggaacgaccuaauauuaccaagauuuguccguaugaaugaacuagcuaaaacaauagcguuuacgucauggaacgaacaacaccaaaaauacuugccaacaguaccucucgagcuuagcaaaggcuuccaaaagaaacguaucgaccacagacaucaugcaauggacgcacuggucaucgcgugugcaacccgagaucacguaaaccuucuaaacaauaaacaugcaaauacggacacuauaagauaugauuuacagagaaaacucagauuauuugagaggguaacauacauagauccacaaaccaaaaauaauguaaccaaagacaucccaaaagaguuuaagaagccaugggacaauuuuaccguagaugcacgcaacgaacuagaaaagauuauagugagcuucaaacaaaaccugagaauaauaaauaaggcaacuaacaucuacacaaaauacgagaauggaaagaaaauaaagguaggacaaaagggccucaauugggcaauccgcaagccacuacauaaagaaacaguauuugccaaagugagccuuagaaaaagaaagacaguuagauugagcgaagcauugaaagauuggaaaaagauaguggauaagaaacuuaaacaagagauaaaaagacucacuugccaauacggcaaguuugauguagacacaauauuaagauacuucaaggauaggaaauaccaguuuggggagguagacguaagcaagguaaaaauguauuauuuugacgaagaaaaugccgcuguaagaaagaacguugacacaucuuuuacugaaaaauucauacaggguucagucacagacaccgguauucagaaaaucuuacucaaucaccuagaagcaaaaggaaacaaaguagaaauagcauucucaccugaaggaauagaagaaaugaauaaaaauauaauacaauugaacgaaggaaaauuacauuuaccgauuuucaagguacgaguuuaugagaccauagguaacaaauucucaguagggguuaaaggaaauaagaaagacaaauacguagaagcagcaaaaggcacaaaccuuuucuucgcaaucuacguagacgaaaacgggauucgaucauaugagacgauaccucuaaacaucguuauagaacgccuuaaacaaggacuuagcguaguaccagagaaaaacaggaaagaacacucuuuauuauucuaccugagucccaaugacuuaguauauguaccuauugaagacgaaagagaaaacauccaugcugucaauuuagaucaauuaaacaaugaacaaagaaaacgaauauauaaaaugguuagcugcaccggaagugaaugccauuuugucccauauuacgucgcgagcccuaucgucaacaaaguagaauacaguagccuaaauaaaaucgggaggagucugacaggagaaaugauuaaagacgucugcaucaaguuaaaaguggauaggcuaggcaauauuaagggaauuaguggccuauga

SEQ ID NO: 5750 - RNA, 4533 nt, Artificial Sequence
  Cas9 variant
augaagagaauacuaggguuagaccugggcacaaacucaauaggaugggcgcuaguagauuccgaagaacaaaggauacuuggaaugggcucacgcauaauaccaauggaccaaggcgugcuagacacauuuucagguggcaacccugucgaaacucaaacagcugcacggaccgcauacagagguacucggagauugagagaaagagcuuuauuaagaagagaaagacuaauucgaguccuuaauaugaugaaguuccuaccugaacacuacgcaucgcaaauugacuucgaaaaacgucuaggacaauucuuugacgaaaaggagcccaaacucgcauggaaacaaaaugaugaagggagguuugaguucauuuuccaacagagcuuuaaugaaaugauagaagaauuuaaaaauaaaggcgugguaagagaagauaagaaaaucccuuacgauuggacuauauauuacuuacgaaagaaagcccuuagccaagaaauagagaaagaagaacucgcauggauauuacuaaauuuuaaccaaaaacgaggcuacuaucaacuuagaggcgaagaagaagaagaaaauccaaauaaauuagucgaauauuauagcuuaaaaauaguggauguuauagccgacgaaaaaccaaacucaaaaggagacauuugguacagucuccauuuagaaaauggcuggauuuaccgucgcucaucaaagauaccucuguuuggguggaaagauaaaacaagggacuuuauaguaacaaccgaccucaaugaugauggaacggugaaaaaggauaaagagggcauagaaaaacgaaguuuuagagccccauccgaaaacgacuggguacuacuuaaaaagaaaaccgaauccgacaucgaaaaaucgcacaaaacagugggagcauacgucuacgaaacgcuauuacaaaaucccaugcaaaaaguuagaggcaaauuaguaagaacuauagaacgaaaauuuuauaaagacgaauuaaaacaaauucuagaaaaacaaagagaauuucauccagaacuacgggacgaggaucuauacaacgauugcgugcgggaacuguacagaagcaacgaaacuuaucaguucauacuuucaaaaagggacuucguacaccuauuuuuagaugacauacucuuuuaccaaagaccacuaagaucucaaaaauccgcgauuggagauuguauccucgaguucaaaacauauaaagacaaagacggcaacaauauaaaagaauauuuaaaaguaauaucaaaaucaaauccgcucuaccaggaguuccguauuuggcaauggcuuuacaaucuaaagauuuacagaaaggaagaugaugaagacguaacacuacaauucaucgcaaacauagaagauaaagaacaauuauucgauuucuuaucaaaucgaaagucuauugaacaaaaaccucucuuagaauaccucauaaaagccaaaggauuaaagaaacaagucaaaacagaagcauacagauggaacuacgucgaagacaagauauacccauguucagaaacuaagacgaugauaagcaccagauuagcuaaaguagaaaacauaccagauaauuucuuuacgaaagaaauugaacaaaaauuauggcacauaauauauuccguaaccgacaaaaaugaauuugaaaaagcauuaagaacauucgcaaagaaauaugaucucgacauagccaguuuuguagacaauuucaagaaaauaccaccauuuaaaaaugaauacggauccuuuucagaaaaagcgaucaagaaauuacuaccccuaaugcgucuaggaaaauacuggaaauggaaugacauugauaauaauacccaaaacagaauaucaaaaauaauaacaggagaauaugaugaagaaauaaaagacauuguacgagagaaaaguauugcguuaacaaacgaaaacgauuuucaagguuuacaacuauggcuugcacaauaccuaguuuaugguagacacagugaagcagauauugcggguaaauggcauagcguagccgaccucgaaaaauacuuaaaugaguucaaacagcauagccugcgaaauccuaucguugaacaaauaaucacggaaacguuacgaguuguacgggauauauggagaaaauacggacaaggagcagaaaacuucuuuagugaaauccacgucgaacuuggaagagauaugaaaaauacagcagaugaaagaaagaaaaucgugaacguagugaccgagaaugagaacacuaacuuacgcaucaaagcucuauuaauggagcuuaaaaacaauagcgacggaaaauuagaaguggaaaauguaaggcccuauucaccgacacaacaagauauacuaaaaaucuacgaagaauaugccauuucgacuggacuagacaaugaaaaggacgagaagguaaaagaagauauuaagaaaaucuccagaguagcgcaaccgacaacaacggaacuccaaagauauaaacuaugguuagaacaaaaauacuguucgccauacaccggaaaagucauaccucugggaaaauuauuuacagaagaauaucaaauugaacauauaauaccaaaaagucgcuauuacgacgauuccuucucaaauaaaguaauuugugaagcggccguaaacaaacuaaaagauaaauguuuaggacuagaguuuauuaaaaauuaccauggucaaauaguagaaacaggauucggacagaaagugaccauauucgacgaagaagcauaucaaaacuuuguuaaacaacacuacgcauauaauagaaguaaacguaccaaauugcuauuagaagagauaccggaaaagaugauagaaagacaaaugaacgauaccagauauauauccaaauucguacucccucuacuuucaaacuuaguacgagccgaagagaaugauaacggcguaaauagcaaaaacguccuaccaguuaauggaaaaauaaccacuaugcuaaaacaagauuggggccuaaaugauguguggaacgaucuaauucuuccucgcuuuguuaggaugaaugaacuagcaaaaacaauugcguucacaucauggaacgaacaacaucaaaaauacuuaccaacuguuccacuagaacucagcaaaggguuccaaaagaaaagaauagaucacagacaccacgcaauggaugcacuuguaaucgccugugcuacaagggaucacgucaaccuacuaaauaacaaacacgcaaacaccgacacaaucagauacgaccuacaacgcaaacucagacuauuugaaagaguaacauauauagauccacaaacgaaaaacaaugucaccaaagauaucccaaaagaauuuaagaaaccgugggauaacuuuacagucgacgcuaggaacgaacuagagaaaaucauagucucguuuaaacaaaaccuacgaaucaucaauaaagcaacaaauaucuacacaaaauacgaaaacggaaagaaaauaaaagugggacaaaaaggucuaaacugggcaauccgcaaaccccuucacaaggaaaccguguucgcaaaaguuagcuugcgaaaaagaaaaacaguaagguuaucagaagcccugaaagacuggaaaaagauaguagacaagaaacuaaaacaagaaauaaaaagauuaacaugccaauauggaaaauuugauguagauaccauauuaagauacuuuaaagauagaaaauaucaguucggagaaguagacguaucaaaaguuaaaauguauuacuucgaugaagagaacgcggcuguucggaaaaauguggacacuagcuucacagaaaaauucauacaagguaguguuacggacaccggaauacaaaagauucuauuaaaccacuuggaagcaaaaggaaacaaaguagaaauagcguucagcccagagggcauagaagagaugaauaaaaauauaauacaacuuaaugaagguaaacuacaucuucccauauucaagguaagaguauacgaaacaauaggaaacaaauucucgguaggaguaaaaggcaacaagaaagacaaauacguagaagcagcuaaagggacaaaccucuucuucgcaauauacgucgacgaaaacggaaucagauccuaugagacaauaccgcuaaauaucgucauagaaagacuaaaacaaggauuaucggucguaccugagaaaaaccgaaaagaacauucuuuguuauucuacuuaucaccuaacgauuuagucuacguuccuaucgaagaugaacgagaaaacauccacgcaguaaacuuagaccaacuaaauaaugaacaaagaaaaaggauauauaaaaugguaucuugcacaggaucagaaugccacuucgucccguacuacguugcauccccuauagucaauaaaguagaauacuccucucuaaauaaaauaggacguucucuaacuggagaaaugauuaaagacgucuguauuaaacucaaggucgacagacucggcaacgugaaagggauuagugguuuauga

SEQ ID NO: 5751 - RNA, 4536 nt, Artificial Sequence
  Cas9 variant
augaaaaaaauacugggacuagauuuaggcacuaauuccauugggugggcugucauaaacucaguagcagaugaaagcguagagaaaagaaacauagaacuagcuggaagucgaauaauaccaauggaugcagcaguucucggaaauuuugacaacggaguaacaaagagucaaacagcugaaagaacuagcuacaggucaauaagacgccuccgugaaagacaauuauuacguagagaaaggcuacacaaaguauuacaaauuuuagguuuucuuccggaacacuauguaaacgacaucgacuucgaaaaucacccaggaaaaauaaaaaaaaacacagaacccaaauuaccauggagaaaaaauuccaugggacaguuugaauucaucuuucaagcguccuuugaggccauguuaacagauuuugcaacacaccaaccggucuuuguaucagaaggaaaaaaaguacauuaugacuggacccuuuacuauuuacgaaaaaaggcuuugacagaagagaucucaaaagaggaguuagcauggauaauauugaauuucaaucaaaaacgaggcuauuaccaacuacguggagaagaagaagaagaacaaucuaacaaacuaguagaauuuuaugcauugagaguggucaaaguugaagcaacagaugacaaaaaaggcaaagauacuugguacaauguacacuuagaaaauggcuggauauauagaaggaccagcaacaucccauuagacugggaaggaaaagucaaagaauuuauugugacaacugauuugaacgaagacgggaccccaaaauuagacaaauauggagaagugaagagaucuuucagagccccaaaagaggaugacuggacccuaaucaaaaaaaaaaccgaaucagacauagccaauucacacaaaacucuaggauguuauauauacgacgcguuacuucaaaacccuaaucaaaaaauaaagggacgauuaguacguaccguagaacgcaaauuuuacaaagaagaacuccgauuaauuuuagaaaaacaauuaucauuccauccagaacuucaagaucgugaccuauauagagcguguaucgaugcacuuuauguaucuaacgaagcccacaaaaacaacaucucaggcagagauuucguauaccuauuuauugaugacauaaucuuuuaccagagaccauuaaaaacaaaaaaaagccuaauugauaauuguccuuaugaaaaaaaucaguauauggacagagagacgggagaaguuaaacaagcaccaaucaaauguaucgcuaaaucucacccauuauuucaagaauuucgauuauggcaauucauuucaaacauaagaauuuaccagcgagagcgaguaauggaugauggaaaacuugaaaccgacgucgacgugacacccgauuucuuaaaaacagaagacgauuauacuaccuuauucgaauggcugaacgaccgaaaagagguagaucaaaaagcauuucuaaaaaauccacaauuuggauuaaaaaaaaccuuuaccgaauaccgauggaacuauguagaagacaaaaguuacccuugcaacgaaacucguaaugcuauauuaaacggacuacaaaaagcugggguaucagcugauuucuuaucccgagaagucgaagaagcguuauggcauauacuauauucagucgaagacaaaauagaaauagaaagugcacuaagaaaauucgccucaaagcacgaucuggaugacagauuugcagauguauucaaaaaauuaccaccauuucgcaaagaauacggagcuuauucagcaaaagcgaucaaaaaauuauuaccauuaaugagaauggggaaauauugggaacuuucaaacauagacgauaaaaccaaggaacgaauagacaaaauuauuacaggagaaugggaugaaaauauacauaacagaguaagagaaaaagccaucaaauuaucagacauuacggacuucaaaggauuaccauuauggcuaagcuguuauguaguauacaacagacauucugaagcacgugcaauugcuaagugggaaucaccagaagacauagacaguuaucucagauuauuucgucagcauucacugagaaauccagucguagaacaaguaauaacagagacacuacgaacagucagagauauuuggaaacgaaucggccaaaucgacgaaauccauguugaacuaggcagagagauaaaaaaucccgcagacaaacgagcaaaaaugacggcacaaauagucgagaacgaaaacacaaaucuuagaauaaaagcacuacuagcagaauucauaaauucugaguaugagauagaaaacgugcgcccuuacucaccaggacaacaagaaauauuaagaauauacgaagauaccguauuaaacucagucgaagaaauaccagaagacauuucagcugucuugaaaaaauuccgagaauccgaccuaaaaaaacgacccacaaaauccgaauuucuaagauauaaauuaugguuggaacaaaaauauagaucacccuacacaggugacaucauuccguuaggcaaauuauuuacaucagccuaugaaauagaacacauaaucccacagucacgauauuuugaugauagcuucucaaacaaagucauaugugaggcagaagucaauaaauuaaaaaguaacgaacucggauacgaguuuauaaaaaaucaucacggccaauauguagaaauaggguucggaaaaguaguacaaauauucucaauagaagcauaugaaaaauucguuaaggcgaauuacaguggaaucggaaguaagaugaaaagauuacugauggacgacauaccagaaacguucauagaacgacaauuaaaugauagcagauauauauccaaaguaguaaaaucacuccuaucuaacauaguuagggaaaaagauucaaacggagaguacgaaccagaagccauaagcaaaaacguaaucgucuguacaggaucggucacagauagacuaaaaagggacuggggaguuaaugacguauggaauagcauaauauacccuagauuugaaagauuaaaugaauuaaccggaucccaacaauuuggaugcugggaaaacaaagaaggaaaaagaguauuucaaacugcaguaccacuugaaaugcaaaaaggauucagcaaaaagagaauugaccacagacaucaugcaauggacgcaauuguaauagcaugugcgauaagaaaucacauuaacuaucuuucaaaugaaucagccucaaaaaaagcaaagauaagccgaaucgaccuacaaaggcucuuauguacaaaaugcagaacugacgacaacgggaauuauaaauggaucguaaaaaaacccuggccagcauuuacacaggauauaaggaaagcccucgagaauauuacaguuucauucaaacaaaaucuaagaguaauaaauaaaacuacaaacuacuauguccauuucgacgaauccggcaaaaaaguguuggaaaaacaaauaaauggcgauucaugggcaauaagaaaaccaaugcacaaggacacuguguucggaaaagugaaucuacaaaaaguuaaagaaguaagacuaucgcuugcauuagacaccccaaaaaugauaguugauaaaaaacuaaaagaaaaaguuuuacaauuauacagcuauaaauaugacaaaaaacgaaucgauaaguauuuuaaagaaaacgcgucccuuuggaaagaucugaacuuaagcaaaguugccguauacuacuucacaaacgacucaacagaaccccuagucgcaguacgaaaaccgcuagauacaagcuuuaacgcaaagaaaauaaaagaauccguuaccgacacgggcauucaaaaaauacuccuaaaucaccuauccaauaaccaagacaauccaaacuuggcguucucacccgacggcauagaugagaugaacagaaaccuaacgacucuaaaugaugguaaauaccaccaaccaauuuauaaagugcgaguuugcgagccucaagguaacaaauucagcguaggaacaucuggcaacaaaacaaguaaauauguagaagcagccaaagguacgaacuuauuuuucgcaguauaccaaacugaggacggcaaaagaaacuaugaaacaauaccccuaaacguagugauugaacgugaaaaacuggaaugggcucccguaccagaaaacaauaauaacggagacaaauuauuauucuggcuuagucccaaugauuuagucuaugucccaaccgcagacgaauuaaauaauggaaugcggcucgauaacauggauaagggaagaauauauaaaaugaucagcuguucagguccccaaugcuuuuuuauaccucagaacguaucaaacccaaucauaccagucaucgaauuaggggucaauaauaaagcagaaaaaucuuggaacaaugaaaugauaaaaguuguuuguguaccgauuagaguagacagacuaggaugcauuacucaaauuaacaaucaaaaauga

SEQ ID NO: 5752 - RNA, 4539 nt, Artificial Sequence
  Cas9 variant
augaagaaaauauuaggacuagacuugggcacaaauuccauaggaugggccuuaaucgaaaacucuuucacugaaaaagaaggcaaaauaaacgacaugggcgugagaauaauaccaaugucagcagacauacuuggaaaauuugaugcaggucaaucccacucucaaacagccgaaagaacgggauacagaggcacuagacgacuguaccaaagagacaaccuacgaagagaaagacuacacagaguacuacauauucuaggauuccuaccaaaacacuacgaugaacauauagacuuugaaaaacgacuuggacaauucaaagaaggcaaagaaauaaaauuaaauuauagauguaacguagaaaacaaacacgaguucaucuucaucucaucauucaacgaaaugcugacugaguucaagaaagcacaaccagaacuguuuuaucuuaaaucaaauggagaagaaacaaaaauucccuacgacuggacauuauacuaccuuaggaagaaagcacuaucccaaccauuaaccaaacaagaauuagcauggaucauccuuaauuuuaaccagaaaagaggauauuaccaauuacguggugaagaaauugacgaugauaaaaauaaacaauuuguuaaacuaaaaguaaaagaaguaaucaacucuggcgaagccguuaaagguaaaccccuauucgauguuaucuucgaaaacggcuggaaauaugacaaacaaguaguaaaaaccgaagacuggauagauagaacaaaagaguucaucguuaccacuaaaguccucaaaaauggagaccuaaaaagaucauauaaaacaguagacucagaaaaagauugggcagcaauaaaagcuaaaacagaacaagacauagaaagaagcaacaaaacuguaggcgaauuuaucuaugaaacacugcuagaaaauccaacacagaaaauccgaggaaaauugguaaaaacaauagaacgaaaauucuacaaagaagaacucaaaaauauacuaauaaaacaaauugaacuccaaccaacgcuauuuagcgaagaacuauauaaagcaugcauagaagaacucuacccaagaaaugaagcucaccaaaacgcgauuaaaaaccgagacuucauauaccuucuuauggaugacauaauauucuaccaacguccucuaaaaucucaaaaaucaaauauaaguggcugucaauuagaacaaagaguuuauuauaaagccaauaaagacaguggagagaaugaagaagucaaacaagccgucaaagcaauaccaaaaagccauccacuauuccaagaauuucgaaacuggcaauggcuccaaaacuuaaaaauauauaauaaaguagauaccgaaaaaggugaauugaccgauguaacuaaacaauuacugccaucagaagacagcuggguaaaccuauuuaacuucuugcaaugcaagaaagaauuagaacaaaaacaauuuauaaaauauuuuaucgacaagaaauuaaucaacaaaacugaaaaagaccauuaccgauggaauuauguagaagauaagaaauacccuuucacagaaacacgagcacaauuuauauccagguuaacuaaaguagaagguauagaagaaaucaauacauuuuuagacaagaaaacccaaaucggcacuaaagauaauucaccauucguaagccgaauugagcaacuauggcauauaaucuauaguguaucugacaucaaagaguaugaaagcgcucuagaaaaauucgccauaaaacaccacuuaaaugaagaguccuuuguagcaaacuucauuaaauucccuccauuuaaaagcgauuacggaaguuacagcaagaaagcccuuaacaaacuacuaccacuaaugcguagagguaacuacuggaccgaaaacgauaucucagaaaaagucaaauuaaggguaucugaaaucauggagagaguuaacgcucuaaauuuaaaagaagacuauaguagcaaagagcuagcagaaacauuaguaaacguaucagaugaugaugucaagaaacaacuuauaaaaucauucguaaguuucaaagacagaaauccacuuaugggcuugaacacuuuccaagcaacauaccuuguuuauggaaggcacucagagguaggagacauacaaaauuggaaaaccccagaugacauagacacauaccugaaaaacuucaagcaacauucccugcgaaauccuaucguagaacaaguagucacagaaacacuaagaguagucagagacauauggaaacaccauggaaaaucacaaaccaacuucuucaacgagauccauguagaacuaggcagagaaaugaaaaauccagcagacaaaaggaaaagaauuucugaaagaaacacugaaaacgaaaauacaaacaaucgaauacgcgaaauccugaaagaccucaugaacgaugcauccauccaaggagacguaagagauuauaguccaucucaacaagguauccucaaaauauacgaagaaggagucuaccaaaauccaaagguagauuauucaaagguaagcgaagaugaaauaacuaaaauacgcaggucuaacaaccccacacaaaaagaaauacaacgcuaucgauuauggcuugaacaaggauacauuucgcccuacaccuguaaaccaaucccgcuguccaaacucuuuacccaccauuaccaaauagaacacauuaucccucaaucgagauacuuugauaauagcucaucaaacaagaucaucugcgaaucagaaguaaacgaagauaaagacaacaaaacugcuuuugaauaucucaaggauaaaggcgaaaacguuauaaacggucauaaauugcuauccuuggcagccuaugaagcacacgugaauaaauacuucaaaaacaaccgacaaaaacucaaaaauuuacucagugaagauauacccgaaggguucauaaacagacaaaugaaugauucacgauauauaucuaagcuaguaaaaggucuauuaagcaauauaguacgugaagaaggugagcaggaagugaccagcaaaaaccuaauacccgucacgggcucuguaacaagcaaacuuaaaaaugacuggggacuaaacgacaaauggaaugaacuaauacuaccucguuuuaaaagacuuaaccaacuaacacaaaccaaugauuuuacaaccgcaaauacgaauggaaauacaauacccacagugccagacgaauuacuuaaaggguuuagcaagaaacgaauagaccaucgacaccacgcucuagacgcacucguaguagcauguugcacccgaaaucacucaaacuaccugucagcauuaaauacagaaaauaaaaacuauggauuaagagacaaauuacuaauuaaaaaugacaacgaccacuacacaaaaaguuuccaaaugccauggcacggguuuaccaccgaagcuaaaaaccaacucgaagagaccguaauuagcuuuaaacaaaaccuacgaguaaucaacaaagccaauaacaaauucuggagcuacaaagacgaaaauggaaaacuaaacuuagacaaaaacggaaagccaaucaagaaauuaaggaaacaaacaaaaggagauaauugggcagugcgccaaccccugcacgaggaaacuaucuccggaauaguuaaccuaccaugggucaaagccgaaaaagaaaaauucacauacgcgacaagaaaaucccuggacaaaucauucgaccucaagaaaauagagaaaauaacugacacgggaauacagaaaauauugcggaacuaccugaugcaagagaaguucaaagaauuggauaagaaagacaaagaagucuacaauagugagcucgcuuucucacaagagggacuagaagacuuaaacuccaacauugagcaauuuaaugaucaaaagccacacaaacccauauacaaggugagacuauucgaaaaaggcaguggaagauuugccuuagguuuuaaagguaucaaugcuaagaaauacgcucagggcucacccaauuuauacuucaacauuuacagaaacgaagauggccaauauuaugaaacaguaccacuuaauaaaguaauaauucaucagaaaaacgcagcaaacaugcccaagaaaaauagaacaccgguaccaauuucaaacacagcaaucaauagaagcaaagaaguucuagucgacuauaaaaugacacucaguccccucgaccuagucuauauaccuaccgaagaagaguuaaacaacaucaacucauuagauuuuaauaaccugucaaaaagccaaagaaaacgccucuauaacguaaaugauuucagcgguuacacuaucuacuucucaccaaauacuuuagcaaaaagcauaugcccuaaagaaguagauaugaaauucgacgagaaaaagcaaaaacccacugguagcuuugauucaaagacagcuucgcuagacgguaugucgauaaaagaacgaugcaucaaauuaaucauagauagacucggcaacauaaguaaagcauga

SEQ ID NO: 5753 - RNA, 4539 nt, Artificial Sequence
  Cas9 variant
augaaaaaaauuuuaggacuugaucuaggcacgaauucgauuggaugggcaguugucaaugcagacgaaauaacuagagacgauggaucacgcuauuuaaaaccaaacggaauaucagcggcaggaucaagaauaauuccaauguccgcagacauccuuggugauuucgaaaaggguaauucaauaucgcagacugcagaaagaacgagaaugcgaauggcccgacgacuccaugaacgcgcacuccuacgaagagaacgacuuuuaaggguauuaaaccuauuagacuuuuuaccaaaacauuucgcagacaaaauugaccgauauggaaaauuuaccgaugacagcgagccaaaacuagcauggagaaaaaauacugaaggcaaauacgaauuuauuuuucaagacgcauucaacgaaaugcuggccgaauucaaagauaagcaaccagagauaguugaagaaggcaaaaagauaccauaugacuggacuauuuauuaucuaagaaagaaagcacuugaaaaagcucucagcaaagaagaacuaucauggauacuccuacaauucaaucaaaaacgaggauauuaccaauuaagaggagaagaagaagaaauuccacaagacaaaaaaaucgaauacuuagcucaaaaaguugucaaaguagaagcaacugaccaaaaaaaaggagacgaugugugguacaacgucuaccucgagaauggaaugaucuaucgacguacuucaaaagcgccccucgauugggaagguaaaguaaaagaauuuauaguaacaaccgaaguagaaaacgacggagaaacgccaaaaaaagacaaagaagggaacauaaaaagaucauucagggcaccuaaagaggacgacuggaccuuacuaaaaaaaaaaacggaagcugacaucgaaaauagucauaaaacaguagggugcuauaucuaugacucauuacuaaauaacccaaaacagaaaauaauaggcaaacuaguaagaacaguugaaaggaaauucuacaaagaagaacuaacacaaaucuuaaaaaaacaaguagaacucaucccugaacuuagggacgacaaccuuuacaaacaauguaucgaagaauuauaccccaucaaugaagcacacagaaauacuauagccaagacagacuuugcuaaucucuuuauaaacgauauuuuauucuaucagcguccacuaaaaucaaaaaagucgcaaauagauaacugucccuaugaagaaagaauauucaucgauucuaaaacaggagaaaaaaaaaaaguacccguaaaaugcauugcuaagagcaauccccuauuccaagaauuccguuuauggcaauuuauacaaaacuuacgaaucuaucaaagagaaaaagaaauugauggcaaacuauugacugacauagacaucacaagugaauguuuaaagucggaggaagacuacgugcgacuguucgauuggcuaaaugacagggaaacaauagaacaagaagaucuacucaaacaucuuuuuaacacuaagaaaaguaaaaacaaagaaaauccuuauagauggaacuacgucgaagacaaagucuauccauguaacgaaacacgagcaacaauacuaaaaggauuuagcaaauguggaauaaacgccucaguucucucuccagaacucgaaauggcacucuggcauauacucuacagcguagaagacaaaaaagaaauugaaaccgcgcuaacacauuucgcacagaaacaaggauggaaugacgauuucgcuaaaguauuuucaaaggcgaaaccauuuaagaaagauuacgguucauacucggaaaaagcuaucaaaaaacuuuuaagccuaaugaggaugggaaaauauuggaaccaggacaauauagauaaaaauacacuugacagaauagauaaaauaaucaauggggaauacgacgagaaaauaaguaacagaguaagggacaaugccaucaacuuaaaggacaucucugacuucagaggguugccuguauggcuugcuuguuacaucgucuaugauaggcacagcgaagcaaaagacuguaccaaauggaauuccccugaagagaucgauagcuaccucaaaaaauucaaacaacacucccuaagaaaccccauuguagaacaaguaguaacagaaacccugaggacggugcgagauauauggauccaggaagaacaaauagaugagauucaucuagaauuaggucgagaccuaaagaaccccgcagauaagcguaaaaagaugucggaaaauauacugaaaaaugaaaauaccaaccugaggauaaaagcaauguuaauggaauuuaugaacccaucaauggguauugagaacguaaggccguauucgccaucccaacaggacauucuccgaauuuacgaagagaaugcacuggacaacuuaacgaaagacgauaaagacuucgauuucauauccaaaaucaguaaacaagcccaaccaucuaaaacugauauaauucguuacaagugcugguuagaacaaaaauaucgaagcccauacacagguaaaaccauuucauuaucaaaauuguuuacaccagcauacgaaaucgaacauguuauaccacaaagcuuauacuucgacgacaguuuuagcaacaaaguaaucugugaagcagagguaaacaaauuaaaggauagacaacucggauauaaauucaucgcagaacaucauggagaaaaaguccaacucucacaaggagaagucguugaaaucuuaucaguagaugcauaugaaaaauucgucaaagaaaacuacgcaaacaacaggauuaagaugaaaaaacugcuaauggaaucuauaccagacgaauucauagaaagacaauuaaaugauagccgauacauaucaaaaguaguaaaagggcuacucucaaacauuguuagagaaaaaaucgaugaugaaaauuacgaacccgaagcaguuucaaagaaucucaucagcugcaacggagcuauuacagauaggcuaaaaaaagacugggggaugaaugacguauggaacuccauaauacuuccaagauucauuagaaugaaccaaauuacaggcaaagacugcuucacgacaaccaaugcagaaggccaccuaauaccucaaaugccucucgaacuacaaaaaggauuuaacaaaaaaagaauagaccaccgccaccaugcuauggacgcaauaguaauugcaugcacaaccagggaccacguuaacuuauugaauaaugaggcugcucacaguaaauuuaacgcaacucguuaucaacuccaaagaaaauuacgacgauucgaaaaagccguaauagacgguaaggaacgagaaguagcaaaagaauuucuaaaacccugggauucauucucuagcgauaguaaaaacauauuagaaaauauaauagucucauuuaaacaaaaucagagggucauuaauaagacaacuaacgcauuuuuacacuucgacgaaaauggaaagaaaaccuucauaaaacaaggcaaaggagacucaugggccaucagaaagagcaugcacaaagacacagucuucggggaaauaaaccuacgcaaaguaagauccguaagucuaaaugaagccaucaagguaccugaaagaguacuaaacaaaaaaauaaaggaaaaaauauuagaacuaaagaacaacaagauagaugcaaaaaacauaaaaaaauauaucgaagaaaaucacacagguggauacggaauagacucaaguaaaauugaugucuuuuauuuuaccaaagaaacaaaagaacgauucuucgcaacaagaaaaacauuggauaccucauucaaucaagccaaaauaaaagacucaauugcagauucagguauacaaaagauacuccuagcacaucuaaaaagcaaaaauggagaugcagaacaagcauuuucaccugauggaauagaugaaaugaauaaaaacauuguagaauuaaauaauggaaaauuucaccaaccgauacuaaaaguaaggguauacgaaaaagccgacaaauucgcaguuggacaaaaaggaaacaaaaaaguaaaauuuguagaagccgccaaggguacuaacuuauuuuucgcgaucuuugagaaagauggaaaaagaaguuaccucaccauaccauuaaauguaaugaucgauugucagaaacaauacggaaaucaauggaaaaacaauauagaggcuuaccugaaagagaaggaacuaguggaaaaagauguaaaacuacaauuuauauuaagcccaaaugacuuagucuaccuaccuaccgaaggcagcauagacaaaaaaagaauuuauaaaguagucucauucacaaauaauagacuauaugccauaccuuacgcgauagcaaaaucaaucguagauaaaaaugaauuuacacagcuaaacaaaauagaauuuacagacaauaaggaauccauaaaagacgccugcgucccaguaauaauagaucgucuagggaacguuauagaauuuaacggaaaaagacucuga

SEQ ID NO: 5754 - RNA, 4539 nt, Artificial Sequence
  Cas9 variant
augaaaaacauccuuggacuugacuugggaacaaacuccauuggaugggcagucauaaauucugaggaagacggaccaauugugaagaaacgaauagaguuagcggguucacgaauaauuccaauggacgcggcuguacuagguaacuucgacuccgguguuacaaaaucacagacagcggaaaggaccucauuuagaucaauccgaagacuacgggaaagacaacuacuaagacgagaacgacuucacaaaguauuacaaauucuaggauuucuuccagaacauuacguaaaugauauagauuuugaaaaucacccgggcaaaauaaaaagaaacacggaaccaaaacuuccauggcgcaaaaauucgaugggccaauuugaguucaucuuucaagauagcuuugaagcaaugcuaacagauuucgcaacacaccaaccagucuuuguaucagaaggcaagaaaguaccauaugacuggacacucuauuauuuacgaaagaaagcguuaacagagggaauuucuaaagaagaauuggcguggcuaauacuaaauuuuaaucaaaaacgaggauauuaucaauuaagaggagaagaagaagaagaacaauccaacaaauuagucgaguucuacgcuuugaggguugucaaaguugaagcaacggacgauaagaaagguaaagauacaugguacaacgugcauuuagaaaacggauggauauaucgucgaacaucuaauaucccuuuggacugggaagguaaaguuaaagaauuuauaguaacaacagaccuaaaugaagauggaacaccuaaacuagacaaauauggagaaguaaaacgauccuucagagcaccaaaagaagaugacuggacgcucauuaaaaagaaaacagaaucugauauagcgaacagccacaagacgguaggauguuauauuuacgaugcacuucuacaaaauccccaucagaaaauaaaaggucgcuuagugagaacggucgaaagaaaauuuuauaaggaagaauuaagacucauucuagaaaaacaacucagcuuucacccagaacuacaagaucgcgaucuauaccgagcgugcauugacgcgcucuauguaucuaaugaagcacacaaaaauaacaucagcggaagagacuuuguauaccuauucauagaugacauaauuuucuaucaacgaccacuaaaaacuaagaaaagccuaaucgauaauugucccuacgaagaaaaucaauacauggacagagaaaccggagaaguaaaacaggcgcccaucaaauguaucgcaaaaucacauccauuauuucaggaauuuagauuauggcaauuuauaucaaacauaagaauauaccagagagagcguguucuagaugauggcaaacuggaaacagacguagauguaacucccgauuuucuaaaaacagaagacgacuacacaacacuauuugagugguuuaacgaucgaaaggaagucgaccaaaaagcauuucugaaaaauccacaauucggauuaaagaaaacauuuacugaguacagauggaauuaugucgaagacaaaucguaucccuguaacgagacucgcaaugcaauauuaaauggacuacagaaagcuggugugagcgcagacuucuuguccagagaaguagaagaagccuuauggcauauucuuuauaguguagaagauaaaauagaaauagaaagcgcacuacgaaaauucgcaagcaaacaugaccuugacgauagauuugcagacguuuucaagaaacucccaccuuucaagaaagaauauggggcauauagcgcaaaagcuauaaagaaacuauuaccacucaugaggauaggaaaauauugggaacuuucaaacauagacgauaaaacaaaagaacgaauugauaaaauuaucacuggcgaaugggaugaaaauauacacgaucgaguaagagaaaaagcuauaaagcuaagugauauuacagauuuuaaaggauuaccucuuuggcuaaguugcuauguaguauauaaucgacacagugaagcccgagccauagccaaaugggagagcccugaagacauugauaguuacuuaaggcuauucagacaacacaguuuaagaaacccaauaguugaacaaguaauaacggaaacauuacgaacgguaagggauauauggaaaagaguaggacaaaucgacgaaauacacgucgaauuaggcagagaaauuaaaaacccagcagauaaacgugcaaaaaugaccgcacaaauuguugaaaacgaaaacacaaaucugcgaaucaaagcacuauuagcggaauuuaucaacucagaauaugaaauagagaauguacgaccuuacagcagcaaccaacaagaaaaauugaaaauauaugaagauacuguacuaaauggcguaaaagaaauuccagaggacauuaauacgauucugaaaaaguucagagaauccgacuuaaagaaaagacccacaaaaagcgacuuuuuacacuauaaauuguggcuugaacaaaaauauuguucaccauacaccgggagaauaauuccguuggguaaauuguuuacaagugcauaugaaauagagcauauaauaccacaagcucacuacuucgacgacucauuuaguaauaagguaauaugugaagcagagguuaacggauuaaaagacaaaaagcuaggauacgaguucaucaagcauaauccaggcaaaaugguagaaauuggauucggcaaaccaccaguacguauauuuucaguagaagaauaugaaagguuuguaaaggaaaacuacagcggaaucaaaaacaaaaugaauaaauuauuaauggaugacauaccugaaacuuucaucgaaagacagcuuaaugauucucgauacauaagcaaaguagucaaaucuuuacuuaguaauauaguacgagaaaaagacucuaauggugaauaugagccagaagccaucagcaaaaauguaauaguauguacuggcucuguaacagacagauuaaaacgagauugggguguaaacgacguauggaauagcauuauauauccaagauuugaaagacucaaugaauugacagguagucaacaauucggauguugggagaacaaggaaggaaaaagaguuuuucaaacagcagucccauuggaaaugcaaaaaggauucucuaaaaagagaauugaccacagacaccaugcaauggaugccauagucauugcaugugcaacaagaaaccauauaaauuaccuuucuaaugaaagcgcaucuaagaaagcaaaaaucucccggacugaucuacaaagacuacuuuguaccaaaugcagaacggaugauaauggaaauuauaaauggauaguaaagaaaccuuggcccgccuuuacucaagacauaagaaaggcccuggagaauauaaccguauccuuuaaacaaaacuuaagagugauaaauaaaacaacaaacuauuauguucauuucgacgagucgggaaagaaaguacuugaaaaacaaaucaauggcgauucaugggccauaaggaaaccaaugcauaaagacacagucuucggaaaagucaacuuacagaaagugaaagagguaagacucucacuagcauuagauacaccaaaaaugauuguagauaagaaauuaaaagaaaaaguccuacaguuauacuccuacaaauaugacaagaaaagaauugauaaauauuucaaagaaaacgccagcuuauggaaagacuuaaaccuaucaaaaguagcaguuuacuacuuuacaaacgauaguacugaacccuuaguagcagugcguaaaccacucgauacaucauuuaaugcaaagaaaaucaaagaaucuguuacagacaccggaauacagaaaauacuccugaaccacuuaucuaauaaucaagacgauccaaaccucgcauuuucgcccgauggaauagauaaaaugaacaaaaaccuaacggcacuaaaugauggcaaauaccaucaaccuauauauaaaguaagagucugcgaaccgcaaggaaauaaauuuuccguagguacuagcggaaauaaaacaucaaaauacgucgaagcagcaaaaggaacaaaucuuuucuuugcggucuaucaaaccgaagauggcaaaagaaguuaugaaacgauuccccuaaacguugucaucgaaagagaaaaacuuggguggacuccaguaccagaaaacaauaacaauggcgauaaauuauuauucugguuaucgccaaaugacuuaguauauguuccaacggccgaugaauuaaauaacggaaugcgacuagauaauauggacaaagggagaauauacaaaaugaucagcuguucuggaccacaauguuucuucauuccacaaaacguuaguaacgcaaucauaccugucauagagcugggagcaaacaauaaagcagagaaaagcuggaauaacgaaaugaucaaaguagucuguguacccauacgaguggauagacuggguugcauaacccaaauaaacaaucagaaauga

SEQ ID NO: 5755 - RNA, 4551 nt, Artificial Sequence
  Cas9 variant
augaaaaauauuuuaggauuagaucuaggaacgaauaguauaggauggagcguaauccaagaaaaacacaaugaaaacaacgaaugucaaaaacuaauauuaggugcuggauccagaauaauuccuauggacgcugcaguacuaggggauuuugcaaaagggaauacaauaucccaaacuaaagaucguacacaauaccguggaguaagaagacuaagggaaagaugucuauugcgacgcgaacgauuguuucgaguucuagacauaaugggauuucuaccucaacacuucuccaaugcacuaacgagguacggaaaauuuaaagaugcugacgaagaaccgaaaauagcuuggagaaaagaugacgaaggaaaaaugcauuuccuguuugcugauagcuuuaacgaaaugaucgaagaauuucgaucuguccaaccugaauuauugaaacgcggaaugaaaguaccauaugauuggacacuauacuaucuaagaaagaaagcaaugagagaagcaguaacuccauucgaacuugcauggcuaauacuuagcuuuaaucaaaaacguggcuacuaucaacuaagaggagaagaagaaggugaagcugacaauucaaaauccgaagaauacuuggcacaaagagucguagauguuauagacacaggagagaagaaaggaaaaucgacaugguuugacauuguacuggaaaacggaaugguuuaucaccgcccagcugaaaucaaaccggacuggaucggaaaaacuaaagaauuuauaguuacuacgcaauuugauaaagauggcaaccccaagaaagacaaagagggaaacgucaaaaugagcuuuaggaugccaaaugaaaacgacuggaauuuacagaaaaagaaagcagaaaaagauaucgaugaaucuggcaugacaguaggagaguauauuuacaaugcuuuauuacauaauccuaaacagaaaauaaaagguaaauuagucagaguagucgaacgcaaauacuauaaaaaugaacuccagaaaauacuugagucacagaaaagauuuauaccgcaacugucggacagugcacuauacgagaaauguauaaaagagcuauaucaaucaaacgaggcauauagaaacucaaucaguaccagaaacgauuucacuuaucuguuuguagauaacauaauauuuuaccaaagaccuuuaaaauccaagaaaucccuaaucgacaacuguccguaugaaagccuagcuuacacaaaagauggcgaagaacauaaagcacccgugaaauguauagcaaaaucgcacccccucuaucaagaauuuagauuauggcaauuuauaucaaacuuacgcauauaucaacgacaaaaacaaguuggagauaaaguuaaauuagauguagauguaacagacgaguuccuccccacagaugaucggagagagucuuuauucgauuaucuuaacgacaaaacagaaauuaaacaagacguauuauuaaaagaguucuuuaguaugaagaaacccaaagguaaagacagcgucuacccauacagauggaacuacguugaagacaaaucauauccauguaacguaacaagaggaaaaaucuuagcaaaacuuaacagagcuggaauaucagccgacuucuuaagcucaaacggaaaugaagaaucacuauggcacauucuauacaguguggaagauaaaggagaauuacguaaagcauuagcacgauuugcagccaaaaacggauuagacgaugcauuuacagaagcacuagcugauauagaacccuauaagaaagaauacggagcuuauucagcaaaagcgcuaaagaaauuacuaccauugaugagacuagguaaauauuggaacuacgauaauauagccccagcuacaaaagcaagaauuucaaaaauaauagauggagaauacgacgaaaauauaagaaacaggguacgagaaaaagcgaugucuuugaauagugcgagccaauuucaagguuuaccucuauggcuggcauguuauauaguuuacgacagacacucagaaagagcagacucugggagauggaguucuccagaagacaucgacaaauaucugucagacuucaaacaacauucacuacguaaccccaucguagaacagguagugacugaaacacuaagaacaguuagagacaucuggaaaagauacggugaaauaucagaaauacauguagaauuaggaagagaaaugaaaaauccagcagacaaaagaucaaaaaugaacagacgaaugcuagaaaaugaaaacgcaaauaugagagccaaacuauuacuaacagaguucaugaauccugaauuuggcauagaaaacgugagguccuauagccccagucaacaagaauuauugagaaucuacgaagacggggcaaucagcaaugcaggaagcgaaaucgacgacgaaauaagugacauaaugagucgauugagucaaguggacgucaagaaacaaccaacagccagcgaggugaaacgguauauacuuuggcuugaacaaaacuauagaaguccauauacaggacaaaugauaccauuggcaaaauuauucacuccugccuaugaaauagaacacguuauaccucaaagcagauauuucgaugacucauucucaaauaaaguaauaugugaagccgaaguaaauaaacuuaaagaucgaaugcuaggcuacgaguuuauuaaacagcauaaaggagaaaaaguaucguuaucgaugggaggcacaguagaaauauuaucaccggaagaauauguaagacacguagagagucaauacaaaaauaauaaagcuaaaaugagaaaacuacuaauggacgacauaccugacgaauuuauuaauagacaauuaaacgacucacgauauauuuccaaacuaaucauuaguuuacuuagcaauauaguacgagaagagggcgaagaagaagcuacgaguaaaaauguaauaaguuguaacgguucgauaacagauagacucaagaaagacuggggaauaaacgauguuuggaaucauauuauacugccaagauuuagaagguuaaaugaauuaacugggacagauaaauucaccacaucaaauaaagagggucaugaagucccagaaaugccacuagagcuacaaaaaggcuuuaauaagaaacgaaucgaccauaggcaccacgcuauggacgcaauaguuauugcaugcauaacaagggaccauguaaaucuuuuaaacaaugaagcugcuaugucuaaaaauaaugcaaaucgaauccaacucuccaagaaauuaagacguuaugaaaguguagagauagaaaaagauggaauuagaaaacagauaaguauggcuaaagaguucaagaaaccaugggaggguuuuacagcggauguggaaaggacacuaagagacauagugguaucauucaaacagaaccucagaguaauaaauaaaacaacgaacuacuaucaacacuucaaagauggcaagaaaauuuauaguccacaaaguaaaggugacucaugggcuauacgcaagagcaugcauaaggaaacuguauuuggagaaauaaacauaagaaggauaaaggaaguaucucugaaagaagcaaugaagagaauaaaagauauagcggauaaagaauuaagaagcaaaauaguugaacucauggcacuacaauauaaugagaagaaaauuaaacaauauuuuucagauaacaaagacgaauggagcgauguaaaccccaagaaaaucaaaauacacuauuuuacuaaagaaacaaacgaaagauucuuugcuacucgaaagccacuagacaccaguuucgacaagaagaaaauaaaaacucaaguugccgacacggcgauccagaaaauauuacucaaccaccuaucagcucauggugauaaagccgaaacugccuucucgccagauggaauagaugaaaugaauagaaauauaauagaauuaaaugauggaaaauuccaccagccaauauugaaaguaaggauauacgaaaaagcagacaaauaugcagucgggcaacaaggaaacaaaaagaagaaauacguggaagcggcaaaaggaacgaaucuauucuuugcaauuuacgcugaagagaaaauagaugagaaaacaggugacacagugauuacgcgcacauaugacucuauuccauugaauguggucauugacagagagaaaagaggauuaagcccaguacccgaaaaugaaaacggugccaaaccaaaauacguacuaucaccaaacgacuuaguauacgucccaaacgaagaagaacgagaaaccggaagaaucugugagccgcuagauaaagagagaauauauaagaugguaucaaguaauaagaaacaggcuuucuuuaucaaauccgaaguugcaucaacaauaguugacaaauuugaguucucagcauuaaacaaacaagaacgagcauuaaguggggagaugauaaaagagauauguaucccuaucucgauaaacaggaucggagaaaucacauugagguga

SEQ ID NO: 5756 - RNA, 4554 nt, Artificial Sequence
  Cas9 variant
augaagaaaauaguaggacuagaccuaggcacuaacaguauaggaugggccuuaauaaaugcuuauaucaacaaagaacacuuauauggaauagaagcaugcgguucuagaaucauaccaauggacgcagcaauacuaggaaauuuugauaaagggaacucaauaagucaaacagcagaccguacauccuaccguggaauaagacgacuuagagagagacacuuguuacgaagagagagacugcaucgaauauuggaccugcuaggauuccugccuaaacacuauucagacagccuuaaccgauaugggaaauuccuaaacgauaucgaauguaaacuaccauggguaaaagaugagacaggauccuacaaauuuauuuuccaggagucauucaaagaaauguuagcgaauuucacugaacaucacccaauauuaauugccaauaauaagaaagucccauaugauuggacgaucuacuaucuaaggaagaaagcauuaacacagaaaauuucaaaagaggaacuagcauggauccuccuaaauuucaaccaaaaacggggauauuaccaauugagaggagaagaggaagaaacgccaaacaaacuuguagaguauuacucauugaaagucgaaaaaguagaggacucgggagaaagaaaaggaaaagacacaugguauaauguacauuuagaaaacggaaugaucuauagacgcacaucaaauauuccacuggacugggaaggaaaaacaaaagaauuuauuguaaccacugaucuugaggccgaugguuccccuaagaaagauaaagaaggaaacauuaaaagaaguuuccgcgccccuaaagaugaugacuggacccucaucaagaagaaaacagaagcagacaucgacaaaauuaaaaugacggugggagcauacauauaugauacauuacuccaaaaaccagaucagaaaauaagggguaaauuagugaggacuauugagcgcaaauacuacaaaaacgaauuauaucaaaucuuaaaaacacaauccgaguuucaugaagaauuaagagacaaacaacucuauauugcuugccugaacgaauuauaucccaacaaugaaccccgaagaaacaguauaucaacaagagauuucugccauuuauucauagaagauaucauauuuuaucaaaggccucugaaauccaaaaagagcuuaauagacaauuguccuuaugaagaaaaccgguacauagacaaagaaucaggcgaaauuaaacacgcaucaaucaaauguaucgcaaaaucgcaucccuuauaucaagaauuuagauuauggcaauucauagugaaucuacguauauaucgaaaggaaaccgacguugauguaacacaagaacuguuaccaacggaggcagauuauguaacccuauuugaaugguuaaacgaaaagaaagaaauagaucaaaaagccuucuucaaguacccaccuuucggcuuuaagaaaacaacuucgaauuaucgauggaauuauguggaagacaaacccuacccauguaacgaaacacaugcacaaauaauagcuagacuagguaaagcacacaucccgaaagccuuuuuaaguaaagaaaaagaagaaaccuuguggcacauucucuacagcauagaagacaaacaagaaaucgagaaagcauuacacagcuucgcaaauaaaaacaaccuaagcgaggaauuuauugaacaauuuaaaaauuuuccacccuuuaagaaagaauauggaucguacagugcuaaagcuauaaagaaacuccugccacuuaugagaaugggcaaauacuggaguauagaaaauauugacaauggaacgcgaauaagaauaaacaaaauaauugauggagaauacgacgaaaauauaagagaacgcgucagacaaaaagccauaaaucuaacggauauaacucacuuuagagcucucccacuaugguuagcaugcuauuuaguuuacgaucgacacagugaaguuaaagacaucguaaaauggaaaacacccaaagauauugauuuauacuuaaaaucauuuaaacaacacucacuaagaaaucccauaguugaacaaguaauaaccgaaacccugagaaccguaagagacauauggcaacaagucggacacauagacgaaauccacauagaauuagggagagaaaugaaaaaucccgcagacaaacgcgcgcguaugucacaacaaaugaucaaaaaugaaaauacgaaccucaggauaaaagcccuacuuaccgaauuucuaaacccugaguuuggaauagaaaacguaagaccuuauuccccaucacaacaggauuugcuacgcaucuacgaagaaggaguacuaaauucaauucuagaacucccagaagauaucgguaucauacuaggcaaauucaaccaaacagauaccuuaaaaagaccuacucgaagugaaauauuaagauacaaacuuuggcuggaacaaaaauauagaaguccguauacaggugaaaugauaccgcugucgaaacucuucacuccagcauaugaaaucgaacacauuauaccacaaucccgauauuuugaugacucacugagcaacaaaguaauaugugaaucagaaauaaauaaacucaaagauaggucacuuggauaugaauuuaucaaaaaucaccacggagaaaaaguugagcucgcauucgauaaaccaguagagguacuaagcguagaagccuacgagaaacugguccaugaaagcuauagccauaacagaaguaaaaugaagaaacuauuaauggaagauauuccugaucaauucaucgaacgacaacugaacgacagcagauacauaucgaaaguaguaaaaagucuacuaaguaacaucguuagagaagaaaacgaacaagaagcgauuucgaaaaacguaauccccuguacuggaggaaucacagauagacuaaagaaagauugggguauaaacgauguauggaauaaaauaguauugccucgauucauaagauuaaaugaacuaaccgagucaacuagauucacuagcauaaacacuaacaacacuaugauuccaaguaugccacuagaauuacaaaaaggauuuaauaaaaagagaaucgaucacagacaccacgcuauggacgccauaauaauagcuugcgcuaacagaaauauaguaaacuaccugaauaacgucucagcaagcaaaaacacuaaaauaacucggagagauuugcagacccugcuaugccauaaagacaaaaccgauaauaauggaaacuacaaaugggucauagauaaaccaugggaaaccuucacgcaagacacccuuacagcucuccagaaaauaacugucagcuucaaacaaaauuuaagaguuauaaauaaaacuacaaaucacuaucaacauuacgaaaaugguaagaaaaucguaucaaaccaaucaaaaggagacucaugggcuauacgaaaaucaaugcacaaagaaacaguacauggugaaguaaaucuucgaaugauaaagacaguaucauucaacgaagcauuaaagaaaccacaagcuauaguugaaauggaccucaaaaagaaaauacuggccaugcuagaacucggcuaugauacaaaacgcaucaaaaacuauuuugaggaaaauaaagauacuuggcaagauauaaacccaaguaaaauaaaaguauauuauuuuacaaaagagacaaaagacagauauuucgcaguaaggaaacccauagauacaucauucgacaagaagaaaauaaaggagaguauaaccgacaccggaauccaacaaaucaugcuuagacaccuagaaacaaaagacaacgaccccacucuagcauuuuccccagauggcauagacgaaaugaacaggaauauccuaauacuuaauaaaggcaagaaacaucaaccaauuuauaaggucagagucuaugaaaaagcggaaaaauucacaguaggacagaaagggaauaaaagaaccaaauuuguagaagcugccaaaggaaccaacuuauucuuugcaauuuacgaaacugaagaaauagacaaagacaccaagaaaguaauuaggaaaagaucuuacuccaccauaccucuaaauguagugaucgaaagacaaaaacaaggucuaaguuccgcaccagaagacgaaaacggaaaccucccuaaauacauacucucgccuaacgaccuagucuacguacccacucaggaagaaauuaauaaaggagaaguagucaugcccaucgauagagaucgcauuuacaaaauggucgacaguuccggaaucacagcaaauuucauacccgcaaguacagccaauuuaauauucgcgcuacccaaggcgacagcugaaaucuauuguaacggagaaaauuguauacaaaaugaauauggcauuggauccccucaaagcaaaaaccaaaaagcaauaaccggugaaaugguuaaagaaauauguuucccaauuaaagucgaucguuuaggcaacauuauacaaguaggaucauguauauugacaaauuga

SEQ ID NO: 5757 - RNA, 4563 nt, Artificial Sequence
  Cas9 variant
augaagaaaauagugggucuggaccucggaacaaauucaauagggugggcccucauaaacgcauauauagaugaauauaacaaagaacacuuauacggaauagaagcaugugggaguagaaucauuccaauggaugcagcaaucuuagggaacuuugauaaaggaaacaguaucagucaaacagccgaccggacaucuuauagaggaauaaggagacuaagagaaagacaccuacuacgaagggaacgacuacaucgaauuuuagaccucuuaggauucuuaccuaaacauuauucagacucacuaaaccgguacggaaaauucuuaaacgacaucgaaugcaaauuaccauggguaaaagaugaaacagggucauacaaauucauauuccaagagagcuucaaagaaaugcuagccaacuucacggaacaucacccaauauugauagccaauaacaagaaaguacccuacgauuggacaauuuauuaucuaaggaagaaagcauuaacgcagaaaauaucaaaagaagaacuagcauggauuuuauugaacuucaaccaaaaacgaggauacuaucaacuaagaggugaggaagaagagacacccaauaagcuaguagaguacuauagccuaaaaguugaaaaaguagaagacucaggugaaagaaaaggaaaagacacuugguauaacguacaccuugaaaauggaaugauauacagaagaacaucuaacaucccacuagacugggaaggaaaaacuaaagaguucauagucacuaccgacuuagaagcagauggcucccccaagaaagacaaagaaggaaacauuaaaaggaguuuucgugccccgaaagacgaugacuggacuuuaaucaaaaagaaaacugaagcugauauugauaaaauaaaaaugacaguaggagcuuacauauacgacacacuauuacaaaaaccagaccagaaaauacguggcaaauuaguaagaaccauagaaaggaaauacuauaaaaaugaacuauaccaaauauuaaaaacccaaucugaauuucaugaagaauuacgagacaaacaacuguacauagcgugcuuaaacgagcuauaucccaacaaugaaccccgcagaaauucaaucucgacaagagacuuuugucauuuauuuauugaagacauaauauuuuaucaacgacccuuaaaaucuaagaaaucgcucauagacaauugcccguaugaagaaaaucgauauauagauaaagaaaguggagaaauaaaacacgccucaauaaaaugcauagcuaaaucucauccacuauaccaagaauuucgccuauggcaauuuauaguuaauuuacgcauauauagaaaagaaacggaugucgacguaacacaagaauuauuaccuacagaggcggauuaugucacacucuuugaauggcuaaaugagaagaaagaaaucgaccaaaaagccuucuucaaauauccaccuuucggcuuuaagaaaacuacaucaaauuaccguuggaacuauguagaagauaaaccauacccguguaacgaaacucacgcucaaauaauagcacgauuaggaaaagcacauauuccgaaagcauucuuauccaaagaaaaagaagaaacacuauggcacauacuauacuccaucgaagacaaacaagaaaucgaaaaagcucuacauaguuuugcuaacaaaaacaaccuaucagaggaguucauagaacaauucaaaaacuuuccaccauucaagaaagaauacggcucauacucagcaaaagcaaucaagaaacuacuacccuuaaugcgaauggguaaauauuggucaauugaaaacaucgacaacggcacacgaauuagaauuaacaaaauuaucgacggugaauaugacgaaaauauaagagaacgaguaagacaaaaagccauaaacuuaacagauauaacacacuucagagcgcucccuuuaugguuagcgugcuacuuaguauacgaccgucacucagaagucaaagacauugucaaauggaaaaucccaaaagauauagacuuauaccuuaagagcuucaaacaacacaguuugagaaaucccauaguagaacaagucauaaccgaaacacuacggacuguucgagacauauggcaacaaguaggacacauagaugaaauacauauagaauuagguagagaaaugaaaaacccagcggauaaacgugcgaggaugagucaacagaugaucaaaaaugaaaauacaaaucugagaauuaaagcucucuuaacagaauuuuugaauccagaguucggaauugaaaacgugcgcccauauucuccgagccaacaggaucuacuacguauauacgaagagggaguccuaaacucaauuuuagaacugccagaagacauaggaauaauacuaggaaaauucaaucaaacugacacccuaaaacgaccaacaagaucugaaauauuaagauacaaauuaugguuagaacagaaauauagaaguccuuauacgggggaaaugauuccuuuaucaaaacuauucacacccgcauacgaaaucgaacacauaauaccgcaaucacgguauuuugaugacagucuaagcaacaaaguaauaugcgagagcgaaaucaauaaacuaaaagaccgcucacuuggauaugaguucaucaaaaaccaccacggcgaaaaaguugaacuagcguuugauaaaccugucgaaguacuaucaguggaggcauacgaaaaacuuguccacgaaucuuacagccacaacaggucaaaaaugaagaaacuauuaauggaagacaucccugaucaauuuauagaaagacaacuaaacgacaguagauacauaagcaaagucguaaaaagucuacuaagcaauauaguacgggaagagaaugaacaagaagcgauuuccaaaaacgugaucccguguaccgggggaauaaccgacagacuaaagaaagauuggggaauaaaugauguauggaauaaaaucguguuaccuagauuuauacgucuaaacgaacuuacagaaucaacacgauucacaagcauaaacaccaauaacacaaugauaccaucaaugccuuuagaauuacaaaaaggauuuaacaagaaaagaauagaccacagacaccacgcgauggaugcaauaauaaucgcgugugcuaaccgaaacaucguaaauuacuugaauaacgucucagcaucuaaaaacacaaaaauuacuagaagagauuuacaaacucuguugugccacaaagauaaaaccgacaauaauggcaacuauaaaugggucauagacaaaccuugggaaacauucacucaagacacacuuacagcucuccagaaaauaacaguuagcuuuaaacaaaauuuacggguaauuaacaaaacaacaaaccacuaccaacauuacgaaaauggcaagaaaauaguaucaaaucaaaguaaaggcgacaguugggcuauuagaaaaagcaugcauaaagaaacuguacacggagaagucaaccuaagaaugauuaaaacaguaucauucaacgaggcgcugaagaaaccacacgcuauagucgagauggaccuuaaaaagaaaauacucgcgaugcucgaauuagguuacgacacaaaaagaauuaaaaauuacuuugaagaaaauaaagacacauggcaagacauaaauccgucaaaaauaaaagucuacuacuucacaaaagagacaaaagauagauacuuugcaguacgaaaaccaauagacacauccuuugauaaaaagaaaauaaaagaaaguauaacagacacaggcauucaacaaauaauguuacgacaucuagaaaccaaagauaacgauccuacacuagcuuucucaccugauggaauugaugagaugaauaggaauauacuaaucuuaaacaaagguaagaaacaccaaccaauauauaaggucagaguuuacgagaaggccgaaaaauucacagugggacaaaaagguaacaaaagaacaaaauucguagaagcagcuaaaggaacuaaccucuuuuucgcaaucuacgagacugaagaaauagauaaagacaccaagaaaguuauccgcaaaagauccuacuccacuauacccuugaaugucguuauugaaagacaaaaacaaggguuaucaucugcuccagaagaugaaaacggaaaucuaccaaaguacauauuaucaccuaaugaccucguguauguaccaacucaagaagaaaucaauaaaggagaaguuguaaugccuaucgaucgagaucgaauauacaaaaugguagauagcucagggauuacagcuaauuuuauaccagcaucaacagcaaauuuaauauucgcacugccaaaagcuaccgccgagauauauugcaauggagaaaauugcauacaaaacgaguauggcauaggaaguccucagagcaaaaaucagaaagcaaucaccggagaaaugguaaaagaaauaugcuucccaauaaaagucgacagacucggaaacauaauacagguaggaaguuguauacuaaccaauuga

SEQ ID NO: 5758 - RNA, 4563 nt, Artificial Sequence
  Cas9 variant
augaaaaagauugucggcuuagaucucggcacaaauucuauuggaugggcccucauaaacgcauauauagacgaauacaauaaagaacaccuauauggaauagaagccugcgguagcagaauuauaccgauggaugcugcuaucuuagguaacuucgacaagggaaauucgauuucacaaacagcagauagaacgaguuacagaggaaucaggcgacuaagagaacgacaucucuuaagaagagagagauugcacaggauauuagacuuacuaggguuccuaccaaaacacuacucagauucacuaaaucgauacgguaaauuuuuaaaugacaucgaauguaagcucccauggguaaaagacgagacaggaucuuacaaauucaucuuucaagaaucauuuaaagaaaugcuagcuaauuucacugaacaucauccaauauuaauagcaaacaacaagaaaguaccauacgauuggacaauauacuauuuaagaaaaaaagcgcuaacccaaaagauaucaaaagaggaauuagcauggauacuacuaaauuuuaaccaaaaaagaggauauuaccaauuaagaggagaggaggaagaaacaccaaacaaauuaguagaguauuacucacugaaaguagaaaagguugaagacagcggcgaaaagaagggaaaagauacuugguacaacguacauuuagaaaacggaaugauauaucgucgcaccuccaacauaccuuuagacugggagggaaaaacaaaagaauuuauaguaacuaccgaccuggaggcagacggaucccccaagaaagacaaagaagguaauauaaaaagaucauuucgagccccaaaagacgaugacuggacacuaauaaaaaaaaaaacagaagcugauauagauaaaauuaaaaugacaguaggggcauauauauaugacacacuuuugcaaaaaccagaucaaaaaauucgcggaaaauuaguaagaacuaucgaacguaaauauuauaaaaaugaauuauaccagauauuaaaaacacagagugaguuucaugaagaacuacgugacaaacaacuauacaucgcuugccugaacgaacuauauccgaacaaugaaccacgacguaauucaauaucaaccagagauuuuugccaucuauucauagaagacauuauuuucuaucaaagaccucuaaaaucgaaaaaaagucugauugauaacuguccauaugaagagaauagauacauagauaaagaaucuggugagaucaaacaugccuccauuaaguguaucgcaaaaucccacccauuauaccaagaauucaggcuguggcaauuuauuguaaacuuacggauauauagaaaggagaccgauguagauguaacccaagaauuauugccaacugaagcugacuacguaacccuauucgaauggcuaaacgaaaaaaaagaaauagaccaaaaagccuuuuucaaauauccaccauuuggauucaaaaaaaccacaagcaauuacagguggaauuauguugaggacaaaccauacccauguaacgaaacccacgcacaaaucauaaccagauugggaaaggcucauauaccaaaagcuuuucuauccaaggaaaaggaggaaaccuuauggcacauccucuacaguauagaagacaaacaagaaauagagaaagccuuacacagcuucgcaaauaaaaauaaucucucggaagaguucauagaacaauucaaaaacuucccuccuuuuaaaaaagaauacggauccuauagcgcaaaagcaauaaagaaacuacucccucuaaugagaaugggaaaauauuggagcauaaaaaacauagacaaugguacacgaauucgaauaaacaaaauaaucgacggagaauaugacgagaacauucgagaacggguccgacaaaaagccauaaaccuaacagauauaacacacuucagagcucuaccacuaugguuagcaugcuaccuaguauacgacagacacucugaaguaaaagacauagucaaauggaaaacacccaaagacauagaucucuaucucaaaucauucaaacaacacucucuuagaaauccaauagucgaacaagucauuacagagacacuacgaaccguaagggauauauggcaacaaguaggucauauugaugaaauccacauagaauuagguagagaaaugaaaagcccagccgacaaaagagcacgcaugucacaacaaaugauaaaaaaugaaaauacaaaccucaggauaaaagcucuacugacagaauuccuuaauccagaauuuggcauugaaaauguucguccuuauuccccuucacaacaagaccuauuaagaaucuacgaagaaggugucuuaaauuccauacuugaacuaccugaagauauuggaauuauacuagguaaauucaaccaaacagacacauugaaaagaccaacaagauccgaaauacucagauauaaacucuggcucgaacagaaauaucgcuccccuuacacuggcgaaaugauaccguuaagcaaacucuuuacuccagcuuacgagauagagcauaucauaccccagucaagauacuuugaugauagccuaucaaauaaagugauaugcgaaucggaaauaaacaaacuaaaagacaggagucuugguuaugaguuuaucaaaaaucaucacggagaaaagguagaacuagcauucgauaaacccgucgagguccuaagugucgaagcuuacgaaaaacucguccacgaaucuuacagccacaaccguaguaaaaugaaaaaacuauuaauggaagacauaccagaucaguuuauagaacgacaguuaaacgacagcagauacauuuccaaagugguaaaaucgcuucucaguaauaucguccgagaagaaaacgaacaagaagcaaucucaaagaauguaauaccuugcacagggggaaucaccgaccggcuaaagaaagauuggggaauaaacgauguuuggaauaaaaucgugcucccaagguuuauaagguuaaacgaacucacggaaagcacccgauuuacauccauuaauaccaauaacacuaugauuccaagcaugccacuagaguuacaaaaaggauucaauaaaaaacguauagaccacagacaucaugccauggacgcaauaaucauugccugugcaaaucgcaacauuguaaacuaucucaacaacgucagcgccaguaagaacaccaaaauuacacgacgcgaucuacaaaccuuacuaugucacaaagacaaaaccgacaacaaugguaauuauaaauggguaauagauaaaccuugggagacuuucacucaggauacauuaacagcacuacaaaaaaucacaguuaguuuuaagcaaaauuuaagaguaaucaacaaaacaacuaaucacuaccaacacuaugaaaacgguaaaaaaaucguaagcaaucaauccaaaggagacucaugggccauccgaaaaucaaugcauaaagagacaguccauggagaaguaaaccuaagaaugaucaaaacagucucuuuaaacgaagcacucaagaaaccacaagcaauagucgaaauggaccuuaagaaaaaaauauuagcuauguuagagcucggcuacgauacgaaaagaauaaaaaauuacuucgaggaaaauaaagacacauggcaagacauaaauccgucaaaaauaaaagucuacuacuuuacaaaagaaacaaaagauagauacuucgcagucagaaaaccaauagacacauccuuugauaaaaaaaaaauaaaagaaaguauaacugauacagggauacaacaaauuaugcugagacaucuagaaacuaaagauaacgacccaacccuagccuuuucaccugauggaauugaugaaaugaaccgcaacauccuuauauuaaauaaaggaaaaaaacaccagccgauauacaaaguccgcguuuacgaaaaggcagaaaaauuuacugucggucagaaaggcaacaaacgcacgaaauucguagaagccgcaaagggcacaaaccuauucuucgcgauauacgaaacagaagagauugauaaagauacaaaaaaagucauaaggaaaagaucuuauucaacaauaccccuuaacguaguaauagaaaggcagaaacaagguuuaucuucagccccagaagaugaaaauggaaauuugccaaaauacauccuuagcccaaacgauuuaguauacguaccgacacaagaggaaaucaauaaaggagaaguagucaugccaauagacagagaucgaauuuauaaaaugguagauucuagcgggauaacggcgaauuucauaccggcaagcacagccaaccucaucuucgcacuaccaaaagcaacugcagaaaucuacuguaacggagaaaauugcauacaaaaugaguauggaauugguaguccacagagcaaaaaccagaaagcaauuaccggagaaaugguaaaagagauaugcuuuccuaucaaagucgaccggcuugggaauauaauacagguaggcucaugcauccucacuaauuga

SEQ ID NO: 5759 - RNA, 4575 nt, Artificial Sequence
  Cas9 variant
augaacaaaauccuaggguuagaucuagggacaaacaguauaggaugggcaauaguacaaaaagacgaacaaggauucuaugagaaaauaauaaacgccggaaguagaauaauuccuauggacgcagaaacaaugaauaauuucaacaaaggaaucacgaaaaguccagcaagcgaacgaacucgauuuagaggagccagaagacucauagaacgaucccuguugagacgcgagagaauacauagauuauuaaacacaaugaacuacuugccuccacauuacgcugaaaagauagauuuugucaaccgauuaggaaaauucaucggcgaagaagaaccuaaauacgcguauaaaguagaugaacacggaaaauuccaauuuaucuucaaagagagcuuuaacgaaaugcuuaaagauuuucaagauaaacaaccagaauuaguauuaaacaauaagaaagucccauaugauuggacgauauauuacuuaaggaagaaagcacuaaaucgagcaaucucaaaagaagaacuagguuggauaauacuacaauucaacaacaaaagagguuauuaucaacuacgaggagaagaagacgaaacauuaacggaaggacaaaagaaagaauacuuugcuuugaaaguaauaagaguggaagcugacucaagcagcgcuggcaagaaaggagaaguaugguauaacguccaguuagaaaauggcuggauauauagauguaaauccgaaauaccauuagacugggaaggaaaaauaaaagaauuuaucguaacaacagaaguagaugaaaacgacaauguguuaaaagacaaagaaggaaaagagaaaagaaaacuaaaaauaccagaagcaggcgacuggacacuccugaaaaagaaaacagaauccgaccuagacaaaagcgggaaaacuguaggagcauauauuuaugacacgcucuuaucaaacccagaccagaaaaucaaagguggacuaauacggacaauugaaagggaacuauacagauccgaacuggaacaaauacuggauaaacagaaagaauuucacccagaauuaaaagauggcacacuauacaauaaaugcguagaagaauuguacagaucgaaugaaagucgucgaauaucccuaaguaauuaugauuuuaccagauuuauaacagaagacguuaucuuuuaucagagaccuuuaaaaagcaagaaaaguuugaucgacaacugcagcuuugaaagacgcaauuaucuaaauccaauaacgaaagaacuagcauaugcacccauaaaauguauagcuaaaagccauccccuauuccaagaauuucgccuuuggcaauucaucaaaaaucuacgaaucauugaaagagagaaaauaguuggugauaaauuaauguuugaccaagaugugacaacugaguuccuuccaacacaaaaugauuacgugauauuguucgauugguuaaacgagcacaaagaaauagaucaaaaagcacuccucaaauaucccgcauuuaacuuaaagaaaaauauagacaaauacagauggaacuauguagagaauaaaucguacccaugcaacgaaacaagagcucuacuaaaagcgaaauuaaauaaagcugggaacauaccaagcgacuuccuggacaaugauacguuagaaucccuuuggcacauacuauauuccguagaagacaaauuugaaaucgaaaaagcacuaaaaucauuugcuaccaagaaagaauugagagaagaacaaacaguagcuuucguaaaacaauuuauaaacauaccaccauucaagaaagaauacgguucguauagugcuaaagccaucaagaaacuauuacaauuaaugaggaugggcagccgauggagugagaacgagauauccgacucaacaaaagaucguauccagaaacuaauagacggugagugggacgaaucaauaaaaaccaggaccagggauaaagccauuaaacuaaaugaaauaaacgacuuccaaggacuaccucuauggcuugcgucauacauagucuacgauagacacagcgaaaguggagacguaaugaaaugggaaacaccagaagauauagauuauuauuugaagcacgucuuuaagcagcauggcuuaaggaacccuaucguagaaguaguaguuguugaaacccucaaagucguaaaagaucucuggaaaaccuauggauacuucaacgaaauacauauagaacucggacgagaaaugaagaaccccgcugauaagagaagaaguaugacgaacaaaaauauagaaaaugaaaacacuaauuuaagaaucaaagcacugcucgcagaacuagccaaucauaaagauguagaaggaguucgcccguacagccccucucaacaagaaauacugaaaauauaugaagaagggguacuagacauguuaaccaaagaagacccagauuacgaaucaaucagcaaaaucucgaaaauggcuuugccuagcaguucagaauuaauaagauacaaaugcuggcuagaacaaaaauacagaagccccuauacaggccaaguaauaccgcuggcaagacuuuucacuagcgaauacgagaucgaacauauaauaccccaaucaagauauuuugaugauaguuuuaguaacaaaguuauaugcgaguccgcagugaacaaggacaaagacaauuuacucgcauacgaauauauuaaacaaaaugaaggcaaaauaauagaaauaggucuaggcaagaaaguaaaacuauuuaccgcagacaguuauacagaauuuguacaauccaauuacgucgggaguguagccaagaagaagaaauuauuaauggacacuauaccagauucauuuaucaaaagacaacuaaacgacucaagguacauaucuagagaaauaaugaaacuauuaucaaguguggugagagagaaagaagaagaagaagaagaagaagaagaagaagcaauaucgaaaaauguaauaguaugcacuggggcaauaacagacaaauugaaacgcgaaugggguuuaaaugaugucuggaauacuauuauauacccucgcuuugaaagacuaaaucaguugacgaacagcgauaaauuuggacaaugggaaaacaagcaagguaagaaaguguuucaaauagaaaugcccuuaaaacuccaaaaaggauuuaauaagaaaagaauagaucaccgucaucacgcaauggaugcaauaguuaucgcaugugcaacccaaucucaugucaacuacuuaaacaaugaaagugcacacucaaauucaaaagagaaaagauauuacuuaagaagaaagcuccggagaauugaaauacucgaaaaacaagaacuaaaagacggggucacaauaaccaagaaaaucgaaguagccaaagaguucaacaaacccuggccaacuuuuacacaagaugcacaugaaguguuacaaucaauaauaguuaguuucaaacaaaauuuaagaguugugaauaaagccacaaacagauacgcuugcuuuguuaauggaaagaaggaaauaguaaaacaaucaaaaggagaaaguugggccauucgaaaacccaugcauaaggacacuguaucagccgcaguuucucuacgaaaaaucaagacaguaucauuaagccaggcaauagacgauuggacaaauauuguagacaaaagccuaagaaaagaaaucggcuuauuguacagcaaauauggucagaauggaucgaaaaauauuauaaaauacuuuaaggacagagacaacaagcauaacggccuagacguaagcaaagucaauguccacuacuucgacaacgacuacgcagcaucuagaguugcauuggaccacaaauucaauucagcaaaaauaaaaagcauuacagacacggggauccaaacaauauuguuaaaacauuuagaaucauauaacgaaauaaacggcgauaaaauaauagaacaucccgaauuagcauuuagcgcugacggguuagacauacuaaacgcuaauauaaccaaacuaaacaaugguaaauuccacaagccaauaaagaaaguucgaaaaaccgaaacacuugguuuaaaguucauaguaggacaaacaggaaauaaaagaaagaaauacguagaagccgcugacggcacaaaucuauucuuugcaauauacguaagcguagauggaauuagaucauauaaaaccaucccauuacgcgaaguugcggaaagacucaaagaaggcuuaauaccuguaccagagaaaaaugacaaagacgaccacuugcuguuuuggcuaucgccaggagaccuuguguauguaccaucaauagaagaagaaggccgaauaguggaaauagagaacauaaaacaagaucgaauauauaaagucguauccuguacagaaaacgaaugucacuguaucccgcauuucguagcauccccaauaguaaaaacagaugaacugggagcuaauaauaaagcacaacgugcauggucaggagagaugauaaaagaaacgugcauuaaaauaaaaaugaaucgacuaggacaaaucgucaaaauuuga

SEQ ID NO: 5760 - RNA, 4581 nt, Artificial Sequence
  Cas9 variant
augaagaaaauacuuggacucgaucuagguaccaauucaauuggaugggcaguccucaacgcagcugaugauaacuccuuaaaauacauagaagcugccgggagucgaauaauaccaauggaugcugcaauucucggagauuuugaucgagguaacucaauaucacaaacggcggaacgaacgagaauuagaggaaugagacaucugcgagaaagauacuuacuacgcagagccagacuucaccgaauuuuaaacuuauuaggauuuuuaccauuccacuaugcacaagauauagacagguacgguaauuucucagccgacauggaaccaaaaauugcuuggaggaaaaaccuggaaggggaacucgaauuuauauucauagaaaguuucaacgaaauguuagaagacuuucgcaaaaaccaaccggagcuaguagcagacaauaagaaaguucccuacgauugggugauuuacuaccuuagaaagaaagcguuagagaagaaaauaucaaaagaagaauuagccuggauucuuuuaaacuucaaccaaaaacgagguuauuaccaauuacgcggagaagaugacgaugagucuaugaaaacggccaaaacaagacaguauuucgacaaacaaauaaucaaaaacauaauagacacuaaucaaacguauaaaggccaacgaauauuaauaguagaacuccaaaauggagacaaaggaaaaauuuucaagaaagaaauuccagacuggauagggcaagagaaaaacauaauagugaccguugauauagacaaagacggcaaugacaaauacgaagaaucaggaaguuuaagcugccguuucaaaauacccaccgaugcugaaugggaaagcgaauggaaauuaauaaaaaugaaaacgcaaaaagaccuagacgaaucuaacaaaaccguuggaaccuacaucuaugacucgauuuugcaaaauccuacacagaaaguacggggaaaauuaguucgcacgauagaaagaaaauacuauaaagcagaacuaaaacaaauacuagaaaaacaaacagaauuucacagcgaauugcaagauaaagauuuguacaucgaaugucugaaugaauuauacucuaauaacgauacacaccgaaacgcaauaacugacagagacuucguauaucuauuuaugaaugauaucuuauucuaucaaagaccauuaaaaagcaagaaaucauugauagauaacuguccauacgaaagaaauauuuacauagauaaagaaacaggagagauaaaauacucaccuaucaaaugcauagcaaaaagucauccucuauuucaagaguucagauuauggaaguuuaucucaucaauccgcauauaccaaagggaaucugucguagaaguagucgauaaacaacuagacuuauucaguucacaaagcacaagcguacaaaaauuaguaacagacguagacguaacagacaaauuucuaacaugugaaaacgacuacgucgcacuauucgaauggcuuaacaagaagaaaauaauagaucagaaagaguucuuaaaauaccgcccauuuggucuuaaaggugacauagauaauuauagauggaauuauguggaagauaaaagcuaucccugcaaugaaacacaugcaaugauauugacuuacuuugccaaagcggggauauccgaagauauacugaccaaagaaauggaagaagcgcucuggcacauccuguauucaguagaggacagacaagaaauaaccaaggcuuuaagaacauuugcgucaaaauaccacuuaucggauucguucgugaaaguauucucgaacauacccccauuuaagaaagaguacggaagcuacucagcuaaagccaucaagaaauuauugagccuaaugagaaugggaaaauauuggagcgaagacgcaaucgacgugaauacaagagagagaauagauaaaauagucacaggagaauaugacgagaaaauuagagauagaguccgagagaaaacgauuagacuaaacgacauaagacacuuccgggcccuuccagauugguuggcauguuacguaguauaugaccgccacucugagacaagagaaaucacagaauggaaaagcccagaagaaauagaugaauauauaagaaacuucaaacaacacagucugcgaaaucccauagucgaacaaguaauaacagaaacauuacgcacgguaagagacaucuggaaacagguugggugcauagaugaaauucauguagaacugggcagagaaaugaaaaaccccgcagauaaaagaaaaagaauuacuucgcaaauaauagaaaacgaaaaugccaaccuuagaguaaaagcauuacucacagaguucguaaacccagaauuugaaauagaaaacguaaggccauacaguuugggccaacaagacauauuaagaauauacgaagacggaguauuaaacagcgucgcugaggucccaggggauaucgccgggauucuuaagaaauuuaaugaaaaugacgccaagaaacgaccgacaacaagugaaauccuaagauacaaauuaugguuagaacaaaaauauaggucuccauacacaggcgaaaugauaccuuuaucaaaacuauucacaagugcuuacgagauagaacaugucauaccucaaagcagauacuucgaugacucuuuuaguaacaaaguuauaugugaagcugaaguuaacaaacuaaaagacaaugcacuaggcuaugaauuuaucaagaaacaccacggcgaaaaaguagaauuagguuucggaaaaaucguagaaauauucucagucucaguguacgaacaauuuguuaaagacaacuacaguagaaaucggggaaaaaugaagaaacuacuaauggaugaaauacccgagcaauucauagaacgacagcuaaacgauucgagguauauaucaaaaguuguaaaaacguuacuaucaaacguaguucgcgaaaaagccgaacaagaagcugugagcaaaaauguuaucguauguaccggaggaguuacagauagauuaaagaaagacuggggaauaaaugauguuuggaacaaaauaguguuacccagauuucuucgucucaaugaauuaacaaauucaacaaauuucacagcuaaaaaugcagcaggaaacgaaauaccagcaaugccacuugaacuacaaaaaggcuuuaacaagaaaagaauagaccacagacaucacgcaauggacgcaauugucauagccugcgccaaucgaaacauaguaaauuaucuaaauaacgaaucagcgagcagaaaagccaaaauaagucgccaugaucuacaagcaauacuuugcgacaaaguaagaacugacgacaaaggcaacuaucaauggcgaguuaagaaaccaugggacaccuuuacucaagacgucuacguagcuuuagaaaauaucauagugucauucaaacaaaaccuucggguaauaaacaaaacaaguaacuacuauuggcauuaugaaaacggcaagaaaguguuagucaagcaaguaaagggugauagcugggccauaagaaaaccaaugcauaaggacacuguauucggagaaguaaauuugagaaaagugaaauccguaagucuuaacgaggcacuuaaaaacccucaauuuauuguagaaaaggaucuaaaaagacaacuacuaagccuauuacagcaaaacuucgacaucaagaaaauuaagaaauacuuugaagaacauaaagauauuuggucagacaucucccugucuaaaaugaauauauacuauuucaccaaagaaacgaaagaccgcuacuucgcaacuaggaaaccauuagacgcaucauuugauaagaagaaaauagaaaguugcauaacagauacgggaauccaacagauauuguuaaggcauuuagaacugaaagagaacgauccagaaagagccuucucaccagacggcauagacgagaugaacaggaauauuauucaacuaaacaaaggcaaaggacaccauccgauagcaaaaguacgagucuaugaaaaagcagauaaauuugaagucggucaaagagguaauaaaucuucaaaauucguagaagccgcaaaagguacaaaucuauucuuugcaguuuaugaaacagaauacccggaugagaaaacuaacucgauaguacgaaaaagaaacuaugcaaccauaccauuaaacauagccauagaaaggcagaaaagagggcuaucgacagcucccgaagaugaaaaagguaacguaccaucauuuguucuaucuccuaaugauuuaguauaucuuccuacaucugaagauauaguaaacggacauauaacacaaccgauagauaaaucacgaauauacaagaugguuucaagcagcggaucacaaugcuucuuuauaaaacacaauauagcuaacauaauaguagauaaauaugaauuuagcccacuaaauaaaauggaacgugcuauuucuaaugaaaugauaaaagaaauuuguauaccagucaaaguggaccgauuagguaauauaguaaaauuaggaaaauccgaguga

SEQ ID NO: 5761 - RNA, 4581 nt, Artificial Sequence
  Cas9 variant
augaagaaaauauuaggacuagaccuaggaacaaauucaauaggaugggcgguccuaaaugcugcggacgauaacucacuaaaauacauagaagcagccgggaguagaauaauaccaauggaugcagccauacuaggagacuucgauagagguaacaguauuucccaaacggcggaacguacgagaauacgaggaaugagacaucuaagagaaagauauuuacucaggagagcaagacuacauagaauacugaaucuacucgguuuccucccauuccacuaugcucaagauauugacagauacggaaauuuuucagcagacauggaaccgaaaauagcuugguguaaaaaccuagaaggcgaauuggaguucauauucauagagagcuucaacgaaauguuagaagacuuuaggaaaaaccaaccagaguuaguugcagauaacaagaaaguacccuaugauugggucauauacuacuuaagaaagaaagcucuggaaaagaaaauuucaaaagaagaauuagcuuggauacuacuaaacuucaaccagaaaagaggauacuaucaauuaaggggcgaagaugacgacgaaagcaugaaaacagcgaaaacacgacaauauuucgauaaacaaauuaucaaaaacaucauugauacaaaucagacauauaaaggacaaagaauacucauuguugaacuccaaaacggcgauaaagguaaaauuuuuaagaaagaaauaccugauuggaucggccaagagaaaaacaucauagucacuguagauauagacaaagauggcaaugauaaauacgaagaaucaggaaguuuaagcugucgauucaaaauuccaacagacgcugaaugggaaucggaauggaaacuuauaaaaaugaaaacacaaaaagaccuagacgaaucgaacaaaacaguagguacuuacaucuacgacagcauauugcaaaaucccacacaaaaaguacgaggaaaauuaguacgaacaauagaacgaaaauauuauaaagccgaacuuaaacaaauucuagaaaaacaaacagaauuucacagugaacuacaagacaaagaccuauauauagaauguuuaaacgaauuauauucaaacaaugauacacaccgcaacgcaauuacagacagagacuuuguguaccuauucaugaacgacauuuuauuuuaccaacguccuuuaaaauccaagaaaagucucauagauaacuguccauacgaaagaaacauauauauagacaaagaaaccggggagaucaaguauuugccaaucaaaugcaucgcuaaaagccacccucuauuucaagaauuuagauuguggaaauucauaucuagcauucgaaucuaucaaagggaaucagucguugaagugguggacaaacaauuagaucucuuuaguucccaaucaaccucuguacaaaaacuugugacggauguugacgucacagauaaauuccuaacaugugaaaacgacuacgucgcccucuucgaauggcuaaacaagaagaaaauuauagaucaaaaagaauuucuaaaauacagaccguucggacuaaaaggcgacauagauaauuaucguuggaacuacgucgaagacaagagcuacccauguaaugaaacucacgcuaugauauuaaccuauuucgcaaaagccgguauaagcgaagauauacuaacuaaagaaauggaagaagcguuauggcacauccuuuacucaguugaagaccgccaagaaauaacaaaagcccucagaacauuugcaucaaaauaccaucuauccgacaguuuuguaaaaguauucaguaauauacccccuuuuaagaaagaauacggaagcuacucugcaaaagcaauaaagaaacuauuaucauuaaugcgaaugggaaaauacugguccgaagacgcaauagacgugaacacaagagaaagaauugauaaaauaguaacaggugaauacgaugagaaaauaagggacagaguaagagagaaaacaaucagacuaaacgauauaaggcacuucagagcacugcccgacuggcucgcauguuacguaguauacgacagacauagcgaaacaagagaaauaacggaauggaaaagcccagaagaaauagaugaauauaucagaaacuuuaaacaacauagcuuacgcaacccgauagucgaacaaguaauaacagaaacucuaagaacagucagagauauauggaaacaaguuggauguauagacgaaauccacguagaacuaggacgagaaaugaaaaacccugcagauaaaagaaaaagaaucaccagucaaauaauagaaaacgaaaaugcuaaccuccgaguaaaagcguuacuuacagaauuuguaaaucccgaguucgaaauugaaaauguacgaccguauagucuaucacaacaagauauccuaagaauuuacgaggacggaguacuaaacuccguagcugaagucccaggcgauauagcuggcauacucaagaaauucaaugagaacgaugcaaagaaaagaccaacaacaagugaaauauuaagguauaaacuuugguuagaacaaaaauauagaucgccauauaccggcgaaaugauaccguuaucaaaauuauucacaagugcauaugaaauagaacauguaauuccccagagccgauacuuugaugacucauucucaaauaaaguaauaugcgaagcagaaguaaacaaauuaaaagacaaugcucuuggguacgaauuuauuaagaaacaccacggugaaaaaguagaacuugguuuuggcaaaauagucgagauauuuuccguaaguguguaugagcaauucguaaaagacaacuacucaagaaacagaggaaaaaugaagaaauuguugauggaugagauaccagaacaauuuauagaaaggcaacuaaaugauucaagauacauaaguaaaguugucaaaacacuacuuucgaacguaguccgagaaaaagcugaacaagaagcaguuagcaaaaacgucauuguaugcacugguggaguuacugauagacuaaagaaagauuggggaauaaaugauguuuggaauaaaauaguauuaccaagauuucuaagacuuaacgaauuaacaaacucgacuaauuucacugccaaaaacgccgcuggaaaugaaauaccugccaugccacuagaauuacagaaaggcuuuaauaagaaaagaauugaucaccgucaccacgcuauggacgcaauuguaauagcuugugcaaaucgcaacauagucaauuaucucaacaaugaaagugcaagucgaaaagcaaaaaucucgagacaugaccuacaagcgauauuaugugauaaaguaagaacugaugacaaaggaaacuaccaguggagagucaagaaaccaugggacacauuuacgcaagauguauacguugcucuagaaaauauaauuguuuccuucaaacaaaauuuacgaguaauuaacaaaacaucaaacuauuacuggcacuaugaaaauggcaagaaaguccuaguaaaacaaguaaaaggagacucaugggcaauccgcaaacccaugcacaaagauacaguuuucggcgaaguaaacuuaagaaaaguaaaaucuguaucacucaacgaagcccuuaaaaacccccaauuuauaguugaaaaagaucuaaaaagacaacuauuaucauuacuacaacaaaacuuugauaucaagaaaaucaagaaauauuucgaagaacacaaagauaucuggucagauauuucccucaguaaaaugaauauauauuauuucaccaaagaaacuaaagacagauauuuugcaacccguaaaccgcuagaugcaucauucgacaaaaagaaaauagaaucauguaucacagauaccgggauacaacaaauccuacuucggcacuuagaauuaaaagaaaacgauccugaacgagcauucucaccagacggcauagaugaaaugaauaggaacauaauacaauuaaauaaagguaaagggcaccacccgaucgcaaaggucagaguauacgaaaaagcagauaaauuugaaguaggucaacggggaaauaaaucaagcaaauuuguagaagcugcaaaaggaaccaaccuuuucuuugcgguauaugaaaccgaauauccagaugagaaaacaaacucuauagucaggaaacgaaauuacgcaaccauaccuuuaaauauagccauugaacgccagaaaagaggauuaucaacugcaccugaagacgaaaaagguaacguaccaucuuucguauuauccccaaaugauuuaguauaccuaccaaccucugaggacaucguaaauggucauaucacccaaccuauagacaaaucccgcauuuauaaaaugguaucaucaaguggaucccaaugcuuuuucauuaagcacaacauagcaaauauaaucguugacaaauaugaguucaguccacugaacaaaauggagagagcgauuaguaaugagaugauaaaagaaauuugcauacccgucaaaguagauagauuaggcaacauaguaaaacuaggaaaauccgaauga

SEQ ID NO: 5762 - RNA, 4584 nt, Artificial Sequence
  Cas9 variant
auggcaaagauauuaggacuagauuuaggaacaaauagcaucggaugggccauugucgaaaaagauggcaacgauuucagccuaguagauaaaggaguucgaaucuuuagugaagguguuaaaucagagaaagguauagaaucaagcagggcggcggaaagaaccggguauagaagcgccagaaaaauaaaauauaggagaaaacugaggaaauacgaaacgcugaaaguccuuaguuugaacggaaugugcccgcuauccauagaggaaguagaggaauggaaaaaaucaggcuuuaaagaauacccacugaauccggaauuccuggaguggcuuagaacuagugaugaugagaacaucaauccuuacuucuucagagauaaagcuucaaaacaaaaagucacucuuuucgaaguaggucgugcauuuuaccauauagcacagagaagaggauuuuuaagcaacagacucgaucaaucggcagaagguauacuagaggaacauugcccuaagaucgaagcucuaguggaagauuuaaacaguacggaugagauacuaacaucucuaaaagacuauuucuuugauacagguauuuuagaugcaaacgaaaaagguggauuugccaaagaucuagacgaaggagacaaaaaauugguaagucuauauagaucuauacaagcaauaguuaaaaaaaacgacacggacuuugaaaaagguaaggcagaaauaauugaaagacuuaacaagaaagacguguugggaaaaguaaaaggcaaaaucaaagauauaucacaagccaugcuagaaggaaauuucaagacucuuggccaauacuucuucagccuguauaacaaagaacgaaucagaaaccaauacacuucacgagaagaccauuaccuagaggaauucaaaauaauaugcaaauuccaaggcauagguaguauuaaucaaaacgaaaaacuacccgaaaaaaaauuugagggauuggcuaaagaacuguauaaagcaauuuucuuccaacgaccccuaaaaagccaaaaagggcucauagguaaaugcucuuuugagaaaucaaagagcagaugcgcuauaagucacccagauuuugaagaaaaaagaaugugggaauaucuuaacacaauaaaaauuggaacccaaagcgaaaaaguguuaagauuuuuaagccaagaagagaaauuaaacuuaauuccgaaguuccucagaaaaaaagauaacuucaacuuugaagacuuagcaaaagaacuaauagaaaaaggcgcgacauucggcuuuuacaaaagcagcaaacgggauucuuuccauuacugguucaauuacaaaccaacugacacaguaucaggaugcccaguaucugcgagucugaaaaguguaguuggcgaagauuggaaaacuaagaguuucauauauaaaacgaccaauagcaaagggauagaaguaucuagaacgguaaauuacaaagacuuauggcauuuauugagcgucucaacuucggacaucuaccuauacgaauacgcaaaaaacaaacugggacuugaagacaagaaugccaaagccuucuccaaaaucaagcugaaaaaagauuuugguaaccucucauuaaacgcaauaaacaaaauacuacccuauaugagagaaggucuacuauacucacacgcagucuucauggcaaacauagagaguaucguagaugaaguuauauggaacgacuuaggucaacguaaauacauacaagauaaaauagcagcuaucauugcuaacaacaucguggauaacggucuauuagaagugguaaacggcuuaauaaaggagugcaaaguugacggagcguacuauucaaaagaagcagccgacacauaccgaaaagaucugagcaaaaaauuagucagcuuuuuuaaauuucaccauauugaugauggaauaaaacaagaaaccaucuugaacgaauuauucccaguguucauagaacaacucaaagcacacgaauucaucaagguuaaaagacuagacgagaaagucuuagaauuccugaaaggugagaaucaagacggagaaguauucugcaacaaugcaaaacaacucaaaaaacuguaucacccauccgacauagaaguauuuaagaaacaaauagucaaagacaaagauggcacugaaacuggucaauuaauauuagggaguccccucaccaguucgauuaaaaauccgauggccaugcgugcgcuacaucaguuaagaaaaguacucaacacauugauaguggaagaacaaguagauaguuccacgcgaauucacauagaaauggcaagagaacuaaaugaugcaaacaaacggaaggguauucaagauuaucaaaaugaaaacaaaaaagagagagaaaaguacagagaugaaauaaaaaaacuauacuuagcagaauguaacaaagaaauagagcccacaguggacgaucuauuacgguaccaacucuggauagaacaagacagaaaagaaauauaugaaaacgggaauaguauuagcauaugcgauauaauaggugauaacccagcauacgacauagaacacacgguaccuagaucaauaagccaagauaauucacaaaugaacaaaacauuauguucacaaaaauucaacagagauguaaagaaacagaaaaugccauuugaacuagggaaccaucuggaaauacuuccucguaucgcucauuggaaagaagaagcagacaacuuaagcagagaaauugaaaugauaauacggucaacaaaaacggcagccacaaaagaagccaaagacaagaagaucagaagacggcacuauuuaaccuuaagaagagacuacuuacaggguaaauacgacagguucauuuggacagagccaaaaguaggauuuaaaaacagucaaauacccgauacaggaauuauaacacgguaugcacaagcauaucuuaaaucauauuucaauagagucgaaucaguaaaaggaggcaugguagccgaauuucguaagauaugggggauacaagaaucauaccaggaaaauggcaaaaaauacuucaaagagaaagauagaucaaaacauacacaccauacuauagacgccauaacuauagcaugcaugaccaaagacaaauaugacguucuggcacacgcuuggacacuggaagauaaagaacaaauaacagaggcucguaaaaucguggcugaaucaaaaccguggaaaacuuucaaagaggaccugaaaaaaauagaagaaggcauccuuguuucacacuauacaccagauaacguaaaaaaacaaagcaaaaaaauugucagggugagaggaagaaaacaauacguagcagaaauagaaagagauguaaauggaaaagcaguggcaaagaaagauauuucaggaaaaguaauauauaaacuggacaaagaugguaaaaaauuaccgcgacugcaacaaggagauacaaucaggggaucacuacaucaagauucaauauacggcgcaauaaaaaauccauuaaaaacagaagagauacgauauguaauccguaaagaucucgaauccauaaaagcaucagauguagacaauauaguagaugaaaugguaaaagaaaaagugaaagaagcaauugccucaaaagugcuaauacuaagcucaaacccacaacaaaaaaacaaaaucgauggaaaaguauggaugaacgaggagaaagguauaccaauaaacaaaguacgauuauaugcaaauucaguaaaaaacccacuagagauuaaagaacauaguucacucucaaagucacgucacgaacacaaacaaaaaguuuauggacagaaugaugagaauuucgcaauggccauauacgaaggucucgauaaaaaaggaaaaacggaaagagccuucgaacuaauaaacuacauggaugcaggauauuacuacaaacuaaaaaauaaaaacgaaaggaaaaaagauauaauaucacugguaccggaaaaacauaucgaaacgggcuuuaaucuacugagaucgaauaaaauccccauaauuuuaaaaaaaggauuaaauguuaucuuauauaaaaacgagaaagaggaaaucgauuucaauaauccuaacaguauaauuaaaagguuauacaaaauaaguggauuagauaaggacggcauuaaauugauguacugcauaagcgcuaaaggaucuacagaaaacaucgcuuauaugaaugacgucauuaacaaacaaaaacuguuugagcucaaaucggaaauggaaaaauuaggacuaugggauaagguuuucagugacuuuaaaaacgacaaucuaaaaaaaagugacuuuuucaaaaaacuaaaugaucuauugaauaaacacuacuucgagaauaaugugugugacucaauaggauccauaaagaagguaaaaaucaaagaaucaggacuaacaaccccaaaaggaggugacguaauagauaacuuuaaggacuucccguacauuaaauucaaaguguccaacuucaaugcauuaauagagggaaucgacuuuaaaauuucgccaacuggaaaauuuguacaaauauga

SEQ ID NO: 5763 - RNA, 4587 nt, Artificial Sequence
  Cas9 variant
augaagaaaauucuuggauuagaucuaggcacaaacagcauagggugggcacuuguagaacaagauuuuaaaaauaaacaagguaauaucaugggaaugggaucucgaguuauaccaaugucacaagaaauacucggagaauuugcacgaggaaauacuaaaucagaaaccgcagaacguacacgauugagaucaguaagaagauuaagagaaagacacuuacuuagaagagaacgucuacacagaguucuacauauccugggcuuccuuccaaaacacuaugugaaccaaauagauuuccaagaaaggcugggaaaauucuuugaagaaagcgaaccuaaacuagcguacgauacaggagauuucuuauucaaaccgucuuuccuugaaaugcuagaagaauuuaaaauacaucaaccgagcuuuguugaaggugacaagaaaguuccauaugacuggacaauauacuucuugaggaagaaagcccuaacggaacgaauugaaaaagaagaauuagccuggguuauacucaguuuuaaccagaaacgaggauauuaucaacuucggggagaagacgaagaagaaaaaccaaauaaacucgaagaauuuuacucucugaaaauuguggauauuaaaguagacgaaucuccgaauaagaaaggagacacaugguauaguuuaacuuuagaaaauggauggauauauagaagauccucgaaaguuccguuggaugauuggcuaggcaaaacacgagacuucauuguaacuacagacauagaugaagaagguaacccaaaacuagacaaagagggaaauccgaaaaggagcuucagagcccccagcgaagacgauuggggacuaagaaagaagaaaacagagaaagaaauacuggauucaucaaaaacaguuggccauuuuaucuucgagaaccuacuagcagaucccacacagaaaauaaaagggagauuaguacgaacaauagaaagaaaauucuacaaagacgaacugaaacaaauccuaguaucgcaaaauagauuucaccccgaguugucagacgcagauaugauggccgauuguguaagagaacuauauaaacauaaccauucacaucaaaauuuccuagcaagcaaagauaucaaacaucuacuuguagacgauauaauauucuaucaaaggccacuaagaagccaaaagucaacaauaggaaauugccccuuggaauuuaaaacauuuaagaaagacggaaucgagauaaaaguaccauauaaaguggcaccuaagucgcacccuuuauuucaagaguucagacuacuacaaugggugucaucauuacgaauaauuagaaaaucugacgauuccgauguaacgagggaguuccuaggcacgcaagauaaaacaaaacaacucuuggauuacuuaaugacacaaucugaaauggacuguaacaaauuaaugaccuuuuuacugacacaagaggguuacaaaagaaaagacuugaagucagaaguuggaaaauuuagauggaauuauguauuugacucugaaacuggagaaucaaaaacuuacccaggaaauagcacaagagcagaguuucucaagcgacuaggcaaaguagaaggauucgauuucucgaaauauacagaagaauuugaagaaucucuuuggcauuugguauacaguguuaccgacaaaguagaguucgaaaaagcccuaagaaaauuuaguaggaaaaacggaauagaaaucaacaguuuugucgaaaaccucaagaaauucccaccuuacaagucugaauaugcgucuuauucauuaaaagcaauaaagaaauugcucgcccugaugcguuucggggaaaauuggaaagaagacaguauugauucuauaaguaaacaccgaaucgagaaaauauuaacaggugaauacgauccagaaauaaaagacaaaguaagagaaauaucucgagcguuugaugaaguagaagacuuucaaggacuaccaguuugguuugcaaauuacguaguuuacggacgucacagugaagcgucugaauugauaaaauggacaagcagugacgaaauggcagacuuuauaaaagaauuuaaacaacacucucugcguaauccaauaguagaacaaguaguguuagagacauuacgaguagugaaagauauuugggacaaauacggucauggacaaaaagacuucuuugacgaaauacauguagagcuggggagagaacuaaagaacccugcagaacaacgggcuaggcuaacuacacaaauaucugcaaaugaaaauacuaauuuaagaauaaaaaguuuauuaguggaacuauuacacgacccaggaguggaaaaugugagacccuacucaccaaugcagcaagaaauauugaaaauauaugaagaaggcguacuuaaaucaaguuucgaaguaccggacgauauucuuaaaauaucaaaaacggcacaaccgaguagcucagauuuaaaaagauauaaacuaugguuggaacaaaaauauagaaguccauacacaggaaaaauaauaccauuaaacaagcuauuuaccccugcauaugaaguugaacauguaauaccccaaagcagguacuucgacgacaguuucucuaauaaagucauaugcgaagcagcugugaacaaacuaaaagacaauagauuagguauggaauuuauaaaaugcuuucacggccaaagaguaucauuaggauucggggaagaagucgaaauauuuagugagucugcauacaaggcuuuuauacaagauaacuucccgaaaaauccugcgaagaaacgaaaacuacuaauggacgagcucccugaacaaaugguagaaagacaaaugaaugauacaagauacauuagcaaguucguaacaagcauuuuauccaacauaguucgcagugaagagaaugacaccggcuuuaauagcaaaaauauuauuccuggcaauggcaaaauaacuacagcucugaaacaagauuggggucuaaaugacguauggaacgaauuaauuuuaccacgcuucgagcgaaugaaucaacugacagguaccacgguguucacagccuggaaugagaaucaccaaaaauucuugcccacaguuccacucgaauaugccaaaggauuucagaagaaaagaauagaccaucgacaucacgccauggaugcccuuguuaucgcaugcgccacaagagaccacguaaacuaccuaaauaaugaacacgcauugggcaaaaacuacaagggaaaagaggaaaaacaaucacgucgauuugacuuaaggcagaaacuaugccugaagaagaaaaaugggcacagccaagaacaauacgaauggauauuuagcaaaccuugggauucauuuacccaagaugccaagaaaaaucuugagagaaucauaguuaguuuuaaacagaacuuaagagucaucaauaagacuucaaacaaauaucuaucuuauaaagacgaggaggguaaucuaagacuugauucacaaggcaagcccguaaaagcauuaacgaggcaaauaaaaggagaugcaugggcaauacgcaaaucaauucacaaagauacagucucuggccuugugaagcucagaagaguaaaaaugguaaaccuaaguguagcauuagacaacccagaaaacauauuaaauaagaaacuuaaaaagaaaauugcagaacucguaaaacuaaauuaugacaauaaauuacucuuaaaauauuuucgugaucgcgacuacauguucgacggacgugaagucucaaaacuagauguauauuacuuugaagagggcuuggcugcuucuaggguuucacuggacacaaguuuuucggacaagaaaauacaauccauaacagacacagguauacgcaaaauauuauuggcucacuuagcaaacuaccacggaagacucgacgaaaaagggaaagucauuccuccagaaacauuagcuuuuacgccagagggcauugaagaacugaacaaaaauauaaaaggucucaauggaggaaaauuccaucaaccaauauuuaaaguucguacuuacgaacccaaagguaauaaauuccaaguaggcuucaaagggaacaaaaacucuaaauaugucgaagcagcaaaaggaacgaaccuauucuuugcuaucuaucuuaaugacgaaggaaaacgaucauaugaaacaauuccauucaacgucguaauggagagauuaaaacaaggugaaggaccaguaccacaaaccaacgagaaagggggaaaacuguuauuucaucucucuccaaacgaauuggucuacgucccagaaacugacgaaaauuacaccaauguagauuucaaaaauuuaaguaaagaacaaguagagaaaauuuacaaaauggugucaaguacagggucugaaugccauuuuguucgagcagauauaucuagcuuaauuaaagguuacgaugccaaaaccaaaguaggagaacuaggaucacucaauaaacaagaaguaacaaauaauggaaugacuagaauuaaagaaaaaugcuggaaaauaaaaauugauagacuaggaaguauauga

SEQ ID NO: 5764 - RNA, 4587 nt, Artificial Sequence
  Cas9 variant
augaaaaaaauccuaggcauagaucucggaacuaauucaauuggcugggcaguagucaacaguuucgacgaaaaucaaaaugaagaaagccuuaaacauauugaauguguuggcuccagaaucauaccaauggaugcugcaauacugggagacuuugacaaaggcaauucuauaagucaaacagcaaagagaacagaauuuaggagcguaagacaccuaagagaacgacauuuacucaggcgagcaagauuacauaaaauacuaagccugcucggcuucuuaccagaucacuacguacaagacuuagauucucauggcaauuucccagugaacguagagccgaaaauugcauggaggaaggacucaaacggagcauuugaguucauauuuaacgauaguuuugacgaaaugcuccaagacuuugcaacguaucaaccugagcuaauagcaugcaacaaaaaaguaccauaugauuggaccauauauuacuugagaaaaaaagcgcucacuaaaaaauuaucgaaagaagaauuauccuggauacuccuaaauuuuaaucaaaaacgaggauauuaccaauugcgcggagaagaggacgaugaaucuguaaaaagcgcaaaaaccaggcaguauuuugacagacaaaaaauuaagagcauaguagauacaaaccaaacauauaaaggccaaaaaguacugauuguugaauuggaagacgguauuaaaggaaagauauucaaaaaagaaauuccaaacuggguaggacaagaaaaaaguaucauaguaacuaucgauauugauaaggacggaugcgauaaauacgaagaaaguggcgaacuaaguugcagguucaaaauucccucagaugcggaaugggaaucagaauggaaacuuauaaagaugaaaacacaaaaagacuuggacgcaagcggcaaaacaguaggggcguacaucuaugacgcaauauuacaaaacccaagccagaagauucgaggaaaacuaguacguacaauagaacgcaaauauuauaaagaagaacucaaacagauauuaaaaaagcaagucgaauuucacccagaauuaagagacaaggaucuauuccuggacugcuuaaaugaacuuuauccaaacaaugaugcacaucguaacgcaugugcagacagagauuucauauacuuauuuauggacgauauucuuuuuuaccagagaccuuuaaaaaguaaaaaaagucucaucgcagauuguccauaugaaaaacacauguacagagauaaagaaaccggcgaauuaaaauauuccagcgucaaaugcauagcaaagucccauccauuauuucaagaguuuagauuauggcauuuuauaucaaacauacgaauauaucagaaagaacgaguaguagacguagaugcugaccaaucagcgcucucuucagcacgauccgcacugaagucaaaauuagaggcugacguugauguaacaaaugaauuucuaacaugcgaagcugacuacgucucguuguucgaauggcucaacaauaaaaaaagcguuucccaaaaagacuucuuaaaauaccccgcauucggaauaaaaaagucuggggauaauuacagauggaauuauguagaagauaaaucuuauccauguaacgagacaagagcucucauauuaucacaucuagagaaagcuaacauacggggagauauauucacacgcgaacaagaagaagcacuauggcacaucuuauauaguguugaagaccgguaugagauaguaaaagccuugcaaucuuuugccgccaaauauagauuuaaugacgacuuugugacagucuucagcaaauucccaccuuuuaagaaagaauacggaucauacucugcuaaagcaauaaaaaaauuauuaccacuaaugagaaugggaaaauauugguccgaagcagcaauugauaucaaaacacgagaacguauagaaaaaauaauuacaggagaaugcgacgacuccauuagagagagaguacggcuuaaagcgauacgcuuacaugauauaggagacuuccgcgcacuaccagugugguuagccugcuauguaguauaugauagacauuccgagucgggagauauaacgaaauggaaaacgccucaagaaauggacugguacauacaaaauuuuaaacaacacucucuaagaaauccaauuguugaacaagucauuacggaaacauuacgcguagucagagauauuuggaaacaaguaggcagaauagaugaaauacacguggaauuaggacgugaaaugaaaaacccagccgacaagagggcaaaaaugaccgcacgaaugauagaaaaugagaacaccaauuugagaauaaaagcuauguuaaccgaauuucucaacccagaauucgaaauagaaaauguacgaccauacuccgcaagccaacaagauauuuuaagaauauaugaaaacggagucuuaaacucaguaagcgaaauacccgaggaaauaaccgguauacucaaaaaauucaacgaaagagaacaaagaaaaagacccucaacuucagaagugcuacgcuauaaacuauggcuagagcaaaaauaccgaucaccauauaccggaaagaugauaccucuuggaaaauuguucacaccagcuuacgaaauagaacauauaaucccacaaaguagauauuucgacgauucguuuaacaacaaaguaauaugugaagcagaaguaaauaaacuaaaggguaauuuacuaggauacgaauucauuaaaaaacaucauggacgaagaguugacuuaggacucggggaaauuguugauauauuuaguguugacgaguaugaaacauuuguuaaagacuauuacagugcgaaucagcagaaaaugaagaaauuacucauggaugaaaucccggaacaauuuauagagagacaacuuaaugacucucgauacaucucuaaaguaguaaaaucgcuauuaaguaacauaguuagagaacaagaugaacaagagucuauaaguaagaaccucaucgucuguacaggaggcgugacagaccggcucaagaaagauuggggcaucaacgacguauggaacaaauuaauauuaccaagauuccaaagacucaacaauaucacagaaaccaccgaguucacggcaaaaaacaugcaaggucaugaaauaccaguaguaccuuucgaauaucagagagguuucaacaagaaaagaaucgaccaccgucaccacgccauggacgcaauaguaauagccugugcaggucgaaacauaguuaauuaccucaauaaugaaagcgcccgaaaaaaagcacaaauaucccgauacgauuuacaaagacugcuaugcgauaaagucaaaaccgacgacaauggaaacuauaaauggauuuuaaaaaaaccauggucuacuuugacacaagacguauaugcugcacuugacaacguuauaguaucauuuaaacaaaauuuaagaguaauaaacaaaacaaauaaucauuacguucauuacgaagcugguaaaaaaaucauagcaaaacaggaaaaagcuucaugggccauacgaaaaccgaugcacaaggauacagucuucggugagguaaaucuacguaagguaaaaacuguuucacucaacgaagccauaaaaucgccccacuguauaguacaaaaagacuuuaaaaaaaaguuacucaguuuacuaaaacaaaauuucgacgcgaaagaaguaaaagcauauuucgaagaacauaaagauguaugguccgacauaaaccuauccaaaaucgaaguauauuacuucacaaaagacacaaaagaaagauuuuucgcgacuagaaaaccacuagacucaucauuugacagaaaaaaaauagagucuguaacagauacgggaauucaaaaaauauuguuacgacauuuagaacaaaaaaacggagauucagauuuagcauuuaguccagacggcauagaagaaaugaaucaaaacauaguacaauuaaacgggggcagaaaacaccaaccaauaguaaaaguacggguuuacgaaaaagccgauaaauuugcaauugggcaacaaggaaauaaggcgucaaaauacguagaagcugccaaaggaacgaaccuuuuuuuugcuguauaugaagaagaagucagagacaaaaaaacuaacgcaguaauguucaaaagaaacuaugcaucgauaccacugaacguugcgauagacagacagaaaaaaggacuuagcacagcuccggaagacgagaacggaaacgcacccauuuuuguacuuagcccaaaugaucuaguguaccucccaaccgcggaagauauaaucaaugcgcgaauaucauuuccaauaaauaaaaaccguauuuacaaaaugguaucauguacaggauaccaauguuucuuuauaaagcaccauguagcgaauguaauaguugauaagaaagaauuuucugcucuuaacaagauggaaaaagcggagacaaaugaaaugaucaaagauauauguguuccaauuaaacuagauagacucggaaauauaguaaaaaucgggguauacaaauga

SEQ ID NO: 5765 - RNA, 4587 nt, Artificial Sequence
  Cas9 variant
augaaaaaaauacuuggauuagauuuggggacuaauagcaucggaugggcaguuguaaauucauucgacgaaaaccagaacgaagagagucuuaaacauauugaauguguaggaucuagaauaauaccuauggacgccgcuauauuaggagacuucgacaaaggcaauucaauaagccaaacugcaaaaagaaccgaauuuagaucuguacgacaucuacgcgaaagacaccuauuacgacgagcaagacuacacaaaauacugagcuuguugggauuccuaccagaucauuauguacaggauuuagacucccacgggaauuucccagucaauguugaaccaaaaaucgcuuggcgcaaagacaguaauggcgcuuucgaauucauauuuaaugacaguuucgacgaaauguugcaagacuucgcgacauaccaaccugaacuaauagccugcaauaaaaaagucccauaugacuggacaauauauuaccuaagaaaaaaggcacucacaaaaaaguuaucuaaagaagaacuaucauggauucuacuaaacuuuaaccagaagcgagguuacuaccaauuacgaggugaagaagaugaugaaucaguaaagagcgcaaaaacaagacaauauuucgaccgacagaaaauaaaaucaauuguagauacaaaucagacauacaaaggucaaaaaguucucaucguagaguuagaagacggaaucaaagguaaaaucuucaaaaaagaaauucccaacugggugggacaggaaaaaucaaucauuguaaccauugacauugauaaagacggaugcgacaaauaugaagaaucuggagaacucagcugccgauucaaaaucccaagcgacgccgaaugggaaucugaauggaaacugauuaagaugaaaacccaaaaagacuuagacgcauccgguaaaacagugggagccuauauauacgaugccauuuuacaaaacccaucucagaaaauacgaggaaaacucguccgaacaauagaaaggaaauauuauaaagaggaauugaaacaaauacuaaaaaaacagguagaauuccacccagaacugcgugauaaagauuuauucuuagacugucuaaacgaauuauauccaaacaacgaugcucacagaaacgcgugcgcagacagggauuuuauauaccucuuuauggaugauauucuauucuaucaaagaccacuuaaaucaaagaagucucuaauugcggauugccccuacgagaaacauauguauagagacaaagaaacaggcgagcuaaaauauagcucuguaaaauguaucgcaaaaagccauccacuuuuccaagaauuccgacuguggcauuucauaucgaauauaagaauuuaccaaaaggaacguguagucgauguggacgcaugccagccugaucuuucguccgcgagaagugcauuaaaaucaaaacuagaggcagacguugacguuacuaaugaauuucucaccugugaagcagauuacgugaguuuauuugaaugguuaaauaauaaaaaaagcgucucacaaaaagauuuucuuaaauacccugcauuuggcauaaaaaaaucaggggauaacuaucgcuggaacuacguggaagacaaaagcuacccaugcaacgaaacuagagcacuaaucuuaagucaccucgaaaaagcaaacauaagaggugacauauuuacaagagagcaagaagaagcauuauggcauauuuuauacuccguagaagacagauaugagaucguuaaagcacugcaaucauuugccgcuaaauaucgcuucaaugaugauuuuguaaccguauucucaaaguuuccaccauucaagaaagaauacggaaguuauagcgcuaaagcuauuaaaaaacuacucccacucaugagaaugggcaaauauuggagcgaggcagcaauagauauaaagacacgagaaagaauagaaaaaaucaucaccggagaaugcgacgauuccauaagagaaagaguccgauuaaaagcuauccgacuacacgauauaggcgacuuuagggcacuuccaguauggcuagccugcuauguagucuacgaucgacauagugagucaggugacauaaccaaauggaaaaccccgcaagaaauggacugguauauacagaacuucaaacaacacucauuacgaaauccaauaguagaacaaguuauuacagaaacacuucgcguuguaagagacaucuggaaacagguaggaagaauagaugaaauucauguggaacuagguagagaaaugaaaaacccagcagauaaaagagcaaaaaugacagcccgcaugaucgaaaaugaaaacacuaauuuaagaauuaaagcaaugcucacagaauuucucaauccagaauuuaaaauagaaaacguacggccauauucagccagccagcaagauauucuacgaauauacgaaaacgguguacuuaauucaguaucagaaauaccggaagaaauaaccgguauacuaaaaaaauucaaugagagagaacaaagaaagcgacccucaaccagugaaguacuacgauauaaauuauggcuagagcagaaguaccgaagcccauacacagguaaaaugauuccacucggaaagcuguuuacaccagcguacgaaauagaacacauaauuccacaaucuagauacuucgaugacagcuucaacaauaaagucauaugugaagcagaaguaaacaaauuaaaaggaaauuugcuaggauacgaauucauuaagaagcaucacgguagacggguagaucuaggcuugggagaaauaguagacauauuuucuguagacgaauaugaaaccuuuguaaaagauuauuauagcgcaaaccaacaaaaaaugaaaaaacuccuaauggacgaaauacccgaacaauucauugaaagacaauuaaaugacucacguuacaucucgaaaguuguaaaaaguuuacucucaaauauaguacgugaacaagaugaacaggaaagcauaucaaaaaacuugaucguaugcaccggcggagucaccgauagauuaaaaaaagacuggggcauaaaugacguauggaauaaacuaauacuccccagauuccaaagauuaaauaacauuacagaaacuacggaauuuacagcgaaaaauaugcaaggucaugaaauccccguaguucccuucgaauaccaaagaggauuuaauaaaaaaagaauugaccacagacaccacgcaauggacgccauuguaauugcaugcgcagggcgcaacauuguaaauuacuuaaacaaugaaucagcacgaaaaaaagcacaaauaucuagauacgauuuacaaagguuacuaugcgacaaaguaaaaacagaugauaaugggaacuauaaauggauccuaaaaaaaccauggucaacacucacgcaagauguauaugccgcauuagacaacguaauuguaucauucaaacaaaaucuaagagugaucaauaaaacgaacaaccauuaugugcauuacgaagcaggaaaaaaaauaauagcaaaacaagaaaaagcuucaugggcaauccgaaagccuaugcauaaagacacaguauucggugaagugaauuuacgaaagguaaaaacaguaagccuuaacgaagcaauaaaaagcccacauuguauagugcaaaaagauuuuaagaaaaagcuuuugucacugcuaaaacagaacuucgacgcgaaagaaguaaaagcauauuuugaagaacauaaagacgucuggagcgacauuaauuuaucuaaaaucgaaguauacuacuucacgaaagacacuaaagaacgauuuuucgcgacaagaaaaccacuagauucaucauucgaucgaaaaaaaauagaaaguguuacagacacuggaauacaaaaaauauuauuaagacaccuugaacagaaaaauggagacucugaccuagcauuuaguccagauggaauagaagagaugaaccaaaacauaguacagcuaaaugggggcagaaaacaucaacccauuguaaaaguaagaguauaugaaaaagcagauaaguuugcuauaggacaacaaggaaauaaagcaucaaaauauguagaagcagccaagggaacaaauuuguucuucgcaguauaugaagaagagguacgggauaaaaaaacaaaugccguuauguuuaagcgaaacuacgcauccauaccguuaaacguggcaauugaccgucaaaaaaaaggucuuucaacugcgccugaggacgaaaaugggaacgcacccauauuuguccuuagcccaaaugacuuaguguacuuaccaacagcagaagauauuauaaaugcaaggauauccuuucccaucaacaaaaauaggauuuacaaaaugguaucauguacaggauaucaaugcuuuuuuauaaaacaccacgucgcaaacgucauaguagauaaaaaggaauucucugcucucaauaagauggaaaaagcagaaacaaaugaaaugaucaaagauauauguguacccauuaaguuagaccgauuggguaacauaguaaagauaggcguguacaaauga

SEQ ID NO: 5766 - RNA, 4590 nt, Artificial Sequence
  Cas9 variant
augaaaaaaauucuaggcuuagaucuugguacaaauucgauaggcugggccgucgugaacucauucgacgaaaaucaaaaugaagaaucacuaaaacauauagaauguuuagguagucguauuaucccaauggaugcugcaauucuaggcgauuucgacaaagguaauucaaucagucaaacugcaaaaagaacagaauuccguggagucagacaccuccgcgagcgacacuuguuacgaagagccaggcuacacaaaauucuacgccuccuaggauuucuuccagaccacuauguacaggaccuagacggacacggcaacuuuuuagugaacguugaacccaaaaucgcauggagaaaggauagcaacgguaccuuugaauuuauauuuaacgauagcuuugacgagauguuacaggacuucgcuacguaucagcccgaacuaaucgcguguaaucgaaaaguaccauaugacuggacgauauauuaccuaaggaagaaagcauugacaaaaaaauuaaguaaagaagaauuaaguuggauccuacuaaauuuuaaucaaaaacguggauacuaucaacucagaggugaagaagacgaugaaaguguaaaaacagcuaagacuagacaauacuucgauagacaaaaaaucaaaagcauagucgauacaaaucaaacauauaaaggacagaaaguccucauagucgaacuugaagacggaguaaaaggcaaaauauuuaagaaagaaauuccaaacuggguaggacaagaaaaaaguauaauuguaaccguagacauagauaaagacggaugugacaaauaugaagagucaggagaacuaucaugcagauuuaaaauuccaagugacgcugagugggaaagcgaauggaaauuaauaaaaaugaaaacgcaaaaagaccuggaugcuaguggcaaaaccguuggugcguacauauacgaugccauucuacaaaaccccagccaaaaaauuagagguaaauuggugagaacaauagaaagaaaauacuacaaagaagaauuaaagcaaauucuuaaaaaacaaguggaguuucacccagaacugcgagauaaagauuuguuucuugauugucucaacgaacuauauccuaacaaugacgcccaucgaaacgcaugugcugaucgagauuuuauauaccuauucauggaugauauccuauucuaucaaaggccccuuaaaucgaaaaagucuuuaauagcagauuguccuuaugaaaagcacauguauagagauaaggaaacaggugaacuuaaauacucaagcgucaaauguaucgccaaaucacacccacucuuccaagaauuuagacucuggcacuucauaaguaauaucagaauuuaucagaaagaacgaguuauugacgucgacgcaugucaaccugaccuuagcucagcacggucagcccuaaaguccaaauuagaagcggacguggauguaacaaaugaauuucuaaccugcgaagccgacuauguaucauuguucgaaugguuaaacaacaaaaagucaguaagccaaaaagacuuuuuaaaauaucccgcuuucggcauaaaaaagaguggcgauaauuacagauggaauuauguagaagauaaaucauaccccugcaacgaaaccagagcacuaauacugucacaccuagagaaagcgaacauccgaggcgauauuuucaccagagaacaagaagaagcauuauggcacauucuauauucaguagaagaccgauaugaaauagucaaagcgcuacaaagcuuugcagcaaaauauagguucaaugaugauuucguaacaguauuuucaaaauuuccaccuuucaaaaaagaauacggcucauacucagcaaaagccauuaaaaaauuauuaccacuaaugcgcauggggaaauacuggucugaauccgccaucgauauaaaaacuagagaaaggauagaaaaaaucauuacaggagaaugugaugauucgauacgagaacguguccgacuaaaagcaauacgccuacacgacaucgagcauuuccgugcuuuaccgguaugguuagcauguuacguagucuaugaucgccauagcgaaagcggcgacauaaugaaauggaaaacaccgcaggagauggacaguuacauacaaaacuuuaaacaacauucacucaggaacccuauagucgaacaaguaaucacagaaacgcuacgaguggucagagacaucuggaaacaaguaggacgaauagacgaaauucacguagaauuaggaagagaaaugaaaaauccagcagauaaaagaaaggaaaugacaaaacgaauuauagaaaacgaaaauacuaaccucagaauuaaagcaaugcuaacagaauuccuuaauccagaauucgaaauagagaauguucgccccuacuccgcaucgcagcaagauauacuaagaauauacgaaaaugggguauuaaauucagucucggaaauaccagaagaaauuacaggaauccuaaagaaauuuaaugaaagagaacagcgaaaacggccuucaaccucugaaguacuacgguauaaacuuugguuagaacaaaaauacuguagucccuacaccggaaaaaugauaccccuggggaaauuauuuacaccugcguacgagauugaacacguaaucccccaaagcagauauuuugacgauaguuuuaacaauaaaguaauaugugaggccgaaguaaauaaacuaaaagguaacuuguuaggcuacgaguuuauaaaaaaacaucacggccaacgaguagaccucggacuaggagaaauuguagauauuuucucaguagaugaguacgaaacauucguuaaagauuauuacucaggaaaucaacaaaaaaugaaaaagcucuuaauggaugaaaucccagaacaauucauagaacgccaacuuaacgacaguagguauaucucaaaaguagugaaaagucuccuuuccaacaucgucagagaacaagaugaacaagaaucgauaucaaaaaauguaauaguuuguacaggcggcgucacagaucgcuuaaaaaaagacuggggaaucaacgacguuuggaacaaacucauccuccccagauuccaaagacuuaauaauauaacagaaaccacggaauuuacagccaaaaacauggaaggucacgagauuccaguaguuccauuugaauaucaaagaggauuuaauaaaaaacgaauagaucaucgacaucacgcaauggaugcaauaguuauagcaugcgcaagccgcaacauaguuaacuauuuaaauaacgaaagugcccgaaaaaaggcuaggauauccagguaugaccuccaaaaauuacucugugacaaaguuaggacagacgacaauggaaacuauaaauggauccugaaaaaacccugggguacauuaacacaagauguuuacgcagcauuagacaauguuauuguuucauuuaaacaaaaccuacgaguuaucaacaaaacuaaaaauuacuauguacacuaugaggccggaaaaaaaacaaucgcaaaacaagaaaaaggaucgucuugggcgauaagaaaaccaaugcacaaagacacugucuucggcgaaguaaaccuuagaaaaguaaaaacaguaucucuaaaugaagcaauaaaaaacccucagugcauuguugaaaaagacuuuaaaaaaaaacuuuuaucccucuuaaaacaaaauuuugacgccaaaaaaguaaaagcauacuucgaagagcacaaagacguauggucagauauaaaucugucgaaaauagagguauauuauuuuacaaaagauaccaaagaacgauucuucgcaacgcgcaaaccuuuagauaguaguuuugacaaaaaagagauugaaucaguaacugauacaggcauacaaaaaauauuauuaagacaccuagaacaaaaaaacggagaccccgauuuagcauucaguccggacggaauagaagaaaugaaucauaacaucguccaacuaaacggaggaagaaaacaucaacccauaguaaaaguaagaguauaugagaaagcggacaaauucgcaauuggucaacaaggcaauaaaucuaguaaauacguagaggccgcaaaaggaacaaauuuauuuuuugcaguuuacgaagaagaaguacgggacaagaaaacaaacgccgucauguuaaaacgacauuaugcaucaauucccuuaaacguagcaauugacagacaaaaaaaaggacuuucaacagcaccagaagaugagaacggaaacguacccaucuucguacugaguccaaacgaucuuguauauuuaccaacagcggaagauauugcaaaugcaagcauauccuucccaauaaauaagaacaggauauauaaaaugguaaguugcacaggcaauagauguuuuuucaucaaacaucacguugccaacgugaucguagacaaaagcgaauucagcguuuuaaacaagauugaaaaagccgaaacagacgaaaugaucaaagaaauauguguuccaauaaaaauagacagauugggaaauauuguaaaaauaggugucuauaaguga

SEQ ID NO: 5767 - RNA, 4608 nt, Artificial Sequence
  Cas9 variant
augaauaccaucuugggauuagacuuaggaaccaacucaaucggaugggcccuaaucaaaguacuaaaugauaaaacaagacugccacuagaaaucauagauuuaggaguagucgucauuccaacggaucaaaggacucuagauaaauucaguaaaggagaauccauaucgaaaacugcagaaagaacaaaacaaaaaggaguacgcaaacuuuacgaaaggaagaaacugagaagagaaagauugcacagaguacuaaauauauuaggauuucuaccggaacauuacucuaagaaaauagacuuuaagaaacaccuugggcaauuuuucgggaacucacaaccuaaaauuucuuacgucgaaaacgaucacggaaaacaugaguucauuuuuauggauuccuacagagaaaugcuaaaagaguucagcaaacauaacaucaaaaaugucccauacgauuggacuaucuauuaccucaggaagaaagcgcuuucccagaaaauaagcaaagaagaauuagcauggguaauacugaacuucaauaagaaaagaggauacuaucaauucagagaugacaacgcagacgaaaauaaagaaaauaaaauagaaaaauacuaugcucucaaaguaacaaacgucaagaaagaagacgcacaaaauuacacaauuacccuagaaaauggauggauauacaaaaauaaaagcaaaauuagucuacuugacuggguugggagcaccaaagaguucauaucaacagaaaaauuugacaauaaagguaauauaaucaaaaagaaaaauggcgaagacgacagaacauuaaaauuaguagacagcgaaaaagauuggauagcaauaaagaaaucgaccgaagacagaauagaaaacuaugguaaaaccguaggaaccuaccuuuacgaacauuuauuaaaagacccaaaccaaaaacuuaacggcgaacuuauaaacauuauugacagaaaauuuuauaaaaacgaauuaaaacaaauauuagaaaaacaaaaagaguuccacccagaacucuuaaaugaagaucucuuccaaaaaucaauaauagaauuauaccccaaaaacucaacucgucaaaaagaacugaaaaacaaagaucuauguuacuuacugauagaugacguaauauauuaccaacgagaccucaaaaagaaaaacucaacaauaaauaaauguucauucgaaagcagagaauauuaccucaacggagaaaaacaaauacagaaaaucaacugcaucgcaaagagcaaaccucucuaucaagaguucaggacacuacaauucaucaaaaaccuaaaagucuaugaaauaauugacggcuuagaaaaagauaucacuucgaaacucuuaccagacuucgaaacaaaagaacacuucuucgaaugguuaaacgacaaagagaagauagaucaacugcaacuacuguccuauaaaugcuucgaucuacaugauaacgucaaaaacgauuuaaucgcuaaagggauaaaacgaccaacagaaaaagcgauucgaacagaacuacuggaaaaauacagauggaauuacagcaaagacaacgauaggaacuuucuauuaaaugaaacaagauuuaaaauacuaaaauauuugaagaaagucgacaagaaacuaacacuaacaaacgaacaaaucgaaucccugugguugcuacucuauagugcuaaagacgaaagagaacucaaaaacggcuuacaaaaauuuuccgagaaaaauaaacuuccaaagaaauucuccgacauauucauaucauuucccccauucaagaaagaauacggagcauauuccgaaaaagcacucaagaaacuauuaagccuaguccgauucggcaaauacuggagcuucaauaaaaucgacaacaauauacaaaauaaaauaaugaacauccuaaacggagaagucgaugacucaauaagugaccgagucagagagaaaacaaucuuauuacaagacaaaaacgauuuucaagaccuuccauuaugguuagcauccuacguagcuuauaaccgauucucagaagugagugaaauaaaauacugggauaguccagauaaaauagaguuccucaaacaacacagcaucggaaauccuauaguagagaaaauaaucaacgaaacccuaaaauugaucaaagauaucuggguuauucacggcaaauccugcaaaaacuucuuuucagaaauacacaucgaacuaucgcgagaaauaaaaucguccagcaagaaaagagcccaaauaacaaauaacaauacgaaaaaccaaaaauuaaacaaccuuauuaaaucguuacuaauagaaauggcaagcgacacaaaauacgagaauguaaccccauauaguccaucacaacaagaaauacuaaaaauauacgaugaaggcauauauagcaaagaagaaaauucagagaaaaucaaagaaaucaacaaaauaaggaacaauaacaaaauuuccaaaagcgauauaacaaaauauaaacuauggcuagaacaagguuauauaucgccauauaccgguaaaaucaucccccucacaaaauuauuuaccgccaaauaccaaaaagaacauaucauaccacaaacgaaauucuucgacgacucauuuaacaauaaaguuaucugcgaagcagaaguaaauaaacuuaaagacaacagccuagcuaugaacuuuauaaaagcaaaaggcggaaaagcaguaaaacugucagacggugaaacaguaacaauccucaaccaagaagaauacaaacaguuaguuagaacaaguuucaagaaaaauagcaucaaguugcgaaaccuccuauuagaagaaauucccgauacauucacaaaaagacaguuaaacgacacuaaauauauaagcaagcuaguucuaucacuacucucaaacauagucagagaaaaaggagaauuagaaucaacagcaaaaagaauaguaagcacaaauggacaaauuacauccauauuacggaaugacuggggucuaaacaauauauggaauaaacuaauaacaccuagauucgagcgucucaacaacaucaauaaaaacaaaaucuacggaaacugggaaaacaagaaagggaaaaauguauuucaaauuaauuaucuuaaugacaacuuaucaacccucaauacaaaaagaauagaccaucgccaccacgcacuagaugcuuuaauaguagccugcacaacgagaaaccacauaaauuucuuaaacaaccaauacgcaaaaagcaggaaucaacgacacgaucugagggcaaagcucaaacgacgagaaaccauaacuaccgaagguagcaagaaacaaguauucaaagauuucauaaaaccaugggagagcuucacacaagaugcuuuaaagaaacuagaaacuacaauaguuaacuucaaaguaaauaaacguaucaucaacaaaacuauuaauugguauaagaaaugggaaaaacaaaaagacggcacuuauaagaaaauucaaaagaaacagacgaaaggcgaugcgugggcgauccgaaaaccgcuccacauagacaccaucuacggaaucgucugcaagaaauuaccacuuaagucugcacucgaaaacuacaaaaauauaauagacgaaaacuuaaaacacaaaauaaaagaauuaaaagaaguaaacaaauuugacaauaaccaaaucauaaacuuuuucaaagaaugcaacuucauauuugaagacaacaacauacaaaaaguagaaguuuaugacuuuaaagauaacagagacaaaacaauauuaagcucauccaggcagcuuauugaugaaucauucacccccaagaaaauaggaaaagucuuagauccuacuauuagaaauauacugcuaaagcaccuaaacucaacuaaauacaacaacaaguucgacagugacggcaauccaaucaaaccugaaaaauuagccuuuucaccggaaggccuaaaagaucucaacaaaaacaucaaacaucugaacaauaacaaggaacaucagcccauuaaaaggguaaaacuuuuugaaacacucggaaauaaaauaaaagucggauacacacagcagaaaaacaagaaauuugcagaaacagcuacaggcacaaaccuauuccuaggaauauauucugacaauaacaaaagagacuuuaagacuaucccacuaauacuagcuauccaacgagaaaaagaaggauuaaacccaugccccgacaccgacgaaaaaggaaaccaacuuuuauucucccuaagccccaacgaauuaguuuucgucccaaauaacgaagaacgaaagaaucccaacuuaguagacuuugaaaacuuaucuaaagaccaaauagaucgcaucuacaaguucguuucguguacagguucggaagccuacuucgucccuucccgcacugcaaaaccaauaauugaaaacgaaaacggaacaaauaauaaaucccagcgaaucauagaauuuaacgagaaaacaagcaucaaaaacgagaaaaacgaaccaguacucauaaaaacaauuuguuggaaaauagaaguuaacagauuagguaagauaauuaaagucauaaaauga

SEQ ID NO: 5768 - RNA, 4608 nt, Artificial Sequence
  Cas9 variant
augacgaaaauauuaggacuagacuugggaaccaauuccauagguugggcaauucgugauaccgaaaaugaaggaaucaaccaaauacuagauaaaggagcccggauuuuuagugaaggaguaaaaucagaaaauggcaaagaaauaucgcgagcugcggaacgaaccgcauaucgaucugcucgcaaaaucaaauaccgucgcaagcucagaaaauaugaaacgcuaaaaguacuaaguaucaacgggauguguccccuauccguagaggaagucgaacaauggaaaaagucaggauucaaggaauacccucuaaaucccgaauuccucgacuggcucaggaccaaugaagacaaaaauauaaauccauaucuauuucgagacaaagccucgaaacaaaaaguuacauuauucgaauuagggcgagcuuuauaccauauagcccaaagaagagguuuccuaaguaauagguuagaucagagugcggaaggcguuuucgaagaacauaacccacaaauucaaaauuuaauagaagaucuagacucaucuaacacaauucuuaacgaacuaaaggaauauuacauaaaucucggaauuauagacgaaaccgaaaaaucgggguuuaaaaaagacuuagacgaaggagaaaaaaagcugaaaucucuauacaacagcuuaguagcaauaacaaaaaaaaaugccaaugauauagaaacaugcaagcaggaguuaaucgccagacucaauaaaaaagaggauuuaggcaaagucaaaggcaaaauaaaagauauaagucaagcgaugcuagauagaaauuucaaaacacuaggacaauacuuuuucucacuauacaacaaagaaaggauaaggaaccaauauacuucacgugaggaacacuaccuagaagaauucauaauaauaugccaaacccaagguauagaaggaauuaauacuaacgaaaaauuaccagaaaaaaaauucacaggcuuagcgaaggaccuguauagagcaauuuuuuuccaaagaccguuaaaaagccaaaaaggccuaaucgggaaauguuccuuugaaaaaaacaaaucacgaugcgccguaucgcauccugauuacgaggaauuccguauguggucuuaccuaaacaccaucaaaauaggcacucagucagaaaaaacacuaagauuuuuaacuuuagaagaaaaauuaaaguuaguacccaaauucuaccgaaaaagcgauuuuaacuucgaaguacuagcaaaagaacuaguggaaaaaggagcaucauuuggauauuacaaaagcaguaaaaagaaugaauucuucuacugguucaauuacaaaccaaccgauagcguaucggcguguguaguauccgcuagucuagaaaacgcaauagguaaagauuggaaaauuaagacauucgaauaucaaacuagaaauaccgagaaaaacgaggucacaaaauccguagacuacaaagaccucuggcaucuacuaagcgucgcgacaucagacaccuaucuauaugacuucgcaaucgagaaacuuaaauuagaaccgaaaaacgccaaagcuuucuccaaaacaaaauuaaaaaaagauuucgcaucauuaucauuagcagcaaucgcaaaaauccuaccuuacuuaaaacagggacuauuauauucucaugccgucuuuauggcaaacauagaaaacauaguagacgccgacauauggaaagaugaagaacaacaaaaauuuauacaaucgaaaauaguugaauuaguagacaauuacauaguagaaaaaucaaaacuggaacucauaaauggacuauuaaaaauauacaauacagaagauaaggaaggcagaaaaguuuauuacucgaaagaagcugaaucguuauuugaagcagaucuacguaaaaaauuggugcccuucuauaaggcaaauauaaucaucgaagagcacgagcaagagaucauauuucaagaccuuuucccaauacucauggaccaacucaaaaaacaagaauuuauaaaaauugguagguuagacaaacaaaucgaagcauucuuagaaggcgaaaaugaagaaggccaaauauuuuguaaccacacagauaagcuuaaaaaguuauaccacccaucagauauugaaguuuucaaaaagaaaaccauaaaagaugaaugggguaacgaaaaagucguacuuggcaguccacuaaccacuuccauaaaaaacccuauggcaaugagagcucuucaccaacuaagaaaaguacuuaacacacuaauagcgaacgaucaaauagaugaagauacuaggauacacauugaaauggcucgugaacucaaugaugcuaauaaacguaaaggaauacaagauuuucagaaugaaaauaaaaaguuccgagaagaagcgauuaaagaaaucaaaaaauuauacuuagaagagugucacaaagacguuaacccaacagaggaugauauacuucgauaccaacuauggcuugaacaagguaaaugcgaaauauacgaagagggaaacaacaucuccauaugcgacauuauagguucaaauccaaguuacgacauagaacacacaauaccaagaucaauaagucaagacaacagucaaaugaacaagacuuuauguagcuuaaaauuuaauagaaguauuaaaaaacaaaaaaugccaguagaacucuccaauuauaaugauauacuuccacguauagcucauuggaaaaaagaggccgaggaauuaacucgacagauagaaacaauaaguagaaguauaaaaucagcagcaacaaaagucgcaaaagacaagaacauaagaaaaaggcacuaccuaacauuaaagagagauuauauucuuggcaaauaugaacgguucacuugggaagaaccaaaggucggauucaagaacucacagauaccugacacaggaauaauaacgaaauacgcgcaagcuuaccucaaauccuauuucaaacgaguagaaucuguaaaagguggagcaguagccgaauucagaaaauuauggggaauacaggaaucauuuauagaugaaaauugguggaaacauuacaaggauaaagaucgugauaaacauacacaucacacaauagaugcgauuacaauagcaugcaugccaaaagacaaauaugaucuauuggcucaugccuggagauuagaggacgaacaagacaaaaaagcggcaaaaguauuaaucgaacaagccaaaccauggaaaacguucaaagaggacaucgaaaaaaucgaaacagagauuuuaguaucccauuuuaccccagacaaugugaaaaaacaauccaagucaaucauaaaaaauagaggaaaaaaaguauacguacucaaaaaugagcugccagugaacuucaagaauaaaauagaaggaaaagacuauuuuaaacuaaaauuugacaguaaaauauuguauaaaauacccaaaaaaaaggaaaaacaaacagacacguuuuacgaagagcugccaaaaaauuaccuaaaugggguagaaggaaaagauuacuucaaaauaaacacgaccggaaaaacauucuacaaaauacccauauuuaaucaaggcgacacuauaagaggaucccugcaccaagaaacaacauacggagccauuaaauuaccagacaucgacauagaaacgaaaaaaccacugcacacagacaaagggggcuucauauugaaaaaagauauuaaaggcaacgaaauaguuuucuuuguaguaagaaaagaaauaucaaaaauuucagaaaaugacguacaaaauauugucgacaauguugugcggaaaaaaaucgaaaacgcuauagcaaacagucucaucacauuuaaaauuguaaaaaaaaagaaaguugcaguuauaaaagaaggggugaccauauggaugagagaaccaaacauagaaaaaggaauugaaggaauuccuauaaaaaaaguacgaauuauaaccaacagcgucaaaaacccaauagaaauaaaaguccacucaccccuaucaaaaucacgacauaaacacaagcaaaagguauacggacaaaacgacgaaaauuaugccauggcacucuaugaauuggaugguaagagagaguuugaacuaauaaauaacuuuaaccuagcaaaacuuuugaaacaaagccaaucauauuaccccuuacauaaagaaaaagaaauuaaaggaaaaaaaauccuuguacccauagaaaaaaggaauaacaaagaugugauauuaaaacggggacaacaaguuguauucuacgauaaaacaguugaaaacccuaaagauaucagcgaaauaauugacuuccgggaaaggauauacauaaucgagggguuaacaauacagagacaaaaagacaaaaaaacuucaaaagugaacgaauaugguauaauacagcuaagacauuucaaagaagccagaaaaagugaagagauaaguaaagauaacuuuaagccagacggcgaauuuaaaaucaacgaaaacaaaccaacacguaaaaugaaucacaaucaauucacugccuuuguagaagguauugauuucaaaguacuaccuucaggaaaauuccaaaaaauauga

SEQ ID NO: 5769 - RNA, 4614 nt, Artificial Sequence
  Cas9 variant
augaaaaaaauauuaggccucgaucuaggaaccaauucgauaggaugggccuuaacgacaaaugacuuugacacaaaaaaaggaacuauugaaggucuaggaucccgaauaauaccuaugucgcaagauauacuaggaaaauuugauagcggcguauccuuaucacaaacagcgcagagaaccgaauacagaggaaaaagaagacuuguccaaagauuuuuacuaagaagagaaagacuucacagaguguuacacauccucgaacuguugccaaaacaauacucagaagcaauagauuuugauaaaaaacucggacaguucaaaccagaaagagaacaaaaaauauccuucuacaaaaacgaauccgggaaaaaucaauucaucuuuacaaaaucacaccaagaaauguugacagaauuucagaccuacuauccaacaauaaaaaacaucccauaugacuggacuaucuacuaccuacggaaaaaagcucuaacagaaaaaauaaguaaagaagaacucgcauggauacuucugaacuuuaaccaaaagaggggauacuaucaacugcgaggugaagaaaaagaagaaaacaaaaacaaaaaagaggaauuccacacuuuauugguaaccgauauuauugagcgcgauaaaggcaagucaggaacaugguauaaugucauucucgaaaauggauggauauacaaaagagaaagcaaaauauccuuagcagauuggaucgggaagacaaaaaguuuuauuguaaccacugaauauaaugacgacgggucugugaaauuaaccaaagacaacgaagaaaaaagaucuuuccggucaccaaaagaggaugacugggggcuaauaaaaauacgaacugaaaaaacuauaaaccaaucugacaaaagugucggagcuuacauauacgaugcucuccucaaaaaucccaaucaaaaaauaaaaggcgaacuagugagaaccauagaaagaaaauacuacaaagacgaacuacgcgaaauacuaaaaaaacaacuagaauuucacagcgauguacuuaaugacaaaauauuauauaaaaaaugcauagacgaauuauauaaaaacaaugacagccacaaaaauuccauaaaagacagaggguuugauuacuuauuccuagaugauauaaucuucuaccaaagaccucuaaaaaguaagacuagccuaauaucagauuguagcuuagaauucagaccaaucaaaaacaagaacgguguuuuaguuaaggacacagacggaaaacaaauagcaaaagcacuuaaauguauagcccgaucaaacccaauauuccaagaauucagacuacugcaauucgucaaaaaccuaaaaauauauaaaagagguguagucgaugacgucgaagucacuaaugacuaucuaaaaagugaaaacgacguagaaaaacuuuuuaauugguuaaacgacaaagcagaaauaaaucaaaaacaguuucuaguuaacuuuaagcuaaaagaggacaaacacagauggaacuuuguagaagacaaaggcuacccaugcaacgaaacccgaaaccaauuccugaacgcgauagcaaagauagacguugauaaaucuuuuuuuaacacuaaaaauacacaagaccuuuggcacauucuguacucuguaacagauaaaauagagauuacaaaagcaauuacuacauucgccaaaagacacaauuugccaaaugaauuuauaauaaauuuuucaaaaauaaaacccuacaaaaaagaauauggaucauuuagugaaaaagcuaucaaaaaacuacugccccucaugcgauuuggaaguuacugggacgccaaaaauauagacaucaaaacccuagaucggauagacaaaauccaaacuggagaauucgacgaaaaaauccgaaacagaguacgggaaaaagcgauagaucuacacaaaauugacgauuucaaagaucuaccauuauggcuagcaagcuauauaguuuacgauaaacacucggaagcaucagacguauccaaauggaaaacaccagcagacauugagaaauuccuaaaacacgaauuuaaacagcacagcuuaaggaacccaauaguagaacagguuauuacagaaacacuucgagucguaaaagauauauggcuucaauacggugaaggcaaagagaauuuuuucaaugaaauacauauagaauuaggacgagaaaugaaaaaugauaaagccacaagagagaagaucaguaaaaaaguaagugaaaacgaaaauacaaaucuccgaauuaaagcgauacuuacagaacucaaaaacgacgggguaucagacauccgacccuauucgccaucacaacaagaaauucucaagaucuaugaggaaggggucuauaacaaugaaagcagaaaagaaaaacuagaagaaguagauaaaauucgaaaaaacgcaaaaccuacuacaucggaaauaauaaaauauaaauuauggcucgaacaaggauacgccucacccuacaccggaaaacugauaccuaugucugaauuauuuaccacuaaauaccaaaucgaacauauaaucccacaaucacgcuuuuucgaugauucacuauccaacaaagugaucugcgaauccgaaguaaaugaacuaaaaagcaacaugaccgcacucgaauucauacuaaccaacgaaaaccgaauaguuacuuuaacaggaggugaaacagugaaaaucuuuacaaaagaagccuacaaucaacacaucauaaguuacuacaguaaaaacaagaacaaacaaaaaagacuuuugacagaagaaauuccagaacaauucauaucaagacaacuuaacgauacuaaauacauaucuaaaaucguaaaaaaccucuuaucuaaaauaguccgugaagaggacgaacaagaagucacuucgaaacacguaguaucacuaaacggauccaucaccagucggaugaaacaagacuggggucucaacgacguauggaacacaaucguaucacccagauuugaacguuugaauacacuaaccaacucuaacgacuucggacaauucgagcuaaaaaaagaugccuacgggaacgaaggaaaaagaguauuccaaacaacuguaccagacgcuaucgcuaagggauucacgaaaaaacgaauagaccaccgacaccacgcacuagacgcacuugucaucgcuugugucaauagaacucacaucaauuacuugaacaaucuaaacgcaaaagauacagacgauaaagcaguaaaacacgaauuaagaaacaaacuuugcuucaaaacaaagccagauucaaacgggaacuacaaaugggaauuucauaagccgugggaaaaauucacaaaagaggcacaggacaaauuaaacacaacaauaguaaguuucaaacaaaacacaagagugauaaacaaaacuguuaauaaauacguaucuuacaaagaugaaaauggaaaccuuaaugucgaugcaaacggacuaccucaaaaaaaaguuauaacacaaaccaagggagauaacugggcgauuagaaaaccauuacacgcggaaacagucuccgguaagguauucuugaaacguauaaagcaaucccacauaacaauugcaaacgcuauagaacaaguggaguuaauaguagacaaagaagucaaaaaacaacucaaggcgaagauuaaacucuacccaaauaauaucgcaggacuaaagaaacacuuaaaagcauuuccagucaugauaaacgacaaagcaauagacaaaauacaaauauaugaaacgcuagaagccacagcgacacgaaaaauucucgauauaacguucgacgaaaaaaaaauucagaaaaucaccgacaccggcauacaaaaaauauuacugaaccacuugaaacaagagaaauaucaaaauacugucgaugaaaacggcaagaaacuagccccacaugaaaucgccuucagcgaaaacggccuagaagaccuaaauaaaaacauaacauuucuaaaugacggaaaaaaccaucaaccuaucaaaaaaguacgcauauuugaagaagguaauaaauuuccucucggggaaguagguaauaaaauaaauaaauuugucgaaacugcuaaaggcacaaaccuauucuucgccguauaugaaaacgaugacaaaaaaaggaacuacaaaacaauuccauucaacgagguaauagaaagacaaaaacaaggacugaacgcggcauuggaaauugacgaaaauggaaacagacuccuauuuacacugaguccaaaugaucuaguauacauaccgcuagaagacgagaucggauaccucaauggugucuacuuuaaaaaccuaaacaaggaacaaacuguaagaauauacaaauucguuaguugcacuggaggugaaggccauuucguaccaaauaacuacucuaaagaaaucauaucaaaugaaaacggcucgaacaauaaaaaugaacgcaugcuuaauuuuaacaacuucaauauuauauuugauggaaaagaaaagcccguaaugauaaaaaguauaugcuggaaauuagaaguugaucgucucgggaaagugauaaagauuauuaaauga

SEQ ID NO: 5770 - RNA, 4617 nt, Artificial Sequence
  Cas9 variant
augaaacacauauuaggacuggaccuagggacaaacagcauagggugggcguugguaaaaagugaacaagacugcgaugacguagaaagaaucaacggaauugaagccgcuggauccaggauaauaccaauggaugcagcaguacuaggagacuucgcgaaggguaauacuaaaucacagacagcagacagaacugcggcacguggaauacguagaaugggagaacgucauaaacuaagaagggaaagacuuaacagaguauuagacguaaugggauucuugccagaacauuacagugcagccuuaacuagauauggaaaauuuaaagauggggaagaaugcaaaaucgcauggcgaaaggaugaaagugggcaauggaccuuuguauucgaagauaguuuucgagaaauguuagcggacuuuguagcacaucagcccgaauggcuggcaggggguagaaaagucccguacgauuggacuaucuacuaucuucgaaaaaaagcucuuaguaagccauugaccaaacaagaacuagcguggcuucuauuaaacuucaaccaaaaaagaggauacuaccaauuaaggggagaagacgaacauacagaugauaagggcaaacuaguugaauauuacgcauuaaaaguaguaggaguugaagacacaggugauaaaaaaggcaaggauacgugguuuaauauaauguuagaaaauggaaugguuuauaggcgaccagcagcagaagcaccagauuggauaggaaaaacaaaagaauucaucguuacaaccgacuuagagaaagaugggacgccaaaaaaagauaaagaaggaaacauaaaaagaagcuuucgaaugccuaaagaagaugacuggacacuaauaaaaaaaaaaacagaaaacgacauagaccgcucugggaaaacagucggugaauacauauaugaugcucucuuagcugaucccacacaaaaaauucgcggcaagcuugugagaaccgucgaaagaaaauacuacaaagaagaacugaaaaaaauaauaaacucacaaaaaagauucauaccugaauugaaugacaacgaauuauauggcagaugcaucagcgaacuauaucagaguaacgacgcguaucgucaaaguaucuccaguugcgacuuuacauaccucuucgucgauaauauaauauucuaucagagaccucuaaaauccaaaaaaagccuaauugacaauugccccuaugaggaacacucauauacagacucaaaaacaggugaaguuaaaacggccccugugaagugcguugcaaagucaaauccauuguuucaagaguuuaggcuauggcaauucguacaaaacauaagaauauuugaaagacaaaaaaaaaucggagacaguguuaaaacagacguagauguaacuggagaauuuauaaaaagugcggaugauguugugucacuuuuugauuucuuaaaugacagaaaagauaucacgcagagcguccuccucggcacauauuuuaagauuaaaaaacccaaaggaaaagacagugacuacccauaucgcuggaauuauguugaagacaaaacauaccccugcaacgaaacuagggcgcugauacuaaaaggacuaaaagaugcaggaaucgaugaaggauuccuggauaaagacaaagaauacagcuuauggcacauacuauauucaguugaagauaaacaagaaauaacuaaggcaauggagaaauucgcagcaaaaaacagucuuggaggaaaauuugcagaaguuuuuucuaguuuaccaccguuuaauaaaaauuaugggaguuauucagaaaaggccauaaaaaaguuacuagcacuaaugagaacaggaaaauacuggagcgcugaugcgauagauaaacauacacuagaaaggauagauaagauuauaaauggggaguaugaugaaucaauuagaaccagaguacgagaaaaagcaauaaaucuaacugauguaucacauuuucguggauuaccgcuaugguuagcuuguuauauagucuaugauagacacucugaaucaaaggauauaacauguuggaauuguccagcggacauagaccaguauuuagaucauuucaaacagcacagccuuagaaaccccauaguugaacagguaguaacagaaacgcuuagaacugucagggauauuuggagacaauacggaaaaaucgacgagauacacauagagaugggaagagacaugaagaauccagcagauguucgagcaaaaaugagcaaacgcaugauagacaacgaaaaugccaauuuacgcauuaaagcuauguuagcugaauucgcugacccagacuuuggaauagcaggagucagaccauacucuccaagccaacaggagaugcuaagaauauacgaagaaggugcacuagaaucaguagacgaaguacccgaugaaauaaaugaaauuauuaguaaauucaaccaaacagacauaaaaaaaagaccaacucauggagagaucauaaaauauaaacuaugguuagaacaaaaauaccagucgccguauacgggccgaacuauuuccuugucgagacuguucacagaugacuaucagaucgaacacguaauaccccaaaguagguauuucgacgauucaaugaguaauaaaguaauuugcgaagcagaagucaaucaacuaaaagauagaauguuaggcuaugaauuuauaaaagcacaccacggagaaaaaguauuacuaagcucaggcgaaacaguuacaauacuaacugcugaggaauaugagaggcuagugcagcuaaacuuucgcaaaaauccaguaaaaaugaagaaacuacucauggacgacauaccggauaaauucauugaaagacaauuaaacgauagcagauacauaucaaaaaaaauuaaaucuuuacuaucaaacaugguacgagaugaaggagaacaagaagauauaucaaaaaaugucauagcuugcaauggagcgauaacggacagguuaaaaagagacugggggguaaacgacguauggaaccauauuauucuaccaagauuugaaagacuaaaugcagucacagggucugacagauucaccacaacaaguacuaauggacauaccaucccagauaugccacuuaaucuccaaaagggauucaauaaaaagaggaucgaucauagacaucacgcaauggaugccauaguaauugcaugcacgacccguagucacguaaaucucuuaaacaaugaggccgcaaugagcaaaaacaacgcaguuagauaucaacuaucgaggaaacuuagaagauacgaagauacaaugguaacuagaaauggggaaacucgaacaauaucaguagcacgagaguucuuaaagccuuggccaacauuuaaugcagacguagaaaaagcccugcgaggaaucguuguaucauuuaaacaaaacuuaagaguuaucaacaaaaccguaaauaaauaucaaaaauucguauauaaugaagaaaagcacauaaaagaaaaaaaagcuguaagacaagaggaacgaaacggucgacaucuuuuagcaauaaggaaaccgaugcacaaagauacaguuuauggcgagguaaaccuucgccgaauaaaagaagucagucuuaaagacgcaguggcaaauccaaaggcuguaguagauaaggauuuaaaaaaaaaacuaauggcaaugaucgaguuagguuacgaucuuaaacaaauaacaaaauacuuugaagauaauaaagacgcauggcaggaugugaacuuaaaaaaaauaaaaguauauuacuuuacuaaagauaccggugaucgcuauuuugcaacaagguuugguaacgauuuaguuacacuguuuucgaaaauuacaaaagcagaugacgcgaaaaaacaaauagaaagaaucacagacacgggaauacaaaaaaucuuaaaaagacacuuagaagcaaauggaggagauugucaaaaagcauuuagugcggacggcauagaugaaaugaaucgaaauauaacccaacuuaacggaggacgaccgcauaagccaguauauaaaguaaggauauaugaaaaagcagacaaauucgcaauagguacuaaagggaauaaggcagcaaaguucguagaagcagcaaaaggaacuaaccuguuuuuugcuguauaucuuaaagaauaugaggauucaacaacuggagaaacaauaaaaaaaagaguauucgacacuauuccacuuaagacaguaaucgaucguuuaaaaaacggacaaacaccugcucccgaagaaaaagacggggcaaaauuauuguuuguauugucaccuaaugauuuagucuauuuaccaaccgaagaugucguaaaaaacggcacuauaaacagaccccuggacaaacguagaauauacaaaaugguaucgugcacagguaccgaauguuacuauauuccguuuaucgucgcaucccccaucguagacaaaguagaauucuuuagucuaaacaaaauugggcgcgcaauuacaggugagaugauaaaagaaauaugcauaccuaucaaaguagauagacuugggaacauuacagaaguaaauaaugaaaaaauauga

SEQ ID NO: 5771 - RNA, 4623 nt, Artificial Sequence
  Cas9 variant
augaauaaaauacuaggacuagauuuaggcaccaacucaaucgggugggcccugguaggaaccgacgaagaagguaauccaauacgaauuuacaaaaguggaaguaggauaauuccaaugucacaagacguauuagguaacuucgaccgggguaacucaaucagucaaacugcagaacgaaccucauauagaggcguaagacgauuaagagaacgacauuuacuaagacgagaacgccuacacagaguauuacaucugaugggcuuucuccccucccacuaugaagaagcaaucgguugggacaaaggcgacaauaaaacauuugcuaaauucuauagcgauacagaaccaaagcuaccauggcgaaagaaugccgaaagggagcacgaguuccucuucaacacaccauauaaugaaaugcucguagacuucaggaaaaaccaaccucaauuauuuaaaauaaaaaaaaacggucaagaaaguuuaauccccuacgacuggacaaucuacuaccuaagaaaaaaagcacuaucaaaaccaauaagcaaaaaagaacucgcguggauaauacucaauuuuaaucaaaaaagaggcuacuaccaacuaaggggagaagaagaggaagagaauucaaacaaauuaauagaauaucacgcgcucacaguagugaaaguaauagcugacgaaccacaaaaagguaaaucugacauaugguacaaugcagaacuggaaaauggaugggucuacagaagaagcucgaaaacacccuuauucgacugggaaucuaaagucaaggaauucguaguaaccaccgaucucaaugcugacgguucacuaaaaguggacaaagaaggaggaguaaaaagaagcuuuagaguaccaucagaagaugauuggaugcuggucaaaaaaaaaacggaaucggacauagaaaaaucagacaagacaguaggauguuacaucuaugauaccauauuacagaauccaucacaaaagauacgagguaaacuuguacgaacaauagaaagaaaauuuuacaaaaaagagcuuacagaaauauuaaauaaacaaaaggaauuucauucagaguuacaaaauaaagaacuauaucaagaaugcauaaaagaacucuauccucauaacgaggcacacuaugauagccuucuagucaaggauuauacggaucuauucguaaacgauaucauauucuaucaacgaccccucaaaucaaaaaaaucauuaauuuccaacuguccauaugaauaccgugucuacagaaacgacucagggauaguagaaaggguaccaauaaaaugcauugcaaaaucgcaccccuuauaccaagaauuuagacuuuggcaauucauucacaaccuaagaaucuacgaacgucaaagagaaguaaaugggaaaccagaaacagauguagacauaacggcggaauuuauacccacuacagaagacagaguaaaauuauucgacugguuaaauaauaaaaaagaaauuaagcaagauacccuacuccaaucauacuuuaagauaaagaaaaaaaaaggggacgacaaauuccccuaucgauggaacuacguugaagacaaagaauauccaugcaacgaaacgagagcacucauacuaagccgauuaacuaaacucaauuuaagcgaagauuucuuaacaaaagaaauggagcuagcuuuauggcacauauuauauagcguagaagauaaagaagaaauaaaaaaagcuuuuaaaucguuugcacaaaaacauaauuuagaugauaguuuuguagaucaauuuauaaaauuuccgccauucaagaaagacuacgguaguuacucagcuaaagcaaucaaaaaauuauuaccacuaaugcggauagguaaauacugggacgaaaaagcaaucagcggaaacaccagaaguagaauacuaucaauuaacgaacgacuugaagauaugcgauccagugggaaaaaaauagaagacguaucagaugaugacauaccaaaacaaguacucaagucauucgacaaagucaacggugucuauaguggucugaacacuuaccaagcauguuacgcugucuacgggagacauuccgaggcauccgaaauuacaaaauggaaaacgccacaggauaucgaugacuacuuaaaugaauuuaagcaacacagucuaagaaauccaaucguugagcaagugauaacagaaacucuaagaguuguaagagacauauggaaaaaauauggagauuucagcgaaauucauauagaauuaggucgcgaaaugaaaaauccagcagacaaaagagcuaaaaugaccacccaaauuucagaaaaugagaacaccaacuuaaggaugaaaagucuucucgcagaacuuaaaaaccauaaugacgucgaaaauguccgaccguauuccccaucucaacaagaaaucuuaaaaauuuacgaagaaggaguauuaaacagcguguccgagauaccagaagaaauaauuaagauaacuaaaaguagucaaccaagccaaacagaauuaguacgauauaaacuuuggcuagaacagaaauaccgaucacccuacaccggagaaauuauacccuuaggaaagcuauucacgucagcauacgaaauugaacaugucaucccacaaucuagauauuuugaugacagcuugucaaacaaaguaauaugcgaaucggaggucaacaaacuaaaggguaaccuccuuggauacgaauucguuaaaaaccaucacggaguaaaaguagaacuaaacuuuaacaaaacuguagaaauauucuccauuaaugaauaugaagaauuuguuaagggaaacuacggcaaaaauagaggcaagaugaagaaacuauuacuagaagacauccccaaaucguuuaucgaaagacaguugaacgacacccguuacauaaguaaaguaguaaaaggacuacuaucuaauauaguaagagaagauggggaacaagaagcaaccucaaaacauguaauuccuuguacaggagggguaacuacuauccugaaacaagauuggggacuuaacgauguauggaacaaaauaguuacaccuagauuugaaagaaugaacgaacuuacaaacacuucuuuauucggacagugggaaaauaaggaaggcaaacgaauauuccgaacagaaguuccauuagaacuucaaaagggauucaauaaaaaaagaauugaccaucgacaucaugcaauggaugcaauagucauugccugugccacaagaucacauguaacuuauuuaaauaaugaaucaucaaaggcaaaugccaaagaaaucagagauggccuaaaacauaaacuauguuucaaauccaagacagacgagacuggaaacuauaaauggcaguuucacaagccuugggauaccuuuacacaagacguacaagacacacuugaaaacauaguaaucucauucaaacagaauuuacgaguaauuaacaaaacaacgaaccguuaccaaaaauacgaagaagagaaaaaaauuuugaaaagucaagaaaaaggcgauucaugggcaauaagaaagccucuucauaaagacacuguauuugcaaaaguuucccuccaaaaaauaaaaugcgugaaacuagcuauggccuuaaaggacuggaaaaauauuguagauaaacaacugaaaaaagaaauacggaggcuaauccuaucuuaugguaaauucgaugcggaaauucucaacaaauauuucaaagacagaaaauacaucuucaaagauguagauauaucaaaaguagacguauacuauuuugaaacagaauauguagcuacucgaaagaaucuagauaccucuuuugaccgcaaaaguauagagucaauuacagacacaggaauacaaaaaauucuacugaaccaccucgguguaaaaaauaauaacccagaacucgcauuuucggccgaaggaauagaugaaaugaaucaaagaauaguagaauuaaauggcgguaaacaacaucaaccgaucuacaaaguaagaauguaugaacccuuaggcaauaaauuucaaguaggaagaaucggaaacaaaaaagacaaauacguugaagcugcaccaggcacaaaccuguucuacgcuauauaccaaucagaggacaaaaaaagaaucuacgacacuauaccacuuaacaucauaauagagcgccagaaaaaagaauuauuucccgucccagagaacaaggaagacaaggacaaccuuuauaaacuacucuuuugguuaaguccaaacgauauggucuaucucccaacugaaaaggagugggcgaauccugacuuauuuaauuucaacaauaugacaaaaaaccaaagaaaaaaacucuacaaauuuaucgauggaucaggaacaacagccaauuucauacccaauacaguugcaaacauaauauuuucuauaccgaaaaaagacucaggaaaauacucaaugggaaaucgaauuguccaaaaugaauucgggauuggguccccacaaucuaaaaaucaaaaagcauuuaccggagaaaugauaaaagaacggugcuggaaacuaaaaauuaaccgacuuggugauauuauagaaugcaucaaauga

SEQ ID NO: 5772 - RNA, 4629 nt, Artificial Sequence
  Cas9 variant
auggaaaaaagaauauuaggacuagauuuagguacuaacagcauaggaugggcacucguuaagggagaacggcaugaaaaugauaaugaaacaauacuaaguuacauagaagcagcgggaucccgaauacucccacuagaugcggcggcccaaggagauuucgagaaaggaaauccagccaaaacacagacaagugaaagaacaagaaugagaggaaugaggcauuuacuagaacgaaguuuauuaagaagggaaagacuacaccgcgucuuggauauuauggauuuucugcccccucauuacagccaaucauuaacucgcuauggaaaauucaaggcagacacagaguguaaacuagcauggcgaaaaacagaaacaggacauuaugaauuucuauuucaagauaguuuucaagaaauguuacaagacuuucaaaaccauggaaagcuugaggaaaauaagaaaauaccauacgauuggacaauuuacuacuuaagaaagaaagcacuaacgcaacccguaagcaaacaagaauuagcauggauacuccuaaauuuuaaucaaaaaagaggguauuaucaaagagaggaccaagcaguagaugauaaucaaaagaaaagaguagaguaccaagcucuaaaagucauaaguguggaggauacgggagaaaaaaaagggaaaaauacaugguacgacguaagauuagaaaauggauuaguguaucauuauagcgcaccaauaaaaccagacuggaaaggcgaaacuaaggaauucauagucacuacaacaauagaucaaaauggaaaaccugagcuagacaaagacgguaaacccaaguacaguaugagggcaccaaaagaggaugauuauaaacuacuuauggagaaaacaaaaaaagacauaacagauagcggaaaaucaguaggagaauacauauacgacgcacugcuagucaauccacagcaaaagauaagaggaggauugguuagaacaauagaaagguacuuuuauaaaaaggaacuagaaaagauccuccugucacaggagcgauucauaccagagcugacugaccgagaauuauaccgcagauguguagaagaacuuuaccccaguaaugaugcauacagacauuuaaucgaaucgagagacaugagauacuuacuagucgaagacauauuguuuuaucaaagaccucuaaaaucaaaaaaaagccuaauugaugacugucccuacgaaucaagaucauauguggaucgcgaaacaggagaaaucaagucaagccccguaaaguguauagcacagucacacccuuuguuccaagaauuuagguuauggcaauuuauucauaacuuaagaaucuaucaaaaugagaggucaguagaagggaaauugcaacuagacguagauguaacagaagaagugcuaccaacuccugaguccaaagcagcacuauucagauuucuaaaugauagagaaaauguaacucaggagauacuuuugaaagaaguuuucaaaggacgaaaauuauccguaaaagauugcccauaccgauggaauuacgcaggcgaaggaaaaaaguaucccuguaaugagacuagacaucuaauguugaagcugcucaaaaaagcagggauagacacugccuuuuuaacaccagaaaaggagcaagcccuuuggcacauuauguauucuguggaagacaaagaucaauaugaaaaagcgcuuucuacauuugcgagaaaaaaugacuuaccagauggauuuaaagaacaguucaagaaagcaccaacauuuaagaaagacuauggugcguauucauuaagggcgaucaaaaaauuacuuccacuaaugcgaguaggagaauacuggagugcagauugcauugauagcgaaacaaaagaaagaauaagucaaauaauccgaggagaaauggacgaaaaagugucacaaagaaugacaaagucgagagauagcuuuacagauauaagucaauuucaagggcucccaguauggcaggcaugcuacguaguauacggccgacacagcgaagcaacagaaauccagaggugggagaaaccugaagauauagauguuuaccucaaagcauucaagcaacacucucuuagaaauccaauaguagaacaaguuguacuagagacacuaagggugguaagggauauauggaaaacauauggaaaaguagaugaaauacacauagaaaugggaagggacaugaaaaauacagcagaagaacgaaaaagaauuuucaacagaaaucagcaaaaugaaaaugacaaucuaagaauuaaagcucuuuuaaccgaauuuaugaauccugauuuugaaauagaaggaguacggccauauucaccaagccagcaagaagcacuaagaauauaugaggacggagcuuggaguggacuugaugaagaaaaggaggauaaaaaagaacuugaggcaauaagagaaauauuagguaaauucagucaaucggauaaagcaaaacgaccaacccauucagaagucuuaagauauaaggcuugguuagaacaaagauauucaagucccuauacuggagaagccauuccacuugcgaaauuauucacaccugccuacgaaauugagcacguaaucccacaaucaagauuuuucgacgacucuuuuucaaauaaaguugucugugaagccgaaguuaauaaauuaaaagaucgaaugcugggcuacgaguuuauaaaagcucaccaaggggaagucgugaguuuaagcggaacaggaaggugugcuagaauucuaaguccagaagaauacgaacaacgcguaacugauuguuauaaacauaacaccgcaaaaaugaaaaaauuauuaauggaagaaauuccagaugauuuuauccaacggcaaaugaaugacucgcgguauaucucaaaauuaguaaaaagucuacuaucaaauaugguuagagaagaaggcgaacgagaagccauaucuaagcauguaauaacaugcaacggaacuauaaccgauagauuaaaaaaagauuggggggucaacgauguauggaaccauauaauucugccgcgauuccaaagaaugaaagauuuaacugguagaaacgacuuugucgcuguuaacucucaaggccaugaaauuccuuccgugccaccagaguuacaaaaaggauucaagaagaaaagaaucgaccacaggcaucacgcgauggacgcuauaguuauagcaugcaccacacgcaaucauguuaauuuacuaaacaaugaagcugcuaugagugagaacaaggcuaauagaauagccuuaagccggaaacuaaggcgauacgaaaacugugcaauuuacaaggguggcgaaacuaaaaacauuaguguagcaaaagaauuucuuaaaccaugggccacuuuuccggcugacgucgagcgagcuuuaggagauauaguuguaaguuuuaaacaaaauuuaagaguuauaaacaaagccacaaaccauuacgagcauuauaaagauggaaaaaaagugaaagugccacaaaaaaaaggagauauguggguaguucgaaagccauuacacaaagauacuguauaugccuuaguaaaucuucgaaacguaaaaacaguaggccuuaaagaugcaauuuugaugccugacaggauugcgaauaaggaccuuaaaaaaaaggucaaagaauuacucgcucaaggugacgaucucaaaaaaauaaaaaaauauuucgaaaccgaaaaagacacauggcaagauguagauguuaaaaaaauagaaguguauuauuuuagcgaagaaacagcaaaccauuacuaugcaacaaggaaacccuuugaugccaacguuaaaauagacucuguaaccgauacgggaauucaaaaaauucuaagacgccauuuagaagaaaacggaaauaaagcugaugucgcauucaguccugaaggcauagcuagaaugaaugaaaacauauucagguuaaacggaaacaaacaucaccaaccaauauauaaaguaagagucuacgaaaaagccaauaaauaucccguaggacagacagguaauaaggccaguaaauucguagaagcagcgaaaggaacaaaccuuuaccucgcaguauacgagucagaaguaguggauaaaaaaacagcagaaauuucuaaaaaaagaaguuaugugauuguaccacuaagagaugcaguagccagacaaaaacaaggcgucccuguggcacccgaaagaaaugaagaaggagggaaacuuuuauuuguuuuaagcccaaaagauuuuguauacguaccuacugaagaggaacgcucaaaaggcgaaguacuucugcccuuagacaaaaacagaauauauauaaugauggaugcaucagaugguauagucaauuuucuucccuacaguguagcaaaucuaauuuacgcucuaccaaaagaucaagcaagcgguuuuuguacagacggcaggaugauacaaaaugaauuuggguuagggucaccaaagagcaaaaaugaaagagcacuaacuggagaaaugauaaaagaaaucugucucccagugaaagucgacagauuaggaagaauaacugaaauaaacgggaacaaggucuga

SEQ ID NO: 5773 - RNA, 4644 nt, Artificial Sequence
  Cas9 variant
augaagaaaauucucggucuagaccugggaaccaacucgauaggaugggcacucacaaacaacgauuucgauaacaaauuaggaaguauagaaggauuagggucaagaauaaucccaaugagccaagacguauuaggaaaauucgauagcggcgugagcauaucucaaacggcagaaagaacuaaauacagaggcacaagaagauuaguacaaagauuucucuuacgcagagaacgccuccauagaauacuaaacauucuggacuuuuugccucgccacuacagcgaagccauagauuuugauaagaaauucggucaauuuaaaccagaacgcgaagaaaaacuaucuuucuacaaaaacgaaucaggcaaaaaucaauuucuauuuuuagaaagccaucaagaaauguucucagaauuuaaacucacacacccagaucuaaaacaaguaccauacgacuggacaauauauuaccuacggaagaaagcucuaacacagaaaauaagcaaagaagaacucgcuuggauuauucuaaauuucaaccaaaaacguggauauuaucaacuuagaggagaagaagaagaaguuaacaaaaacaaauuagaagaauuucauaccuuagugauagucgacguaauagaacgugaaaaaggaaaaaguggcguuugguacaacguaauacuggaaaaugguuggauauacaaacgugaaucuaaaauagcucucuuugacuggaucggaaaacagaaaaauuucauagucaccacagaauugaaugaugaugggacgauuaaacuaaacaaagacaaugaagaaaaacgaucauucagaagccccaaagaagaugacuggggucuaagaaaaauacgaacagaacaaacaauaaaccagagcgagaaaagcguugguucguucauauacgacgaacuacuaaagaaaccaaaucagaaaauaaaaggagaauuaguacggacgauagaacgaaaauucuauaaagaugaacucagcaaaauacuuaaagcacaaauaaccuuccacuaugaaaucuuaggagaccgaaacauuuacaagaaaugcauagacgaacuauacagacacaaugacucccauaaaaauaacauaaaagauaaaggcuucgacuaucuauuccuagaugacauuaucuucuaucaacgcccucuaaaaucaaaaacaucauugaucucggauugcagccuagaguucguccccauuaaagauaagaaaggcauacuugucaaagauucaaauggaaaacaaguaguaaaaccacucaaauguauagcuaaaucuaacccaauuuuucaagaguucagauuacuucaauuuguuaaaaaucuaaaaauauacaagaaagaaauaauaaacgaaauagauguaacaaaugauuacuuaaaaacagaagaagaccucguugaacuuuuugauuggcuaaacgauaaagcagaaauaucucaaaaacaauucuuagcuuauccaaaauucaaauuaaaagaagauaaauauagauggaacuucguagaagauaaaaucuacccguguaacgaaacacguaaccaauuucuuaaugcaauagcgaaaaucgacguuaacaaauccuucuucgacgccaaaaauacgcaagaccuguggcauauauuauacuccguaaccgacaaaacagaauuauucagcaucaacacugaaacuggcauucaaaguggcgcgcucucaaccuuugcaaaaagacauaacuuaucaaacgaguucgucuccaauuucucuaaaauuaaaccauauaauaaagauuauggaucuuauagugaaaaagcgauaaagaaacuauugccccuaaugagauuugguaguaacuggaacaaaaauaacauagaugcaaaaacacuagcacgaauagacaaacuucaaacaggagaguucgaugaaacaaugagaacgcgagugagagaaaaagcaauucaccuaagcaaaauuacugacuuccaaggcuuaccucucugguuagcaucauauauaauauaugauaggcauagcgaggcuucuaacauaagcaaauggaaaacaccugaagacauagcgugguuuuuaaaucccaaaaauaaaucaggcuucaaacaacacucacuccgaaaccccaucguagaacaaguaauaacagaaaccuugcggguagugaaagacauuuggcaacauuauggcgaaggaaaagaaaacuucuuuaacgaaauacauauagagcuaggcagagagaugaaaaacaaugccaaugacaggaaaaggauaacugaaaccauaaaccaaaacgaaaacacaaaccuaagaauaaaagcuauauuaaccgaauuaaagaacgacgggauaaaugacguaagaccauacucuccuucacaacaagaaaucuuaaaaauauacgaagaaggugucuacaauucagaaauacgaaaagaaaaauuggaagacauagauaaaauaaggaaaaaugcaaaaccaaccccgucagagauaauaaaauauaaacuauggcuugaacaagguuacauauccccauauaccggaaaacuuauaccacuaucagaccuuuucacaacuaaauaccaaauugaacauaucauaccucaaaguagacuauucgaugacucacuuaguaacaaggucauaugcgaaucagagguuaaugaccuaaaaggaaacaacaccgcacuugaguucauacucaaaaacgaaggaagaauaguucuccuaacaggaggaaaaacaguaaaaauauucacaaaggaagcauauaaccaacauauaacaaguuauuacaucaaaaauaaaaguaagcaaaaacgucucuuaacagaagaaauaccagaaaaguucauugacagacaauuaaaugauacgaaauacauuucuaaaaucgucaaaaacuuacuaucaaaaauuguacgcgaagaagaugaacaagaaguaacaagcaaacacauuguaucacucaacgguucgauaacuucacgcaugaaacaagacuggggacuaaaugacguauggaacaaaauaguaagcccaagauuugaaagauuaaacgcgaucaccaauucuaacgacuuuggaaaacucgaacuaaagaaagacgaguucggaaaugcaggcaaacaaguauuucaaacaacagucccagaugacauagcaaaaggguucuccaagaaaagaauugaucaccggcaucacgcucuagacgcauuaguaauagcauguauaaacagaacccacauaaauuaucuuaacaaccuaaacgcgaaagacgaaaaugauaaaacaaucaaacacgaauuaagaaauaaacugugcuucaaaacgaagccagauuccaacggcaacaguaaaugggaauuucauaaaccaugggagaacuucacaaagaaaguagaagacgaacuaaaccaaacaauuauaaguuuuaaacaaaacacgcgaguaauaaacaaaacaguaaauaaauaccaagucuggaaagaagaggauggugccaugaagaaaguuaccguaaagcaaacuaaaggcgauaauugggcaauaaggaaaccaauacacgcagaaacaguauccggaaagguuuucuuaaaacgaauaaaacaaucacacauaacuaucgccaacgcaauagagcaaaucgaauuaauaguugauaaagagguacgaaaacaacuaaaagcaaaaauaaaacaguauccgaauaacaaagaaggauucaagaaacacuuaaaggcuuuuccaaucaugauaaauggaaaagccauagacaaaguucaaauauacgaaacuauugaggccacagcgacaagagaaagaaacaaucuugauauaacauuugaugagaagaaaauagagaaaauuacugauacgggaauacagaaaauacuccucaaucaucuaaaacaagaaauauaucaaaaugcaauagacgagaguggaaagaaaauugcuccacacgagguagcauucucagaaauagguauagaugagcuaaauaaaaauaucaaaguucugaauaauggcaaaaaucaccaacccaucaaaaagguuagaauauucgaagaaagcaaacgauucagcuugggacagagugguucaaaaacggacaaguacguggaaaccgcaaaaggaacaaaccuauucuacgcuaucuaugaaggcaagaaaggcaauagaaauuacaaaacaauaccacuuaacgaaguaauagaaagacaaaaacaaggacuaaauagcgcauuaguuaccgacgaaaacgaaaauagauuauuauucacuuugaguccaaacgaucucgucuauauuccaacaaacgaggagaagaaaaaccuaacaacuauaaauuuugauaaacuaucaagagagcagacugaaagaaucuauaaauuugucaguugcacgucaggagaaggucacuuugucucgaacaacuacucaaaagaaauaauuaguaacgaaaauggaagcaauaauaagaacgaaaggaugcuugaguucaacaacagcaauacaauuuaugaugaaaaagaaaaaccaguaaugauaaaaucgguauguuggaaacuagaaguugaccgucucgguaaaaucaaaagaaucauaagguga

SEQ ID NO: 5774 - RNA, 4677 nt, Artificial Sequence
  Cas9 variant
augaagaaaauacuagguuuggaucuugguacaaacaguauaggaugggcguuagucaacguagauaaaaacggaaauccauuuggcauugaaggccuaggaucacgaauaaucccaauggaucaagcgacauuauccgacuucgagaaaggaaauucaaaaagucaaacagcagaaaggaccauguuucgaggagcaagacgcuuaagggaacgaaaacaccuaagaagagaaagacuacaccguauccuaaacgaacuaaacuuccuaccaauucacuacagaucauguauugauuuuguccauagguuagggaaauuuaaagcaaaccaugaaccaaaaauagcauggagauccaaugaucaggauaaaauggaguucauauuucagaauagcuuucuggagaugaugucagacuucacaaaaaggcagccggaauuagucaaagaaggaaagaaaauaccuuaugauuggacuauuuacuucuuaagaaagaaagcacuaggacaaagaaucgaaaaagaggaacuagcgugguuauuauuacacuucaaccagaaaagaggcuacuaccaauuaagaggagaagaugagauagacgcaacuagaucggcuaaaacacgaaaauacuucgaccgcaaaaucauaaaauccauaauagauaccggcgaagaauauaaaggacucaaaguacugauuguugaacuagauaauggaaaccaaggaaaaauauucaaacaagaaguacccgauuggguaggucaagagaaaaauaucauagccacaguagaucuagauaaagacggaaaagaccguuuugacaaaggaguauuaucccaaagauucagcauccccagugacagugaaugggaaaccgaauggaaacuaauaaaacuaaaaacggaagaggauuuagaagccagucagaaaaccgugggaacauacauuuacgauucacuauuaaagaauccaaaccagaaaauaaaaggaaaauuaguaaggacaaucgagcgaaaauacuauagggacgaauuaagagcuauccuaaacaaacaaagagaauuucauccugaauuaaaugacaagaaauuauaccaacacugcauauucucacuuuauccacaaaaugaggcauucagaaauagcaucgcuaacaaagacuucacauacuuauuucuagaagauauuaucuucuaucaaagaccucuaaaaucgaagaaauccacaaucaauaacugugcauaugaaguaaggcgguauauggauaaagaaacaaaagaacuaaaagaagugccacuaaaaugcauagcuaaaagucacccaauauuccaagaauuuagauuauggcaauucauaucuaaucuacgaauauauaagaaagacauaacagauauugaugugacaaaugauuuucuacacucgcaagaugacuacgcuaacuuauucgaaugguugaauaacaaaaacgaaauagaccaaaaagccuucuuaaaauaccccgcauucggauucaagaaagacgcagucaacuaucguuggaacuauguagaagacaaaagcuacccauguaacaaaacaagauccgcaaucuuaucaaaacuggauaaacacgaacaagaauuuuuaaccaaagagcuagaacucaaaauauggcaacuacucuacaguguaaacaguaaagaagagauagauaaagcauugaacgucaauucaccaaaaauuaauaacaaaauaagcaucgaucauacagggauucuccacgaacuaaaaagcagcucauugagcgauauuucaauucaaagacuuaaagcuauaaauuuugaggaaaaagacuacgggucauauagcuacaaagcaaucaaaaaguuacuggcauuaaugaggcaagggaaauauuucgauaauacagcaaucacagaugcaaccaaggcaagaaucaauagcauauuugaucgccuggaaucuauaaguuucgauccagaacguaucaauucaauaucugaugacgacauaccaaaacaaauacuaaaaucauucauaaaacucaaucgaacguauggagguuucaacacauaucaagcaugcuacgcagucuacggaaggcauagugaagcgaaagaaauagcgaaaugggaaaaacccgaagauauagaccaauaucuugccaaauuuaaacaacauaguuuacggaacccuauaguagaacaaauaauaacagaaaccuuaagagucgugagagacaucuggaaaaagcaugccuacaaaacaaucaacaaagacaaucaaggcaacaauugcgaaagcgaaagcgaauuaacugaaauacacauagaguuaggccgagacaugaaaaacaauaaaagcgagaggcuacgaaucucaagaauuaacucagaaaaugagaacacuaauuuaagaaucagaaaauuacuaaucgaguucaaugaccccgaguucggcguagaaaacguuagaccacacucucccucacaacaagaaaucuugagaaucuaugaagauggagucuuaaaauccggcguagaaaucccugaauacgucgauaacauuauaaagaaauuuaaggaaacagauguaaagaaacaaccguccaaaagcgaagugcugcgcuacaaauuauggcuagaacaaaaauaucgaucgccauauacuaaugaaguaauaccauuagggaaauuauucacaaaugacuaccaaauagaacacauaauaccacaaucgcgauauuucgacgacucauucaguaacaaagugauaugcgaagcugaaguuaaccaauuaaaagaaaaugaauugggaugcgaguucauaaugaauaauggugguagaauuguugaacugucauuuggaaaaacaguuagaauccuugauuuugaagcauacgaacaauuugugcaacaaaauuacgcuggcaacaggcccaagcuccgaaaccuacucaugacagaaauaccaaacgauuuuauagaucgacaauuaaacgauucucgauauauaucaaaaguagucaaaggauuauuaucuaauauaguaagggaagacggggaagcagaaagcacauccaaaaauuuaauaucauguacuggaggcguaacugcuagauuaaaaauggacuggggacucaaugacguauggaacaaccuuauauacccgcgcuucgaaagauuaaacgaacugacaaacucuaaucaauucggcuacugggacaagaaagaugguaaaaauguguuucaaacgcaaguacccauggauauacagaaaggauuuaacaagaaacguauagaucaccgacaccacgcauuagaugcccuuguaauugcaugcgcuacccgaucacauauaaauuaucuuaauaacgaaucagcgaaauccaacagcaaagaauccagauaugauuuaagacgaaaacugcgccgacuagaaguuauacagaaagaauauacaauaaacggaagaaaagaaauuagaaacauagagguagcaaaagaguuuuauaaaccauggaacucauucacacaagacgcgcagucagcguuagaaaauauaguaguaucguucaaacaaaaccuaagaguaaucaauaaaacaaccaacuauuuccuacguuucaauaaggaagguaaaaagauauucgaaacacaaacaaguggaucaaacugggcaauacgaaagccacuucacaaagacacggcauuuggacucguaaauuuaaaaaggaccaaaaccguaucccuagcaaaugcuauacuagacuacgaccaaauaguuaacagaaaacuauggacaaagauaaaagaacuaaucucaauaggauacgacaauaaaagaauauuaaaauacuuuacugaugacaaagaaaauuggaacgaaauaauaucaucaggaaucgagguguuuuauuacaccgacaauuucgaaaaacaaguugcuacgagaaaaccacuagauacaucuuuuacugaguccaagaucauuaacagcauaaccgaccucggaauccacaaaauacuauuggcgcaucuaagagccaaugaaggcaauccuaauauugcauuuucuccagaaggaauugaaacaaugaaucgacauaucugugaauuaaauggagggaaauuucaucacccaauauacaaagugcguguccacgaaccucuuggauauaaguuuaaaguaggugacaaaggaaaccguaguacuaaauauguagaggccgcaaaagguacaaacuuauucuucggcauuuacauaaacagucaaggcauacggucauaugagaccaucccacuaaacgucgcgauagaaaggcaaaagcaaggauuaucgccuguacccgauaacaacgaacuaggugaacgacugcuauuuuggcucucaccuaaugaccucguguauuuacccacauccgaugaaguggaaucuggaaucuguuguaacaaacuggguauagaucgcauuuacaaaauggucucuuguacagguuacgugggcgauuucauaccagcucacauagcaaacccaauaauacaaacacuugaacuagguucuaacaauaaagcgcaaagggcauggacaggagaaaugauuaaagaaauuuguauaccuguuaaaguagauaggauggguaacauagucgaaauauucaaucgaaacaaaaacuga

SEQ ID NO: 5775 - RNA, 4695 nt, Artificial Sequence
  Cas9 variant
auggcaaaaauacuaggacuagaccuaggaacaaacucuauaggaugggcaauaguagaugacaaaaauucaaaaauacuagacacagguguacgaauauuuccagaaggaguuguugcaaaaacaauagguaguggugacaaagaagaaagcaaaaaugcaaaaagacgcgaaucuagacaaacaagaaggggauucuacagaaaaagacuuaggaaaauaaaacuauuacggacacuaauaaauuucaaaaugugcccucuagaacacuucgaauuagacguauggaguaaaugggauaaaauuaaaaagaaagaaggaaggauggcaccggaacuauuuuuaccggaaaauagcgcuuacaaccuauggcugaaacaaaacccauacauauugagagauaaggcuuuauccaaagaccugacgcuaacagaguucgguaggguacuuuaccaucucauacaacgacguggauuucucucgaaucgcaaaggcaaagaugacgguaaaauauacggaggcaaagaagggauaguaggaauagacaaaacuaaugaacaaaucaaaaauucaacacuuggaaaauucuuauuuaaaauacuaccaaaagaaggugaacccuucaaaauaauagaagacgaacuaggaaacgaauuacgaguuaggucaagguauacucuaagagacauguauauagcagaauuugaggcaaucuggaauagacaagccaaacaccuaggguuagacaacauauacuacuccaaugucaaaaacguacuacuaaaaggaucccuuaaaaauaagaaaaaugaaaggaaaauaaaucaucuaaagaaaauaaaaggaaacggcaacauagaaauaauaacauuaaauaacaacuuaucuaaaaaugaaaaaccaaaauaccuacuaaaaauugcaacgaaacucccacuaaaagaauuuuuagcagggcguauagaaaaagaugaagauggcaaaauaaaauucaaaagcaaugaaucugucuuauucuggcaaagaccucucagaucccagaagaaacuacuugcuaaaugcagauucgagccagaccuaaaagacgacaacgggaaauuuauucaaaaaggcaaaacaccaugccauuuaagucacccacuauaugaagaauacagagcauaucaauaugucaauaacaucgaauacggcaagaaacaaagauuagaagaaagccagagaaaacaaguaauugauuugauaaauucgaaagacggaaacuuuaaauucucagaaauaaagaagaaacuaaaacuaagcuacgagaccuucaacuauucagacgacagcuccguaaaugguaacuauaugaucaaaaaucuaaauucaauauucccuaaagaaaucuuagaaaaagaguucguuguuaauguaaauaaagaggauauaauagaauacggauacgaaagaauauggcaccuguuucauuuuugcgaagacaacgauguacugauaaagaaacugcaagauaauuucgaucuaucggaaaacgauaucgagaaaauaucgaaaauaaacuuaaaagaagguuacuccaaugucagucucaaagcaaucaaaaacauacuuccguaucucaaagaagguaaauuguugagcgacgcaguaaucuuaggagguguaagaaauguauucgggaagaaauggcacgaguucauugauuuucaugagaaaauugaaaaagacauauuguauauaaaucaccagaaaagcaauaaagaaggggaagcaauagagaaaaucaagaaauaucucauagauuauaaauucggguucacagaaaacgacaauagauucaagaaauuauaccaccacucacaagauguagucgaaguaaaauuacagaagaaaauaggucccguggaagaucuaagaaaccccauuguucaacagggcguaaaugaaguaagaagacugguaaaugaauuacuugacguacauggaaaauuugaccaagugcguguggaauuaggcagagaucucaaaaauaauaaaagcaaaagagaagagauaggauacaaaauacgcgaaaacacagccaaaaacgaaaaagcaaaagaacugcuuaucgaguacggauuaagacaaucuagagacaacguacaaaaaguucuauuauuccaagaaauguuagacagaggcacaguagccguguguccauacacaaauaaaacuauaaauauaagugacguacuagggaacgaaaacaaaaugcaaauugaacacaucauaccuaaaucaauaucacuugacgacaguuuugcaaacaaaaccuuaugugauucaaaauuuaauggcuugaaaggugaaaggacuccauaugaguucuaucaaaucaauaaugacgcaaacuuauggggcgguucaaaaucaugggaagaaauagaaagaagaacauuuaggauauuaccuuauagcaaagcaaaaagguuuacaucaaaaacuaaauuugaaacuaacgacuucauccaacgacaacuaaacgacacucguuacauaucuaagaagacuaaagaaauccuaucacaaauuugcgaagaugugagaguuaugccagggucacuaacagcagaauuaagaaagcuauggggcuuaaauaacauucuacauccagccuuuguucuagauuuaccagccuuacacauagaugcaaauaaacauaucccacacuauguaguacuugacgaggacaacguaccuauccucucccaaagaauauacaaugacaaaccuauauugaaagcgaaucagacuagcaucaccggauucguagacaaugaaauauuuaagucaaaagagaaauacgucaaauuugaaguuaaagcucccaauuuaagcaauggcgaauauugggcgaaauuacuucuaagcaacccaaaaagcauaguucgaguuuuuaaggagaaacccaaaaguacggaaaaugaaauaguaguucgcggcaagaucgaaaaagaaaaguuuaagcacgaaggauuaucaggaaucaacgccgagggcaaagaaaauggaaccuacugggccaaacuuaguauaguagacaagaaauuuaagaaaccuaagaaagaugaucaaccaaagaaaaacggaaaacaaauccuucuuuucggcgcuguaaaagaaggaguauucagcucuuauauguacgaaugugaugcagacuuagaagauggaaaauacugguuaauauuagacauagauuuugaaaauguagaguucgaaaaagccuuaaacgagcgaccagaaguacuagaaaaucaaauacucauccaagguauaacuaacgaugaaaacguauucguuagcgauauggauugccaacaccaguuucuuaugaaugagggcaaaggaaaauauuacguccuauucgauauuauaagcgaaguaaacgaauuuuacccaauaaaaacgaaaucaccugaacuugagaauggacaaaguuuaacagaagguaccauuugggucgacaaauauacgggggaaauuaaauucgacccuaagaaaaaccgugaggaccaucggcaucacgcaauugacgcauuagucaucgcucuaacaaaagaaacuuacuuucaacaauuaucgagaagaaaugcaaguucugaaaauaagaaacguggcaacgaauaugagaaagaacaacuugauuucgcggaaccauggaaagaguuccauguagaugcacaaaaaucuauuaacagcaucuugauaucacauaaacaaaauaaaaacauccuaacuaaaauaaccaagaaaauaaccaaaaacggaaaaaccuacaaaucagagggaaugagcguacguggucaacuccacgacaaaacauacuacgggcacaacaaaaacuguaaagcggaugaauacgucuacagaguggacauaaauaaucuuaguuuuucacaacuaacaaauauuauugaccuaaaucuuaaagccgucauaguagaaggcgucaucaagaaauucgaggaaucagaaaagcuccuuuuuaagaaaaugaauaguaaaguacagaaccuagacaaaagcaaaguaaagaaaaucaaagcaaaaguagacaaaauccucaaagaaaccagcuucuuuaugccaaaugaagggaaaagguacauuagguuaaauaucauagaaccagccaauuuugaaagaaugccagucccaauuaaaaagguaagaauaagaaaaguccuacggaacgccgaaaaguugaacaaugaaauuaagcaauuuguagacccccaaaacaaccaccauguacuaauauacaaagaugaaaacggaaacuuaaaagaggaaguaguuacauucuggacaguaguagaaagaaaaagaacaggagaaccaguauacaaacuaccgucagauggcaagaaaauuguaaccacacuucaaauaaacgauauguuucuccugggauuaaacgaagacgaaauuaauugggaaaaucccaauuauaaucacuuaaaggaacauuuauacagagugcaaaaauuuacuucgggagauuuuuacuucagaauugcuaagacaagcucuauucaaaacggcgaagaaaaacaacaaauaaacucauuugguuuagggaagaauggaugguuaacccacaacccaauaaaaguaaaaaucucuguaaguggaaaaauacuaaaaguauga

SEQ ID NO: 5776 - RNA, 4713 nt, Artificial Sequence
  Cas9 variant
auggagaacucaaacaacucaaguaaaaaauacuaucuuggcuuagauaugggaaccgacuccuguggcugguguguuaccgaugauaaauacaauauuauacgaucucacaaaaaaauuuauggaccagaugggaaacuaguaaaaagagaaggaugccacuuaugggggucacgauuauucagaccagcaaacacggccaaaucaagacgacugaauagaacugcacgacgaagacucgcaagaagacgcagaagaauuaucuuacuaagggaacuguuccagccagaaauagacaaaguagacccaaauuucuuucgaaggcuagaccaaucaaauuuauggaaugaagacaaagauaaagagcuccaaauggaacacaacuuccuauucaaugacaaggauuuaacagauaaagaauauuacaaagacuuuccaacaauauaccaccuaaggaaagcgaugguaaacggauuaacaauaaacgguuauuauuaugacccaaaaaagcaauuugauauacgugaaguauaucuaguacuagcucauaugaucaaauauagagguaacuuucucauggaaggagauguaaaagauucagucguagaccccacauauuuaaaacaauguuucgauaacaucgacgucaucuugauaucgcuaaauaauggugaagacgaugagaacgaagacgauaaaauagauccaagcgagugcuguuucaacguagacgaaaaaaaagcuagaaaacuagcuaauaacuuccaagagacuaauaagguaagugaucuggaagacgacgaaagagacuuauuuggaaaauuuaacagcaaggauauaagaaagaaaauacugaaacucauaaacgguggaagcggcguuaaacuuaaagacuuccuacccaaagaaauucuaguagcacacgauggagaugaugaauauggagauaaaaaaauagaccucagcucagaaacguuagaagaugauauuaauggcuauucacuaccagaaucuuaugucgaaaucauacuagaggcuaaaaaaauauaugauuucaagaccuuagcauaucuauuacauggcaaauccuuauuaugugaugcaauggucaauguauacgaagaacauaaagaacaacuagcagcccucaaaagacuauacaagaaguacgcaacgaaagaacaauauuacuuuauguuuagagacagucgaauccucgauggagacgacucagacgacgaagaagauaaagaagaaucaaauaaagaagaaucaaaagacaaaaaaaaaaaggcuucauacguaucguacaucggauauacaaaaaccaauaguaaagccaaauauacuggugcucauaucacaagcgagaaaaacauaagugcacuaauuaaacaaauaaaagacgauuuaaaauucgacgacuuaaaaucaaaaguggaugacccuagccaacaaaacgaacuauccgacgaagacaaacucgacauccaauguauagaagaagcaaucgaaucgaacacauuucugccgcggcaaaacucgcgcaacaauggagccuuccccuaccaacucaaucuuaacgaaaugcgcacaauaaucgaaaaucaaucuaaauauuacccauuucuuaaagauaaagcaccaaguuuuccagacggcaaaacagaagaauacaaaauagugucccuccugaaauucaagauaccauauuacauaggucccuuaucacaacccaaugacuacgugagagacgacaagagggacaaccauuggguucaguucagaggagaaaacaaccaagggauuauaaauccauggaauuucagucaaaucguugauuuagaaggcaccgcagacaaauuuaucucaaauuuaaccaacuauugcaccuacauauuuggagaaaacacauuaccaaaagaaagccuaauuuuccaagcauacaaaguacuaaacgauuugaauaaucucaaaguaaauggcagccugauaagcaaagaggacaaggauuacaucauacaaaacguuuauuuaaaaaaaaaaaaaauuaaaggcaaagauauaguaaaugcauuaaaaaauaaauacaaauugagugaugaagaucccacaguaaccacaaaaggcagcggaaaaucaaucggugaagaugaaguggaccuaacaauguucaacaguaguuuaaguuccuuuauagacaugagcgauccaaacgcauucgggccagaauuuuacaaagauucaaacaaauuugaguuagcugagaaagucauagaacuaauuacuauaguagaagauaaagacuuguugaaggaaagacuaaaaaaauuaggccucagcgacaaccaggucaacuaucucuuuaaacaaaaauacucgggaugggcaccucuaagucgcaaacuucucgacggaaucacaauagauuguguaaaugaaaacaccggcgaagcauacccagugaccaucaucgauguaaugcgagacacuccacuaaauuucauggaaaucuaugaaaccaaagaaagccaauuuucuggauucaaggaaaaagucgcggaguugaacgaugaaaaaaaacuuucgcgagaugaucuaauagaagagagcuacgcaagucccgcaaugaaacgaagcguacgccaaaccuuuaaaguaauagacgaacuaaaaaauacccuaaacaucgaccauuuugauagaauauuuguagaagccacacgagcgccuggugaagcaggaaaaaugguuaaaucacguaaaaaacaacuacaagaagccuaugacgcagccaaggaucuuguagaucaagaaucccgagacgaccuacaaaaacuaagagaugaucuugaaaaacaaaccgacgaccaacucagaagaaaaaaaguguaccucuauuuuaugcagcuaggcagaucaguauacagcggagaaaagauagacuuaaacgaauuagauaaaaacuacgacauagaccauauuauuccgcaggccaaacuaaaagacgacucguuuaauaauauggucuuagucgaacgugaauuaaacaacaagaaacaagaugaauacccgauaccuagcaccauuauaucagaacacgguagaaacuggauacaaaagcuagcuaaaauucaagacaaaaacaaaaggaguuauuuuaugcccaaagauaaagcaaaccgauuauugagaccagaaucgaaacaauuaacaagcgacgagcugaacggauucauuaaucgacaacuaacacuaacgaaccaauccguaaaagcaguuugcgauauccucaaaaugacagaaaagggaagugaaauaguuuauucuaaagcaaacuuugucucagauuuuaggaaacuuugcggcgagcuaagaccaagcuaugaugcauucguaaaaguacgagacaucaaugacuuccaccaugcaaaugaugcauaccuaaacaucguaguuggaaacguauacuacgaaaaauuuaaaaauuuuuacauuaauaaccguauagacuacgacaauaauggcaaaaaagaccucucaguccucgccagcaaacuauucacaaagacacaagcagacgacaaaacaggaaacauauacugggaggcuagauuucacaaugaaaaagagacagauucaaauggaaaagaaagaacaauaaaaguacgagaugaggguacagaaucaacauuugauaagauagaguacuacauggaacucaacgauccacuuguaacacagaugcaauauacacuuagugggaaacaaggauuuuuuaaaaaaauuacccuaaaaacaaaagccaaagacaaugaagacaauagcgacaaacuauuuccacugaaacaauauuuacgaucggauaguaauaaaguaauggauguuaauaaauauggaggcuacucugacaugauaacaccauacuuuaugcuaguccaaagugaagggaagaaaggaaaacauauauacucccuagaaucaauaccaacaauauacuuaaagucauucaaaaaaaaagaagaagauauaauuaacuacuugucaugcaaaaacaaauuaaaaaaucccguggucauuucugacaaacucuuaaugcgaacaauagucaaaauaccauacuucaaaaacgacagcaacuuaucccuagucaaacuagguacaucuggaagaacugguaauaacauaauuuauauaaaccuaucagaacuaauccuaccaauagaguggaaaaacuacuacagaaaaaucucaaacuuacugggaacaaacguaucaaguacaaaacccaaagaccuaaguaaauucaccgagcaaaugaaaaacgaucccacgagcacgcuaguugaugggucaaacaaagucgaacacgauaagaauaaucgauucuucaguuacuuaaucaacaacguuauuaacaaaccaauauucgaaggacuacccaaaaccucgugcaguuucauaaaauuagaaucaaaauacgacgaauucugcucauuaaauacacuagaacaagcaaaaauaauagcaacaaucauuaaacuacuaucaugcaaaaguguacaaggaugcaaacuuucuaaucugaguggacuacccagcucuuuaggugcacugauauccaauaaagcccuaacagaaggaacgaucauaucaaaggaauccaguugcgguuuaaaagaaaacaucauauucguaguaccaaacgacuga

SEQ ID NO: 5777 - RNA, 5067 nt, Artificial Sequence
  Cas9 variant
auggaauuuaagaaaguauugggauuagacauagggaccaauuccaucggcugugcauuauuaucccugccgaaaaguauacaagacuacgguaaaggaggacguuuagaauggcucacaaguagaguaauaccccucgaugcugauuacaugaaagccuucauagaugguaaaaauggccuaccucaaguaaucacccccgcuggcaaaagaagacagaaaagaggaucacgaagacuaaaacauagauauaaauugagaagaucaagacuaauaagaguuuuuaaaacauuaaacuggcugccagaagacuucccauuggacaacccuaaaagaaucaaagaaacuauaaguacagaaggaaaauuuucauuccguauauccgacuacgucccaaucagcgacgaaucuuaccgggaauuuuaucgugaguucggauacccagaaaacgagauugaacagguaaucgaggaaauaaauuuuagaagaaaaacaaaaggcaaaaacaaaaacccaaugauaaaacuucucccagaagacuggguaguguauuacuuacgcaagaaagcguugauaaaaccuaccaccaaagaagaacucauuaggauaaucuaucucuuuaaucaaagaaggggauuuaaaucuucgagaaaagauuugacagaaacagcuauucuagacuaugaugaauuugcaaaaagacuggccgaaaaagaaaaauacagugccgaaaacuaugaaacaaaauuuguuucuauaacgaaaguaaaagaaguaguggaacucaaaacagauggaaggaaagguaagaaacgauucaaaguuauucuagaagauagcagaauugaaccauaugaaauugaacguaaagaaaaaccagauugggaaggaaaagaauauacuuucuuagucacacaaaaacuagaaaaagggaaauucaaacaaaacaaaccugacuugcccaaagaagaagauugggcauuaugcacaacugcacucgauaauaggauggggucaaaacaucccggagaauuuuucuucgaugaacuacuaaaagcauucaaagaaaaacguggauacaaaauaagacaauauccugucaaucgcuggagauauaagaaagaacuagaguucauuuggacaaaacaaugucaacuaaacccagaacuaaauaacuuaaauauaaauaaagaaauuuuaagaaaacucgcuaccguucuguauccgagccaaagcaaauucuuuggaccuaaaaucaaagaguucgaaaauucagauguucuacauaucaucucagaagauauuauauacuaucaaagagacuugaaaagucaaaaaucacuaaucucugaaugcagauacgagaaaagaaaaggcauagauggagaaauauauggacuaaaauguauaccuaaaucaucaccccuauaccaggaauuuagaaucuggcaagacauucauaauaucaaaguaauaagaaaagaaagugaaguaaacggcaaaaagaaaaucaacauagacgaaacacagcuauacauuaacgaaaauauaaaagaaaaacuauuugaacuauuuaacucaaaagauagucuaagugaaaaagacauccucgaacugauaaguuugaacauaauaaacucaggcauaaaaaucaguaaaaaggaagaggagaccacucauaggaucaaucuauucgcaaaucgaaaagaacucaaaggaaaugaaacgaaaagcagguacagaaaagucuuuaaaaagcugggcuuugacggagaauauauucuaaaucauccaagcaaacugaauaggcuauggcauucagacuauucgaaugacuacgcugacaaagagaaaaccgagaaaaguauacuguccuccuuaggcuggaaaaacagaaacgguaagugggaaaaaucaaagaacuacgauguguuuaauuuaccacucgaaguugcaaaagcaauagccaaccuacccccauuaaagaaagaauauggaucuuauuccgcguuagcuauaagaaaaaugcuaguaguaaugagagauggaaaguauuggcaacauccagaucaaauagccaaagaccaagaaaacacaucgcucaugcuuuucgauaaaaaccuaauacaacuaacaaauaaccaaagaaaaguucugaacaaauaucucuugacccuagcagaaguacagaaaagaaguacccuaauaaagcaaaaacucaaugaaaucgaacacaacccauacaaauuagaacuugucagcgaucaagacuuagaaaaacaaguacuaaaaucauucuuagagaagaaaaaugaaagcgauuaccuaaaaggcuuaaaaacauaccaagcggguuaucugauuuaugguaaacauucagaaaaagacguuccuauagugaauagcccagaugaacucggagaauauauaagaaagaaauuaccaaacaacucacuaagaaauccgauuguggaacaaguaauaagagaaacaauauuuauagugcgugauguuuggaaaucauucgguauaauagaugaaauccauauagaacuuggaagagaauugaaaaacaauagcgaagaaaggaagaaaacaucagaaagccaagagaaaaacuuccaagaaaaagaacgcgcuaggaaacuacuaaaagaauugcucaauuccucuaacuuugaacacuaugaugaaaacggaaacaaaauauuuucaaguuucacaguaaacccuaacccagauucaccucuugacauagaaaaauuuagaaucuggaaaaaucaaucuggacucaccgaugaagaacuaaauaagaaauuaaaagaugagaaaauuccaacagaaauugaagucaagaaguauauauuguggcuuacacaaaaaugcagauccccauauacgggaaaaauaauaccccuaucuaaauuguucgauaguaauguguacgagauagaacauauuauaccuagauccaaaaugaaaaacgauagcacuaauaaccucgucauaugugagcuuggcguaaacaaagccaaaggugaccgacuagcagcuaauuucauaucagaaaguaacgguaaaugcaaauucggagaggucgaauauacucugcuaaaauacggagauuauuuacaauauugcaaagauacguuuaaauaccaaaaagcaaaauauaaaaauuuauuagcaacagaaccaccugaagacuucauagaacgacaaauaaaugauacaagauauaucggcagaaaauuggccgaauuauuaaccccaguaguaaaagacagcaaaaacauuauauucaccauaggcucaauaacaagcgaauugaaaauaacuuggggucuaaauggaguauggaaagauauauuacgcccucgcuucaagagacuagaaaguauaauaaacaagaaacugauauuucaagacgaagacgaccccaacaaguaucacuuugauuugucaauaaauccacagcuagauaaagaaggguugaaaagauuagaucacagacaucacgcguuagaugcuacaauaauagcagccacgacuagagaacacguuagauaccuaaauucguuaaacgccgcagacaacgacgaagaaaaacgagaauauuuccuaucucuaugcaaccauaagauaagagacuuuaaguuaccgugggagaacuuuaccucggaaguaaaaaguaaacuguuaucaugcguuguaaguuacaaagagagcaagcccauacucucugacccuuucaauaaauaucuuaaaugggaauacaaaaaugguaaauggcaaaagguauucgcgauacaaaucaagaaugacagauggaaagcugugcgacgauccauguuuaaagaaccaauuggcacaguauggaucaagaaaauaaaagaaguaucacuaaaggaagcaauaaaaauucaggcaaucugggaagaagucaaaaaugaccccguaaggaagaagaaagaaaaauauauuuaugaugacuacgcucagaaagucauugcuaagaucguccaggaauuagggcuaaguucaucaaugagaaaacaagaugacgaaaaacuaaauaaauucauaaacgaggcaaaaguuagcgccggaguaaacaaaaaccuaaauaccacaaauaaaacaauauacaacuuagaaggcagauucuaugagaaaauaaaaguagcagaauacguacuauacaaagcaaaacgaaugccacuaaacaagaaagaauauaucgagaaacugucauuacagaaaauguucaacgacuuacccaacuuuauuuuggagaaaucaauccucgacaacuaccccgaaaucuuaaaagaacuagaaucagacaauaaauauauaauagaaccacauaagaaaaauaauccaguaaauagauuauuacuugaacacauccuggaauaccacaauaacccgaaagaagcauucucaacagaaggauuagaaaaacuaaauaagaaagcaaucaacaaaauaggaaaaccgauaaaauacauaacccgacucgauggcgauauaaaugaggaagaaauauuuagaggcgcaguauucgagacugacaaggguaguaacguauacuuugugauguaugaaaauaaucaaacgaaggacagagaauuucuaaaacccaacccaucaauuagcguauuaaaagccauugaacacaaaaacaaaauagacuucuucgcgccaaauagacuaggcuucaguagaauuauacugucucccggagacuuaguauauguuccaacaaaugaucaauaugucuugauaaaggacaauaguucuaacgaaacaauuaucaacugggaugacaacgaguucaucucaaacaggauauaucaaguuaagaaauucacaggaaacuccugcuacuuccuuaaaaacgauauagcaucuuuaauacuuagcuauucagccucgaauggugucggcgaguucgggagucaaaauauuagugaguacucaguagacgacccaccaauuagaauaaaagacgugugcauaaaaaucagaguugaucgcuuaggaaauguacggccacuauga

SEQ ID NO: 5778 - RNA, 3924 nt, Artificial Sequence
  Cpf1 variant
augacacaauucgaaggcuuuaccaaccuuuaucagguaucaaaaacucuacguuucgaacugaucccacaaggcaaaacacuuaaacauauacaagaacaaggauuuauagaagaggacaaagccagaaacgaccauuacaaagaacuuaaaccaaucauagacagaauauauaaaaccuacgcagaucaaugccuacaacuuguucaacuugacugggaaaacuuaucagcagcaauagacucauauagaaaagagaaaacagaagaaacaagaaacgcacuaaucgaagaacaagcaacauaccgaaacgccauacaugauuauuuuauaggccgcacugauaaccuuacugacgcuauaaacaaacgacaugccgaaauuuacaagggucuuuucaaagccgaauuauuuaaugguaaaguccuaaagcagcuaggaaccguaacaaccacagaacacgaaaacgcccuccuacgcagcuuugacaaauuuacaacuuacuucucagguuucuacgaaaaucguaaaaauguauucucagcagaagacaucagcacagccaucccacacagaaucguccaagauaauuucccaaaauucaaggaaaauugucauauauucacccgacuaauaacagcuguuccaucccucagagaacauuuugaaaauguaaagaaagcuauagguauuuucguuuccacaucaaucgaagaaguuuucagcuuuccguucuacaaucaauuacuuacacaaacccagauagacuuauacaaccaauuacucggcggaaucaguagagaagcaggaaccgagaaaauuaaaggccuuaaugaaguuuuaaaccuagcaauacagaaaaacgaugaaaccgcacauauaauugcaucucuaccacaucgauucaucccacuuuuuaaacaaauacuauccgaccguaacacauuaucuuuuauacuugaagaauuuaaaucagaugaagaaguaauacaaucuuuuugcaaauacaaaaccuuacuucgcaacgaaaacguacuagagacagcugaagcacuuuucaacgaauuaaauucaauagaccuuacccacauauuuauaucucacaagaaauuagaaacaauuagcucagcacucugcgaucauugggacacguuaagaaacgcucuauacgaacggagaauaucagaacuaacuggaaaaauaacaaaaucggcaaaagaaaaaguacaaagaucccucaaacaugaggacauuaacuugcaagaaauaauaucagcugccggaaaagaacuaucugaagcauucaaacagaaaacaucugaaaucuuaagccacgcacaugcagcuuuagaccaaccuuuaccaacaacccuuaagaaacaagaagaaaaagaaauauuaaaaucccaacucgacucucuauuaggacuuuaucauuugcucgauugguuugcaguugacgaaucuaacgaaguugaccccgaguucucagcuagauuaacgggaaucaaauuagaaauggaacccagccuguccuuuuauaauaaagcaagaaacuaugcaacaaagaaaccguauagcguugaaaaauuuaaacuaaacuuccaaaugccaacucucgcaaguggcugggacguuaauaaagaaaagaauaacggagcaauccuuuuugucaaaaauggauuauacuaucuagguauaaugcccaaacaaaaaggcagauauaaagcccuaucguuugaaccaacagagaaaacaucagaaggauucgacaaaauguauuacgacuauuuucccgacgcugcgaaaaugauaccuaaauguagcacccaacuuaaagcaguuacagcucauuuccaaacucauacuacaccuauauuacucucaaauaauuucauagaaccuuuagaaaucacaaaagaaauuuacgacuuaaacaaucccgaaaaagaaccaaagaaauuucaaaccgcauacgccaagaaaacaggagaccaaaaaggauauagagaagcacuguguaaauggauagauuuuacaagagauuuccucucuaaauauacaaaaacgacauccauagacuuaucuagucuaagaccaucaagucaauauaaagaucuaggagaauacuacgccgaauuaaauccauuacuuuaucacauauccuuccaacgaauagcggaaaaagaaauuauggacgcuguagaaacaggaaaacucuaccuauuucaaaucuauaacaaagauuucgcuaaagggcaucacgguaaaccaaaucuucauacauuauauuggaccggauuauucagucccgaaaaccucgcaaaaaccucaauuaaacuuaacggccaagccgaauuauuuuaccgaccaaaauccagaaugaaacgcauggcacauagacuaggugagaaaaugcucaacaagaaacuaaaagaccagaaaaccccaauucccgauacccuauaucaagaacuauaugacuacguaaaccacagacuaagucacgaccuuagcgaugaagcacgagcccuacugccaaaugucauuacuaaagaagucucacaugaaauaauuaaagaucgacgguucaccucagauaaauucuuuuuccacguaccaauaacccuaaauuaccaagccgcaaacucacccaguaaauuuaaucaacgaguaaacgccuacuuaaaagaacacccugaaacuccaauuauaggaaucgaucgaggcgaaagaaaucucaucuauauuacuguaaucgacagcacuggcaagauauuagaacaacgaucacucaauacaauacaacaauucgacuaccaaaagaaguuagacaauagagaaaaagaaagagucgcagcaagacaagcauggucuguaguuggcacaaucaaagaccuaaaacaagguuaccuuucacaaguaauucacgaaaucguagaucucaugauucacuaccaagccguugucguacuugaaaaccuaaauuuuggauucaaaucaaaaagaacaggaauagcagaaaaagcgguauaucagcaauuugagaaaauguuaauagacaagcuaaauugucuaguccuaaaagauuaccccgcagaaaaagucggcggaguacuaaacccuuaccaacuaacagaucaauucacuuccuucgcuaaaaugggcacccaaagcggauucuuauucuauguaccggcaccauauaccucgaaaauagauccauuaacaggcuucguagauccguucguuuggaaaacaauuaaaaaccacgaaucccgaaaacauuuccuagagggcuucgacuuuuuacacuaugaugugaaaacaggagacuucauacuucacuucaaaaugaacagaaaccuaucauuccaaagaggauuaccaggauucaugcccgcaugggauauaguuuucgagaaaaacgaaacucaguucgacgcaaaaggaacucccuuuaucgcuggcaaacgaaucguacccgucauagaaaaucaucguuucacaggaagauauagagauuuauauccagcaaacgaacugaucgcccuacuagaagagaaagggauaguuuuuagagacgguagcaacauacuacccaaauuauuagaaaacgacgacucgcacgcuaucgacacaaugguugcgcuaauaaggagcguacuacaaaugcgcaauuccaacgcagcaacgggggaggacuauauaaauagcccaguucgugaucucaacgggguaugcuucgacucuagauuucaaaauccagaauggccuauggacgcugacgcuaacggagccuaccacaucgcacuuaagggacaauuauuacucaaucacuuaaaggaaucgaaagaccuaaaacuacagaacggaauuucaaaucaagauugguuagcauauauacaagaauuaagaaacuga

SEQ ID NO: 5779 - RNA, 3903 nt, Artificial Sequence
  Cpf1 variant
augucaaucuaucaagaauucguuaauaaauacucauuaagcaaaaccuuaagauuugaacugaucccccaaggaaaaacacuagaaaauauaaaagcuagaggccucauauuagaugacgaaaaaagagccaaagauuacaaaaaagcaaaacaaauuauagacaaauaccaucaauuuuucauugaagaaaucuuaucaucugucugcauaagugaagaccuccuacaaaacuacagcgauguuuacuuuaaacucaaaaaaucagacgacgacaacuuacaaaaagauuucaaaagcgcaaaagauaccaucaaaaaacaaauauccgaauacauuaaagacucagaaaaauucaaaaaucuauuuaaucaaaacuuaauagacgcaaaaaaaggucaagaaucugaucuuaucuuauggcuaaaacaaagcaaagauaauggcauagaacucuucaaagcuaacuccgacauaaccgauauagaugaagcacuagaaauaauuaaaaguuuuaaaggauggaccacguauuucaaaggauuccaugagaaucgaaaaaacguguacagcucuaaugauauaccaacaucaauuauauacagaauaguugacgauaaucuaccgaaauucuuagaaaacaaagccaaauaugagucucuaaaagauaaagccccagaagcaauuaauuaugaacaaauuaagaaagaucuagccgaggaacucaccuucgacauugauuauaaaacuucagaaguaaaccaaagagucuuuagucuagacgaggucuuugaaauagcaaacuucaauaacuacuuaaaucaaucaggaauaacaaaauuuaacacgaucauaggaggaaaauuugucaauggcgagaauacaaaacgaaaagguauuaaugaauacauaaaucuauauagccaacaaaucaaugauaaaacgcuuaaaaaauacaaaaugucagugcuauuuaaacaaauauuaucagauacugaaaguaaaucuuuuguuauagacaaacuagaagaugacagcgacguuguaacaacaaugcagucauucuacgaacaaaucgcagcguuuaagacaguugaagaaaaaucaauaaaagaaacacuaucccuucuauuugacgaucuaaaagcacaaaaacuagaucuaagcaaaauauauuucaaaaacgauaaaucacuuacugaucuaucacaacaaguuuucgacgacuauucggucauaggcacagcaguacuagaauauauaacccaacaaaucgccccaaaaaaucuugacaacccaagcaaaaaagagcaagaacuaauagccaaaaaaacagagaaggccaaauacuuaagucucgagacaauaaaauuagcccuagaagaauucaacaaacacagggacaucgacaaacaaugcagauuugaagagauauuagcaaacuucgcggcaauccccaugauuuucgacgaaaucgcacaaaauaaagacaaucuagcacaaauuuccaucaaguaccaaaaccaaggcaaaaaagacuuauuacaagcuucagcagaagaugaugugaaagcaaucaaagaccuauuagaucaaaccaauaaucuauuacauaaacuaaagaucuuccauauaagucagucagaagauaaggccaauauccuagacaaagacgaacacuuuuaccuagucuucgaggagugcuacuuugaauuagccaauauaguaccguuauauaauaagauacgaaacuacauaacccaaaaaccauauucugacgaaaaguucaaacucaacuuugaaaacucaacacuugccaacggaugggacaaaaacaaagagcccgacaauacagcaauacucuuuauuaaagaugauaaauacuaccuaggagucaugaacaaaaaaaauaacaaaauauucgacgauaaagcgauaaaagaaaacaaaggagaaggauauaaaaaaauaguauauaaacuccuuccaggagcaaacaaaaugcuaccaaaagucuuuuucucugcaaaaucaaucaaauucuacaacccaucagaagauauacuacgaauccgcaaucacucaacgcacacaaaaaauggcucaccacaaaaaggcuacgaaaaauucgaguuuaauauagaagauuguagaaaguuuauugauuucuacaaacagucaaucucuaaacacccagaauggaaagacuucggcuuccguuucagugauacacaacgcuacaauucuauugaugaauuuuaccgagaagucgaaaaccaaggauacaaauuaacuuuugagaacauauccgaauccuacaucgauuccguaguuaaccaaggaaaacuuuauuuauuccagaucuacaacaaagacuucuccgcauacaguaaaggaagaccgaaucuacacacacuauauuggaaggcauuauucgaugagcgaaacuuacaagauguaguauauaaauuaaauggagaagcugaacuauucuaucguaaacaguccauuccaaaaaaaaucacacauccugcgaaagaagccauagcaaacaaaaacaaagauaacccaaaaaaagaauccguauucgaauacgaccuaauaaaagacaaacgcuuuacagaagauaaauucuucuuccauuguccuauuacaauaaacuucaaaagcucgggagccaauaaauucaacgaugaaaucaauuuacuacuaaaagaaaaagcaaaugacguucacauacucaguauagauagaggagaaaggcaccuagcauauuacacgcucguugaugguaaaggaaauauaauaaagcaagacaccuucaauaucauaggaaaugacagaaugaaaacuaacuaccacgauaaauuagcagcuaucgaaaaagacagggacucugcaagaaaagauuggaaaaaaaucaauaacauuaaagaaaugaaagagggauaucuaucccaaguaguacacgaaauagcgaaauuaguuauagaauacaaugcgauaguuguauucgaagaucucaauuucgguuucaaaagaggccgcuuuaaaguugaaaaacaaguauaucaaaaacuagaaaaaauguuaaucgaaaaacucaauuaucucguauucaaagauaaugaauucgacaaaacgggaggaguacuccgagcauaccaacuaacugcacccuuugaaacauuuaaaaaaaugggaaaacaaaccggaauaaucuacuauguacccgcaggauucacuuccaaaauaugcccagucacaggcuucguaaaccaauuauacccaaaauacgagucagugucaaaaucccaagaguuuuuuucaaaauuugacaaaauuuguuacaaccuugacaaagguuacuuugaauucucuuucgacuacaaaaacuucggagauaaagcagcuaaaggcaaauggaccauagcgucauuuggaucucgguuaauaaauuucagaaauuccgacaagaaccauaacugggacacccgagaagucuacccaacuaaagaauuagaaaaacuucuaaaggacuacagcauugaauacggacacggcgaauguaucaaggcugccauaugcggagaauccgauaaaaaauucuucgcaaagcugacaucaguauuaaacacuauauugcaaaugagaaauagcaaaaccggaacugaacuugauuaccuaaucucacccguagcugacguaaacggcaacuuuuucgacucccgucaagcaccaaaaaacaugccccaggacgccgacgccaauggcgcauaucauauaggccuaaagggcuuaaugcuacucggacgaaucaaaaacaaccaagaaggcaaaaaacugaacuuaguaauaaaaaaugaagaauacuucgaauucguacaaaaucgaaacaauuga

SEQ ID NO: 5780 - RNA, 1341 nt, Artificial Sequence
  Cpf1 variant
augaaaccagacauaaaagaccgagaauauauguauagacuuauuauaggacaauuauuuuacgacggacaccaacaaauagcaguaaaucucgcaaacacauuaggaugcuccgccccaccaccaccaccaucagauaaauuauuccgauuaguuacaauugcaaaacaauuuguagaagacccagacuauaaagcagaagaaaacacaaugccaaugcaauucgaaacaucaagcgcaggacuagacuuacaauaugaugcagacguagcagcaacaucaccagaaccaucacaauacgaaacaauauaccuaacuguccacaaagcaccauguagagcugcagcauuuaauagcgauggaucacuaauugcaacaggaucagcagacugcucuaucaagauaauggacguagaaaggauacuagcuagagaaaaagaacacagagaaaugaaugagaaugguccagacgcacaccacccaguuauaagaacauuauaugaccacguagauguaagaagggauuuugguagauuuucagacaaaauauuagacuuucaagauguaaauacaguaauauuucacccacgagaugcaauauuaauaucaggaagcaacgauaaaacaguaaaauuauuugauuucucaaaaacagcaguaaaaagagcaaugaaaacacuaucugaaguauacccuguaagggcauuaucaugucacccaggaggcgaauuucuccuuguagcaacagaucauccaacaguaagacuuuacaauauagaaacugcacaagcauacgcuucagcuaacccugacgaucaacauagagaaucaguaacagauguacacuauucagaaaaugcaagacuauacguaaccgccucaaaagauggcgauguaaaagucugggauggaguaucaucaagaugcguagaaacauuuaaaagagcacaugacggaaguucaauaugcagcgcaaaauuuacuaaaaauggaaaauauauauuaacaucuggaauggauagcauaguaaaacuaugggaauuaaguaccaacagaugccuaauaguuuauacuggagcuggcgcuacaggagcacaagacuaucccacaucagccucauucaaucaaaacgaagacuuuguuuuauucccugacgaaaaaucuggcuccaugugcucaugggaagcuagaaaugcagaucgaaaacgucuauuagcacuaggacauacuucagcuugcagaacuuuuguccauaguccuaguaugccugccuucaugacaggaucagaugaucacagagcacgauuuugguauagaaaaccaacaacaaacgacaauuga

SEQ ID NO: 5781 - RNA, 1293 nt, Artificial Sequence
  Cpf1 variant
augaaaccagauauaaaagauagagaauacauguauagauuaauaauaggacaacuauuuuaugauggacaucaacaaauagcaguaacacucgccaauacacuaggcugcagugcuccugcaccuccaccaucagauaaauuauaccgucuuguuacaauugcaaaacaauuuguagaagacccagauuacaaagcagaagaaaaaucuuuaccaaugcaauucgaaaccguaucaacaggacucgaccuugaauacgaugcagacguccaaccaguaucaccagaaccaagccaauaugaaacaaucuaucucacaguacauaaagcaccauguagagcugcagcauucaacucagacggaagucuaguagcaacagguucagcugauuguucaauaaaaauaauggacguagaaagaauauuagcacgagaaaaagaacaccgagaaaugaaugaaaauggaccagaugcacaccauccaguaauaagaacauuauacgaccacgucgacgacguuaacacaguacuauuucacccaagagaugcaauauuaauauccggaucaaaugacaaaacaguaaaauuauuugacuucucaaaaacagcaguaaaaagagcaaugaaaacucuaucagaaguauacccaguaagagcauuaucaugucacccagguggagaauuucuauuaguagcaacagaucacccaacaguaagauuauacaauauagaaacagcacaagcauacgcaucagcuaacccugacgaucaacacagagaaucuguaacagauguucauuacucagaaaaugcuaggcucuacguuacagcauccaaagauggagauguuaaaaucugggauggagucucaaauagauguguagaaacauuuaaaagagcucacgauggaucagccauaugcagugcuaaauuuacuaaaaauggaaaauaccuacuaacaucaggcauggauaguauagucaagcucugggaauuaucaacaaacagaugccuuauaguauauacaggagcuggagcaacaggagcacaagacuacgcuacaucagcaucauuuaaccauaacgaagacuacgucuuauucccagacgaaaaaucuggaucaauguguagcugggacgcaagaaauagcgauagaaaacgacuguuagcacuaggacacacaagugccugcagaacauuuguccauucaccauccaugccagcauucaugacaggaucagaugaccauagagcaagauuuugguaucgaaaaccagcaaccacagacaauuga

SEQ ID NO: 5782 - RNA, 3690 nt, Artificial Sequence
  Cpf1 variant
auggccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaauga

SEQ ID NO: 5783 - RNA, 3903 nt, Artificial Sequence
  Cpf1 variant
auguccauauaccaagaauuuguaaacaaauacucauugucaaaaacauuacgcuucgaacuuaucccacaaggaaaaacccuugaaaauaucaaagcacguggauuaauacuagacgacgaaaagcgugcaaaagacuauaaaaaagcaaaacaaauuaucgauaaauaucaccaauuuuuuauagaagaaauccuaucaaguguaugcauaagugaggauuuacuacagaacuauucugacguauauuucaagcuuaaaaaaucugaugaugacaaccuucaaaaagacuuuaaaagcgcaaaagacacaauaaaaaagcaaauaucagaauauauuaaagacuccgagaaauucaaaaaccuuuucaaccaaaacuuaauugacgcuaaaaaaggacaagaaagcgacuuaauacucuggcucaaacaaucaaaagacaacggaauagagcuauucaaagccaacuccgacauaaccgacaucgaugaagcucuggaaauaaucaaaagcuuuaaaggcuggaccacauauuucaaagguuuccacgagaauaggaaaaacguauauuccucagacgacauaccaacgucaauuaucuauagaauagucgaugauaaucucccaaaauuuuuagagaauaaagcaaaauacgaauccuuaaaagauaaagcacccgaagccauaaacuaugaacaaauaaaaaaagaccuagcagaagaacuaacauucgauauagauuacaaaaccucagaaguaaaucagagagucuuuagccuagaugaaguuuuugaaauugcaaauuuuaauaauuaccucaaccaauccggaaucacaaaauucaauacaauaauagggggaaaauucgucaauggagaaaacaccaaaaggaaaggaaucaacgaauacauaaaccuauacucccaacaaauaaaugauaaaacacucaaaaaauauaaaaugaguguucuuuucaaacaaauauuaucagauacagaaaguaaauccuucguaauagacaaacuugaagaugauucagacgucguuacaacaaugcaaaguuucuaugaacagauugcugccuucaaaacaguugaggaaaaaucaauaaaagaaacccuaucacuuuuauucgaugacuuaaaagcccaaaaacucgacuuaucaaaaauauacuucaaaaaugacaaaucacuuacagaccuaucccaacaaguauuugaugauuacuccguaauaggaacugcaguuuuggaauacauuacucaacaagucgcaccaaaaaaccuugacaacccaaguaaaaaagaacaagacuuaauagcaaaaaaaaccgaaaaagccaaauaucuaucccuagaaaccauaaaacuggcacucgaagaauuuaacaagcauagggacauagacaaacaaugcagauucgaagaaauauuagcaaacuuugcagcaauuccaaugauauuugacgaaauugcucaaaacaaagacaaccuggcucaaaucagccuaaaauaccaaaaccaagguaaaaaagacuuauuacaagcuucagcagaagaagauguaaaagcgaucaaagaccuauuagaccaaaccaauaaucuuuuacacagacuaaaaaucuuccacauaucacaaagcgaagacaaagcgaacauacuagauaaagacgaacauuucuaccuagucuucgaagaaugcuauuucgagcucgcuaacauugucccucucuacaacaagauacguaacuauauaacucaaaaaccauauagcgaugaaaaauuuaaacuuaacuuugaaaacucuacccuagcaaacggcugggacaaaaauaaagaaccugacaacacugcaauacuauucauaaaagacgacaaauacuaccucggagucaugaauaaaaaaaacaacaaaaucuucgaugacaaagcuauaaaagaaaacaaaggcgaaggauauaaaaaaaucgucuacaaauuacuaccaggcgcaaacaaaaugcucccaaagguauuuuucucagcaaaguccauaaaauuuuauaacccuucugaagauauccuacgcauuaggaaccacucaacccauacaaaaaauggaaauccucaaaaggguuacgaaaaauucgaauucaacauagaagacugcagaaaauucauugacuucuacaaagaaucaaucuccaaacacccugaauggaaagacuucggguuuagauuuuccgauacucaaagguacaauaguaucgaugaauucuaucgugagguggaaaaccaaggauauaaacuaacauucgaaaacaucucugaaucauacaucgauuccgucgugaaccagggaaaacuauacuuguuccaaaucuauaacaaagauuuuucagcauacucaaaaggucgaccaaauuugcauacauuauacuggaaagcacuauucgaugaacgcaaccuucaagacguaguauauaaauuaaacggcgaagcugaauuauuuuaccgcaaacagaguauuccaaaaaaaauaacacacccagcaaaagaagcaauagcuaauaaaaauaaagacaauccgaaaaaagaaagcguguuugaguacgaucucauaaaagauaaaagauuuacagaagauaaauucuucuuccauugccccaucacaaucaacuuuaaaagcagcggagccaacaaauucaacgacgaaauaaacuuacuccuuaaagaaaaagcaaacgauguacacauacuaucaauagaccggggagaaagacaccuagcauauuauacacuugucgacggaaaaggaaacauaauaaaacaagacaccuucaacauaauaggaaaugauagaaugaaaacaaacuaucaugauaaacucgcagcuauagaaaaagaccgagauagugcaagaaaagauuggaaaaaaauuaauaacauaaaagaaaugaaagaaggauaucucagccaaguuguacacgaaaucgcaaaauuaguuauugaacauaaugcuaucguaguauuugaagauuuaaauuuuggauuuaaaagaggacgcuucaaaguggaaaaacaagucuaccagaaacucgaaaaaaugcuuauagagaaacuuaacuacuugguauucaaggauaacgaauucgacaaaacagguggaguccuaagagcauaucaacuaaccgcaccauucgagacauucaaaaaaaugggcaaacagacaggcaucauauauuacgucccggccggcuucaccucgaaaauaugcccagucacuggauucgucaaucaguuguaccccaaauacgaaagcgucucuaaaucccaagaauucuucuccaaauucgacaaaauauguuacaacuuagacaaaggguacuucgaauucagcuucgauuacaaaaacuucggagauaaggcagcaaagggcaaauggacaauagcgagcuucgggucgaggcucauaaacuuuaggaacagugauaaaaaucauaacugggacaccagagaagucuauccuaccaaagaacucgaaaaacuacuaaaagacuacagcaucgaauacggacacggagaaugcauaaaagcagccaucugcggcgaaucagacaagaaauucuuugcaaaacucacaucaguauuaaacacaaucuuacaaaugcgaaacaguaaaacaggaaccgagcucgacuauuugauuuccccaguagccgacguuaacgguaauuuuuuugacuccagacaagccccaaaaaauaugccucaagacgcugacgcuaauggagcauaccauauaggacugaagggacuaaugcuacuagaucgcaucaaaaacaaucaagagggaaaaaaacuaaaucucguaaucaaaaacgaagaguauuucgaauucguccaaaacagaaacaacuga

SEQ ID NO: 5784 - RNA, 1071 nt, Artificial Sequence
  Cpf1 variant
augaaaacaaacuaccacgacaaacuagcagcaauagaaaaagacagagaaucagcucgaaaggacuggaaaaaaauaaauaacauaaaagaaaugaaagaaggauaccuaagccaaguaguacacgaaauagcaaaacuagucauaggauauaacgccauaguaguauucgaagaccucaauuucggauucaaaagaggacgauuuaaaguagaaaaacaaguauaccaaaaacuagaaaaaauguuaauagaaaaacuaaacuaccucguauuuaaagauaacgaauuugacaaagcaggaggcguauuaagagcauaucaacuaacagcaccauuugaaacauucaaaaaaaugggaaaacaaacaggaauuaucuacuacguaccagccgacuucacaucaaaaauaugcccaguaacaggcuucguaaaccaacuauacccaaaauacgaaucaguauccaaaucacaagaauucuuuagcaaauucgacaaaauaugcuacaaccucgauaaaggauacuuugaauucucauucgauuauaaaaacuuuggagauaaagcagcaaaaggaaaauggacaauagcaagcuucggcucaagacuaauaaauuuccgaaacucagacaaaaaucauaacugggacacaagagaaguauauccaacaaaagaacuagagaaacuacuaaaagacuacuccauagaauacggacacggagaaugcauaaaagcagcaauauacgcagaaaacgauaaaaaauucuucgcaaaauuaacaucaauacuaaacucaauacuacaaaugagaaacagcaaaacagggacagaacuagauuacuuaauaucaccagucgcagacguaaacggaaacuucuuugacuccagacacgccccaaaaaauaugccacaagacgcagacgcaaacggcgcauaucacauaggacuaaaaggccuaaugcuacuauacagaauaaaaaauaaucaagacggaaaaaaauuaaaucuaguaauaaaaaacgaagaauacuucgaauucguacaaaacagaaacaaaucuaguaaaauauga

SEQ ID NO: 5785 - RNA, 3792 nt, Artificial Sequence
  Cpf1 variant
auggaagauuacuccggcuucguaaacauauacucaauccagaagacucuccgauucgaacucaaaccgguuggcaaaacauuagaacauauagaaaagaaaggcuuucucaaaaaagauaaaauuagagccgaagauuacaaagcaguaaaaaagauaauugacaaauaucacagagcuuacauagaagaggucuucgacuccguacuacaccaaaaaaaaaaaaaagacaaaacuagauucucaacacaauucaucaaagagaucaaagaauuuagcgagcuauacuauaaaaccgaaaaaaacauaccagauaaagaaagauuagaagcguuauccgaaaaauuaagaaaaaugcuuguaggcgccuuuaaaggagaauuuagugaagaaguugcagaaaaauacaaaaaucucuucucaaaagaacuaauaagaaacgaaaucgagaaauucugcgaaacagaugaagaaagaaaacaagugaguaacuucaaaucauuuacuacguacuuuaccggauuucacagcaauagacaaaacauauauucugacgaaaaaaaauccaccgcuauugguuauagaauaauucaucaaaaucuaccaaaguuccuagacaaccuaaaaaucauugaaagcauucaacgaagauucaaagacuucccuuggagcgaucucaaaaagaacuuaaaaaaaauagauaaaaacauaaaauuaacagaguauuucucaauagacggcuuuguaaauguucuaaaucaaaaaggaauagaugccuauaacacuauacuaggagguaaauccgaagaaagcggagaaaagauacaaggacuuaaugaauacauaaaucuauauagacaaaaaaauaauauagacagaaaaaaccucccaaauguaaaaauauuauuuaaacaaauacucggggauagagaaacaaaaagcuucauaccagaagcauuucccgaugaccaauccguacuaaacucaaucacugaauucgccaaauaccuaaaacuagauaagaaaaaaaaaucaauaaucgcagaacuaaaaaaauuucuauccucauuuaauagauacgaacucgacggaauauauuuagcaaacgauaauucauuagccuccaucagcacauuuuuauuugacgacuggucauucauaaaaaaaucagugucauucaaauacgacgaaucaguaggagauccuaaaaaaaaaaucaaauccccccuuaaauaugagaaagaaaaagaaaaauggcuaaaacaaaaauacuauacaauaucauucuuaaacgaugcaaucgaaagcuacucgaaaucucaagaugaaaaacgugugaaaauacgucuagaagcuuacuuugcagaauucaaaucaaaagacgacgccaaaaaacaauuugaccuccuugaaaggauagaagaagcauacgccaucguagaaccauuguuaggugcugaauauccucgcgauagaaacuuaaaagcagauaaaaaagaaguaggcaaaauaaaagacuucuuagacaguauaaaaagccuccaauuuuuccuaaaaccuuuacucucagcagaaauauuugaugaaaaagaucuaggauucuacaaucaacucgaggguuacuacgaagaaauugacucaaucggacaucucuacaauaaaguuaggaauuaccucaccggaaaaauuuacucuaaagaaaaauuuaagcuaaacuucgaaaauucaacauugcuaaagggaugggaugaaaauagggaaguagcaaacuuaugugucauauuuagagaagaucaaaaauauuaucuuggaguuauggacaaagaaaacaacacaauauugucagauaucccaaaaguaaaacccaaugaacuguuuuacgaaaaaauggucuauaaacucauaccaacaccacacaugcaacuuccaagaauaauauucagcucggacaaucuaaguauauauaacccaaguaaaucaauacuaaaaauacgggaggcaaaaucauuuaaagaaggaaaaaacuucaaguuaaaggauugucacaaauuuauagauuucuauaaagaauccaucucaaaaaaugaagacuggucacgauucgacuuuaaauuuucuaaaaccucaagcuaugaaaacauaucugaauucuacagagaaguagaaagacaaggauauaaccuugacuucaaaaaaguaagcaaauuuuacaucgacucacuaguugaagaugggaaauuauauuuauuucaaauauauaacaaagauuucuccauauucucaaaagguaaaccaaaccuacauaccauauauuucagaagucucuucuccaaagaaaacuugaaagauguuugcuuaaaauuaaacggagaagcagaaauguucuuccgaaaaaagucuauaaauuacgacgaaaaaaaaaaacgcgagggccaucaccccgagcucuuugagaaacuaaaauacccaauucugaaagauaaaagauauagugaagacaaguuucaguuccaccugccuaucagccugaauuuuaagucuaaagaaagauugaacuuuaaccucaaaguuaaugaauuucuaaaaagaaacaaagauauuaacaucauagguauagaucgaggcgagagaaaccuacuuuacuuagucaugaucaaucaaaaaggcgaaauacuaaaacagacacuacuugacuccaugcaaaguggaaagggacgcccagagaucaacuauaaagaaaaacuacaagaaaaagaaauugaaagagacaaagcaagaaagucaugggggacuguugaaaacauaaaggaacucaaagaagguuaucuuucaauaguaauucaucagauaucuaagcuaaugguagaaaauaacgcaaucguuguccuagaagaccuuaacauagguuucaaaagaggaaggcaaaaaguagaaagacaaguauaucaaaaauuugaaaaaauguuaauagacaagcuaaacuuucuagucuucaaagaaaauaaaccuacagaacccggaggcguccuaaaagcauaccaacuaacagacgaauuccaaaguuucgaaaagcucaguaaacagacuggguuuuuguucuauguuccauccuggaacacaucuaagaucgacccaagaacgggcuucauagacuuucuacacccagcauacgaaaauauugaaaaagcaaaacaguggauaaacaaauucgauagcauacgauuuaauucuaaaauggauugguucgaauucacagccgacacacgaaaguucagcgagaacuuaauguuaggaaagaaucguguauggguaauaugcaccacgaauguagaaagauacuucacuagcaaaacugcuaacuccaguauccaauauaacucaauacaaauaaccgaaaaguugaaagaacuauucguagacaucccuuucagcaauggucaggaccuaaaaccagaaauuuuaaggaaaaaugacgcaguauucuucaaaucccuacuauucuacauaaaaacaacucucagucuacgacaaaauaaugguaaaaaaggugaagaagaaaaagauuucauauuaaguccagucguggacagcaaaggccgcuucuuuaacucccucgaagccucagaugaugaaccgaaagaugcagacgcuaacggcgcguaucauauugcacucaaagggcuaaugaaccuacuuguuuuaaaugaaacaaaagaagaaaaccuaagcagaccaaaauggaaaauaaaaaauaaagacuggcuagaauuugucugggaaagaaacagguga

SEQ ID NO: 5786 - RNA, 2820 nt, Artificial Sequence
  Cpf1 variant
augaaccuauacucaaaucuaacaaacaaauacucgcuaaguaaaacacuucgcuuugaauuaauuccacaaggagaaacauuagaaaauaucaaagcacguggucuaauacucgaugaugaaaaacgagcaaaggauuauaaaaaagcaaaacagauaauagacaaauaccaccaauuuuuuauagaagagauacucucaucaguaugcaucucagaagaccuacuacagaacuacagcgauguauauuuuaaacuaaaaaaaucagacgaugacaaccuacaaaaagauuuuaaaagugcaaaagauacaaucaaaaaacacauaagcagauauauuaacgacuccgaaaaauucaaaaaucucuucaaccaaaaccuaauagaugccaaaaaaggucaagaaucggacuuaauacuauggcucaaacaaucuaaagacaacggaauagaacuauuuaaagcaaauucugacaucacagauauugaugaggcacuagaaauaauaaaaagcuucaaaggcuggacaacauacuucaaaggcuuccacgaaaaucgaaaaaacgucuauaguucagaugacauaccaacaucaauaauauaucgcauaguugacgacaauuuaccaaaauucauugaaaacaaagcaaaauacgaaaaccucaaagauaaagcaccugaggcaaucaauuacgaacaaauaaaaaaagaucuagccgaagaauuaacauuugacaucgacuauaaaaccucagaaguaaaccaacguguauucucacucgacgaagucuucgaaaucgcuaacuucaacaacuacuuaaaccaaucaggaauaacaaaauucaacacuauaaucggaggaaaauuuguaaauggagaaaacacaaaaagaaaaggaauaaacgaauauauaaaccucuauucacaacaaauaaacgauaagacguuaaaaaaguacaaaaugucuguccuauuuaaacaaauacuaucagacacagaaucuaaaucauuuguaauugauaaacuagaagaugacagcgacguagucacaacaaugcaaucauuuuacgaacaaauagcagccuucaaaaccuuagaagaaaaaagcauaaaagaaacucucucgcuccuauuugacgaccuuaaagcgcaaaaacuagaccuauccaaaauuuauuucaaaaaugauaagagucuaacagauuuaucccaacaaguauucgacgauuacuccguaauaggaacagcuguacuagaauacauaacacaacaaguagcaccaaaaaaccuggauaaccccuccaaaaaagaacaagaccucauagcuaagaaaacagaaaaagccaaauacuuaucacuugaaacaauaaaacuagcauuagaagaauucaacaaauaccgagacaucgacaaacaauguagauucgaagaaaucuuugcaucauuugccgacauaccuguccuauuugacgaaauagcccaaaacaaaaauaacuuagcacaaaucucgaucaaauaucaaaaucaaggaaaaaaagaucuccuacaaacaucugcagagguagauguaaaagccauuaaagaccuacuugaccaaaccaacaacuugcuccauaaacuaaaaaucuuccauaucacccaaagcgaagacaaggccaauauucuagacaaagaugaacauuuuuaucucguauucgacgaaugcuacuucgaacuagcaaacaucgucgcacuauauaacaaaauuagaaacuacauaacacaaaaaccauauucggaugaaaaauucaaacuaaauuuugaaaauucaacacuugccaauggcugggauaaaaacaaagaaccagacaacacagcuauucucuucauuaaagacgacaaguauuaucucggcgucaugaacaaaaaaaacaacaaaauauucgaugauaaagccauaaaggaaaacaaaggagaaggcuacaaaaaaguaguauacaaacuccucccaggagcaaacaaaauguuaccuaaaguauucuucagugccaaaucaauuaauuuuuacaaucccuccgaagauauccuaagaauaagaaaucacuccacucauaccaaaaacggcuccccacaaaaagguuacgagaaauuagaauucaacauagaagacuguagaaaauucauagacuucuacaaacacucaauaagucgccauccagaauggaaagauuuuggcuucagauucucugauacaaaaaaguacaacuccauagaugaauuuuacagggaaguagaaaaccaaggcuacaaacuaaccuuugaaaacauauccgaaucauauaucgauagccuaguagacgaaggaaaauuauaccuauuccaaauauacaauaaagauuucucaguuuacuccaaaggaaaaccaaaucuacacaccuuauacuggaaagcacucuucgaugaacgaaaccuacaagacguagucuacaaauuaaacggugaggcggaauuauuuuacagaaaacaaagcaucccuaagaaaaucacucauccagcuaaagaagcuauagcuaacaaaaacaaagauaacccaaaaaaagagucuauauucgaguacgaucuaauaaaagauaaaagauucacagaagauaaauucuucuuucacuguccaauuacaauuaauuucaaaagcucaggagcuaacaaguucaacgacgaaauaaacuuacuccuaaaagaaaaagccaaugauguacacauauuauccauagaccgaggagaaagacaccuagccuacuacacauuaguagacggaaaaggcaauaucauaugcaaaaacuga

SEQ ID NO: 5787 - RNA, 3795 nt, Artificial Sequence
  Cpf1 variant
augcuauuccaagaauuuacacacuuauauccauuaagcaaaacuguuagguuugaauuaaaaccuaucggaaaaacccuagaacacauacaugcaaaagacuucuuaucacaagacgaaacaauggccgauauguaccaaaaagugaaagcaauacuagaugacuaccaccgcgacuucauugcagauaugauguccggcguaguacuuacaaaacuugcagaauuuuacgaaguauacuuagcuuuaagaaaaacaccaaaagacgacucccuucagaaacaauuaacagaaauucaaaccgcauuaagaaaagaaauuguaaaacccauugguucaggagguaaauacaaagcuggauaugacagacuauuuggagccaaauuauucaaagauggcaaagaacuaggugaccuagcgaaauuugugauaacacaagaaggagaaucuagccccaaauuagcacauauagcacacuucgagaaauuuagcacauauuuuacuggauuccacgacaaucguaaaaacauguauagugaugaagauaaacacacagccauagcuuauagauugauucaugaaaaccuacccagauuuauagauaaucuucagauauuagccacuauaaaacagaaacacucagcccuguacgaucaaauaguaaacgaacuaaacgccaauggauuagauguaucacuagcaucccaccucgacggauaccauaaacuauuaacacaagaagguaucaccgccuacaauacauuauuaggaggaauuagcggagaagcagguagcagaaaaauucaaggaauaaacgaacuaaucaacauacaccauaaccaacacugccaaaaaucugaacgaauagcaaaauuacgaccgcuucauaaacagaucuuaagcgacggcauggguguaucauuucuaccaucaaaauucgcugaugacucagaaguaugccaagcaguaaacgaauuuuacagacacuaugcacacguauucgcuaaaguccaaucacucuucgaucgauuugacgacuaucgaaaagauggcauuuacguagaacacaaaaaucuaaaugaacucucgaaacaggcuuucggcgauuucgcacuacuaggacgaguacuagauggauauuauguugauguaguaaauccagaguucaaugaacgcuucgccaaagccaagaccgauaacgccaaagagaaauuaacaaaagaaaaagauaaauucaucaaggguguacauucauuagccucacuugaacaagcgauagaacacuacaucgcaggacaugacgacgaaagcguacaagcaggaaaacuuggucaauauuucaaacauggucuagcuggaguugacaacccaauccagaaaauacauaacucccauagcacuauaaaaggcuuccuagaaagagaaagaccagcaggagagagagcucuacccaaaauuaaaucagacaaaaguccagaaaugacccaacuacgucaacuuaaagaacuccucgacaaugcacucaacguuguccacuucgcgaaauuacuaacgacaaaaacaaccuuagacaaucaagacggaaacuucuauggcgaguucggugcccuauaugaugaacuagcgaaaauugcuacauuauacaauaaggugagagacuauuuaucgcaaaaaccauucucaacugaaaaauauaaauugaacuuuggaaauccaacccuacugaacggaugggacuuaaauaaagaaaaagauaacuucggaguaauauugcaaaaagauggaugcuauuaccuagcacuauuagacaaagcccacaagaaaguauucgauaacgcuccaaacgcaggaaaauccguauaucagaaaaugguguacaaacucuuaccaggccccaacaaaauguuacccaaagucuucuucgcaaaaucaaaucuagauuacuauaaccccucugcagaacuauuagauaaauaugcacaaggaacacacaagaaaggcaacaauuuuaaucuaaaagacugccaugcccugauagacuucuuuaaagcaucaauaaacaaacacccugaauggcaacacuuuggauucgaguucagucccacaucaucauaccaagacuuaagcgacuuuuacagagaagucgaaccacaaggauaucaaguaaaauuuguagacaucaaugcagaguacaucgacgaauuaguugaacaaggccaacuauaucuuuuucaaauuuauaauaaagacuucagucccaaagcccauggcaaaccaaaucuucacaccuuauauuuuaaagcacuauuuucagagaauaaccuagcaaauccaaucuauaaauuaaacggggaagccgaaauauuuuauagaaaagccaguuuagauaugaacgaaacaaccauucauagagccggagaaguacucgagaauaaaaauccagauaauccaaagaaaagacaauuugucuacgacauuauaaaagauaaacgauacacacaagacaaauuuaugcuacacguacccauaacuaugaacuuugggguucaaggaaugacuaucaaagaguucaauaagaaaguaaaucaaucaauacaacaauacaacgacgucaauguaauugguaucgaucgaggagaaagacaccuacuuuaucuaacuguaaucaacaguaaaggagaaauacuagaacaaagaucacucaaugauauaauuacaacuuccgcaaauggaacacaaaugaccaccccauaccauaaaauacuagacaaacgcgaaauagagcgccucaacgcacggguuggauggggugaaaucgaaacaauuaaagaauuaaaaucgggguauuugucccacguaguacaucaaaucucccaacucaugcuaaaauauaacgcaauaguaguacuagaagaccucaauuuuggauucaaaagaggaagauuuaaaguagaaaaacaaauuuaccaaaacuuugaaaaugcuuuaauaaagaaauuaaaccauuuagcccuuaaagauaaagcagaugacgaaauaggaucauacaaaaaugcuuuacaauuaacaaacaacuucacagaccugaaaucgauagggaaacaaacuggauuuuuauuuuacguacccgccuggaacacuucaaaaauagacccggcaacaggauucguagaucuguuaaaaccacguuaugaaaacaucgcacaaucccaagcauuuuucggaaaauuugacaaaaucuuuuacaacgcagauaaaggauacuuugaauuuuauguagacuacgcaaaauuuacagauaaagcgaaaaacuccagacaaacuuggguaauauguagucacggugacaaacgauacguauacgacaaaacugcaaaccaaaauaaaggagccacuauaggaaucaacgucaacgaugaacuaaaaucacuguucgcuagauaccauauaaacgauaaacaaccaaauuuaguuauggacaucugucaaaauaaugacaaagaguuccauaaaagucucauguauuuauuaaaagcacucuuagcacuaagguacuccaacgccucuucagacgaagauuucauauuaucucccguagcugacgacaaaggagucuucuuuaacagcgcucuagcugaugacacccaaccccaaaacgcugaugcuaacggugcauaccauauagcucuaaaaggucuauggcucuuaaaugaacuaaagaauaguaacgauuuagacaaaaucaaacuagcaauugacaaucaaacaugguuaaacuucgcacagaacagauga

SEQ ID NO: 5788 - RNA, 3903 nt, Artificial Sequence
  Cpf1 variant
augucuauauaccaagaguuugucaacaaauacucccuaagcaaaacacugagauuugaauuaauaccccaagguaaaacccuugaaaacauaaaagcacgcggacucauacucgacgaugagaaaagagcaaaagacuauaagaaagccaaacaaauaauagacaaauaccaucaguucuuuauagaagaaauucuaaguagcgucugcauaagugaagaccugcuacaaaacuauucagacguuuauuucaaauuaaagaaaucagaugacgauaaccuccaaaaagauuucaaaucagccaaagacacuaucaagaaacaaauaagugaauauauaaaagauagcgaaaaauucaaaaaucuauuuaaccagaaccuaaucgaugccaagaaaggacaagaauccgaucuaauacuaugguuaaaacaaagcaaagacaacgggaucgaacucuucaaagccaauagcgacauaacugacaucgaugaagcauuagaaauuaucaaaucuuucaaaggauggacgacauacuucaaagguuuccaugaaaaucgcaaaaaugucuauucaagcgacgacauacccacaagcaucauauaucgaauaguagaugacaauuuacccaaauuccuagaaaacaaagcuaaguacgaaucucuaaaagacaaagcacccgaagccauaaacuaugaacaaauaaagaaagaccuagcggaagaacuaaccuucgauauagacuauaaaacuuccgaaguaaaccaaagagucuucucauuagacgaagucuucgaaauagcgaauuucaauaauuacuuaaaucaaucuggaaucaccaaauucaacacaauaauaggcggaaaauucgucaacggcgaaaacaccaaaagaaaaggcauaaacgaauacauuaauuuauauucacaacaaaucaacgacaaaacccuuaagaaauacaaaaugucagugcuguucaaacagauuuuaucagacaccgaauccaaaaguuucgugauagacaaacuagaagaugauucugacguuguaaccacuaugcagucauuuuacgaacaaauagcugcauuuaaaaccguggaagaaaaauccauaaaagaaacauuaucuuuauuauucgacgacuuaaaagcucaaaaacucgaccuaucaaaaauuuauuuuaaaaaugauaaaucuuuaacugauuuaucacaacaaguauuugacgauuauucugugaucgguaccgcaguacuagaauauauuacacaacaaguggcucccaaaaauuuagacaacccaaguaagaaagagcaagacuuaauagcuaagaaaacagaaaaagcgaaauaucuuagucuagaaaccaucaaacucgcacucgaagaauuuaacaaacaccgcgauaucgauaaacaaugucgcuuugaagaaauauuagcaaacuucgcagcuaucccaaugauauucgaugaaauagcucaaaauaaggauaaucucgcucaaauaucucuaaaauaucaaaaucaaggaaagaaagauuuauuacaggccucagccgaagaagacguaaaagcuauuaaagaucuccucgaucaaaccaacaaccuacuacauagauuaaaaauauuccauaucucucagagugaagacaaagcuaacauucuugacaaagacgaacacuuuuaccucguauucgaagaaugcuacuucgaauuagcuaacauuguaccgcuauauaacaaaauaagaaacuacauuacacagaaaccuuacucggaugaaaaauucaaacuaaauuucgaaaauaguacauuagcaaauggcugggauaaaaacaaagaaccagacaauacagcgauacuauucauaaaagaugauaaauauuaccuagguguuaugaacaagaaaaauaacaaaaucuuugacgacaaagcuaucaaggaaaauaaaggagaaggauauaagaaaauaguguacaaauuacuccccggcgcaaauaaaaugcuaccaaaaguauucuucucggcuaaaucaauaaaauuuuauaaccccagcgaagauauauuacgaauaagaaaucauucgacacacacuaaaaacggaaacccacaaaaaggcuacgaaaaauucgaauuuaauaucgaagacuguagaaaauuuaucgauuucuacaaagaaucuauaucaaaacaccccgaauggaaagacuucggcuuucguuucucagacacacaaagauauaauuccauagacgaauuuuacagagaaguagaaaaucaaggauacaaacucacauuugaaaauauauccgaaucuuauauagacaguguugucaaucaaggaaaauuauaccuauuccaaauauacaauaaagauuucucugcguacuccaaaggacgaccaaaucuucauacacucuacuggaaagcauuauuugacgaacggaaucuacaggauguuguauauaaacuaaacggugaagcagaacucuucuaccgaaagcaaaguauuccaaagaaaauaacucacccagccaaagaagccauagcuaauaaaaauaaagauaauccaaagaaagaaucgguauucgaauaugacuuaaucaaagacaaacgguucacugaagacaaauucuucuuccauugcccgauaacaauaaauuucaaaucaagcggggcaaauaaauucaaugaugaaauuaaccuacuccuuaaagaaaaagcaaacgaugugcauaucuuaucuauugaucgcggcgaacgacaccuagcuuauuauacccuaguagacggaaaaggaaacauaaucaaacaagacacauucaacauaaucgggaaugacagaaugaaaaccaauuaucacgauaaacuagcagcaaucgaaaaagacagagacuccgccagaaaagacuggaagaaaauaaacaacauaaaagagaugaaagaaggcuaccugucccaaguuguccaugaaauagcaaaacucgucauagaacauaacgcaauagucguauucgaagaucuaaauuucggcuucaaacgaggaagauucaaaguugagaaacaaguauaucaaaaacuagagaaaauguuaauagaaaaauuaaauuaccuaguuuucaaagauaaugaauuugacaaaaccgggggcguacuaagagccuaccaacugaccgcaccauuugaaacauucaagaaaauggguaaacaaaccgguauaauauacuacgucccggcuggauucacaucaaaaaucugcccaguaaccgguuucgucaaccaauuauacccaaaauaugaaucaguaucaaaaucacaagaguucuucucuaaauucgacaaaaucugcuacaaucucgacaaaggcuauuucgaguucucuuucgacuacaaaaacuucggugauaaagcagcaaaagguaaauggacuaucgccaguuuugguagucgucuaaucaacuucagaaacagugacaaaaaccacaacugggacacacgagaagucuacccgacaaaagaauuagaaaaauugcuuaaagacuacagcauagaauacggacacggugaauguauaaaagccgccauauguggagaaucagacaagaaauucuuugcaaaauuaaccucaguacuaaacacuauacuccaaaugcgaaauaguaaaaccggcacagaauuagauuauuuaaucagcccagucgcagaugucaauggaaauuucuuugacucaagacaggccccuaaaaacaugccacaagaugcugacgcuaacggagcauaccacauaggauuaaaaggauugauguuacuagauagaauuaaaaacaaccaagaaggcaagaaacuaaauuuaguaauuaaaaacgaagaauacuuugaauuuguacaaaaccgaaacaauuga

SEQ ID NO: 5789 - RNA, 3756 nt, Artificial Sequence
  Cpf1 variant
augaaccacaugaaacaauucaccaaucaauuuagccuaucaaaaacccuacgauucgaauuaaucccacaagguaaaacaaaagaauuuauagaaauaaauggcuuaaucgaaaaagacaacgaacgcgcaguaucguauaagaaaguaaagaaaauuauugacgaauaucauaaauacuuuauagaaaugguacugugugacuucaaacuacauggucuugaaaccuaugaaacaauauuuaacaagaaagaaaaagaugacacggacaagaaagaguucgauaauauaagaaauucccuccgcaaacagaucgcagaugcauuugcuaaaaacccuaacgacgaaauaaaagaaagauucaaaaaucuauuugcaaaagaacuuauuaaacaagacuugcucaacuucgucgaugaugaacagaaagaacucgugaaugaauuuaaagacuucacaacauauuucacaggcuuccaucaaaaccgaagaaauauguacgucgccgaugaaaaagcuaccgccauagcauaucgacuugugaacgaaaaccuaccuaaauuuauugauaaucuaaaaauauaugagaaaaucaagaaagacgcaccagaauuaauaucagaucuaaauaaaacauuagucgaaauggaagaaauaguucagggaaaaacauuggaugaaaucuucagccuuagcuucuucaaccaaacacuaacacaaacugggaucgaacuguacaacauagugauuggcggcagaacagcagacgaaggaaaaaccaaaauaaaaggacuaaacgaauauauaaauacagauuauaaccaaaaacaaacagauaaaaagaagaaacaagccaaauuuaaacaacucuacaaacaaauauuaucagacagacauucaguaucauuuguagcagaaacauucgaaacagaugcccaauuauuggaaaauauagaacaauucuacucaagcguacugugcaauuaugaagacgauggacacacuacuaauauauuugaagcaaucaaaaaccugauaauaggacucaaaaccuucgauuuauccaaaauauacuuacgaaacgacacaucauuaacugacauuucacaaaaauuauuuggagacugguccauaauauccucugcccuaaaugauuacuacgaaaaacaaaauccaaucagcuccaaagaaaaacaagaaaaauacgacgaaagaaaagcuaaauggcugaaacaggacuuuaacauagaaacuauucaaacagcacucaaugaaugcgauucagaaauaaucaaagagaaaaacaauaaaaacaucguaucagaauauuucgcaaaacuagguuuagacaaagacaauaaaauugauuuacuucagaaaauacaucacaacuacguaguuauaaaagauuuacucaacgaacccuacccagaaaacauaaaacuaggcaaucaaaaagaacaaguaucccaaauuaaagauuuucuagauucuauauuaaauuuaauacauuuccuuaaaccacucucccucaaagacaaagacaaagaaaaagacgaauuauucuauucacucuucacagcacuauucgaacacuuaucacaaacaauaucuaucuacaacaaaguccgcaacuaccuaacacaaaaagccuacucaacagagaaaaucaaacucaauuucgaaaacucaacauuacuaaacgguugggaugugaacaaagaaccaguaaacacauccguaaucuuuagaaagaacggacuauucuauuuaggcauaaugaguaaauccaacaauagaauauucgaacgaaacguccccguaugcaaaaacgaagaaaccgcauucgagaaaaugaacuauaaacuucuuccuggagcaaacaaaaugcucccaaaaguauuccugucagccaaagguauagaaaguuuccaaccaagugcugaaauccaaucaaaauaccaaaaagaaacccacaagaaaggagacgcauucguucgaaaagauauggaaaauuuaauagauuucuuuaaacaaagcauagcuaaacacacagauuggaaacauuuuaaccaucaauuuagcaaaacugaaacauauaacgaucuaucugaauuuuauaaagaaguugaaaaacagggauacaaacuaacauuuacaaaacucgacgaaaccuacauaaaccaacuuguagacgaaggaaaacucuauuuauuucaaauauacaauaaagauuuuucaccguuuucuaaagguaaaccaaacaugcacacgcuauauuggaaaaugcuauucgacgaacaaaaucuacaaaauguaguguacaaauuaaauggagaagcagaagucuucuuuagacaaaguucuauaaaacagaccgacagaaucauacacaaagccaaccaagcaauagacaacaaaaacccauuaaacaauaagaaacaaagcucauuuaauuacgaccuaauaaaagacaaaagauuuacacuagauaaauuccaauuucacguccccauuacacuaaacuucaaagcagaagggaaugaauauuuaaacacuaaaguaaacgaauaccucaaaagcaacucagacguaaaaauaauaggcuuagauagaggugaacgacaucuaaucuaccuaacacucauaaaccaaaaaggugaauuacuaaaacaacaaagccuuaacguaauagcaaccucccaagaacacgaaacagacuacaaaaaccuccucguaaauaaggaaaacgaaagagcaaacgcaagacaagacuggaaaacaaucgaaacaaucaaagaacuuaaagaaggauaccugucccaaguaguucaucaaauagcaacuaugaugguugacgaaaaugcaauaguagucauggaagacuuaaaugcgggauucaugcgaggucgacaaaaagucgaacgacaaguauaucaaaaacuagagaaaauguugaucgaaaaacugaacuauuuaguauuuaaaaacaacgacguuaaugaaacugcgggagucuugaacgcacuccaacuaacaaacaaauuugagagcuucgagaaaaugggaaaacaaucuggauuccuauucuacguaccagcguggaacacaucuaaaauagacccagcaacagguuuuguagauuucuuaaaaccaaaguacgaaagcguugaaaaagccaagcucuuuuucgaaaaauuugaaucaauaaaauucaaugcagacaaaaauuauuucgaguucgaauuugauuauaagaaauucaccgaaaaagcugaagguucacaaacuaaauggaccgucuguacacauagcgacguccgauacagauauaacccacaaacaaaagcuagcgaugaaguaaauguaacaaacgaacuaaaauuaaucuuugauaaauucaaaaucgaauauaaaaacggcaaaaaccuaaaaaccgaacuauuauuacaagacgauaagcagcucuuuucaaaacuucuucacuaucuagcccuaacauuaauguuacgccaauccaaaagcggaacagacauugacuucauccucuccccuguugccaaaaauggaguauucuaugacagcaggaacgccaugccaaaccuuccaaaagacgcagacgccaauggagcuuuucacaucgcccucaaaggacugugguguguacagcagauaaagaaagcagaugauuuaaagaaaaucaaacuggccauaagcaacaaagaauggcuauccuuugugcaaaaucucaaauga

SEQ ID NO: 5790 - RNA, 4173 nt, Artificial Sequence
  Cpf1 variant
augauagacaauacaaaagagaagaaagaagguuccguauucgauggauucacuaggaaauaucaacuaucaaaaacgcuacgauucgaauuacgaccaauauuaaauacaccuaaaaugcuagacgacgaacaaguuaucaaaaacgacgaaacacggagaaagaaauacgaagcugucaaaccgugguuugaucaacuacacagagaguucauagaagaugcacucaaaucauuuaaauuuaaaaaucucgcgauauaucaagacacauuucaaacuuggcaaaaagaucgaaaaagcaaacagaagaaagacacauuaguaaaaauagaaguaggauuaagagaagaaauagugagaagauuugaagaaguugcaaauauauggguacgguccgaacaguauaaacuucuaggaauaaagaaagaaggccucggaaugcucuuugaagcaggcguuuuucgacuucugaaagaacguuucaaaaaugaaaaagacacuaccguugacggcaacaauaucuuugaugaauggacaagauggacaggcuacuuuaagaaauucuucgaaacaaggaaaaauuuuuacaaaucagacgacacaucaacagcaauagccuauagaguaauaaaucaaaaucucagaagauuuugugaaaauauccaaaucuuugagaaaauuucagagaaaauagaauuuucugaaguagaaaaauccuuugacauaagcugugcaggaaucuuuagccuagcuuauuacaaugcuugccuacuacaagguggcaucgacacguacaauaaaauaauagggggcgaaguugaugaaaaagacaagaaaauaccaggaauaaacgaauugaucaacaaauaccgacaagacaauagcggggaaaagauaccauucuuaaaacaauuagacaaacaaauacacagugcaaaagaagcguuuauugaaaguauagaaacaaauaaagaacugguagggaaacuuaaaacauucuaugaaaacgcagaagugaaaauucaaaguuucagaaauuuaauugcagauauaguaacagacuauuccggguacgacauagacaaaauauaucuuacuaaagaagcagugucacacaacgcaaguaggugguucgccagcuucgaaucauuugaaagagaucuauucgcaguuguagcagaaaaacaaaacaaacucguauaugaacuacuacgaacacauaaaaacgauucaaaaauaucggauaaagauggcaaauucucauuuccugauuuuaucaaauguucucacauaaaacgagcccuggaaaaacaagaagguagaauauggaaaggugaauauuaugaagauauuguagauuucgagaaaaucaaagacguauucacacaauuucuuugcgucuucaaauucgaacuggaacaacaauucuuucgcaaaacaacaagcgcacaaacaggcgaacaaacaaaaauaggauaugaaaucuucguuacaaaaauaaaugaacuaauaacaagagaaaauccagucauugaccuugaagagaaaauugcuaucaaaaauuucgcugaugcgacacuauuaaucuaucaaauagcaaaauauuuugcugucgaaaaacgaagagguuggcuugauaauuaugaucuugacgaccguuuuuacaaaagcucagauaucggguacuuaaacuucuacagagacgcauuugaacaaaucguacgaccauauaaccuauucagaaacuacuugacaaagaaaccauacaacacgaauaaauggguucuaucguucgaaaacccaacacuagcagaugguugggauaaaaacaaagagaaaacuaacgcagcaguuauccugcgaaaagacggcagguacuaucuagguaucaucaaagaagauugcaaaucauuauuugcagauagauacagcaaagaaaugucggaaggaauagaaucgggaucguuccagaaaauggcauauaaauucuuuccugaagcaaguaaaaugauaccaaaauguucaacucaaacuaaaaacgucaaagaacauuuuagaaaauccuccagugacuacaaccuauuucaugaaaaagauuacaaaauaagugucgcaauuaccaaaaauauuuacgaacugaacaauguauucuauaggaaagauaauauagaagaaucguucguaccuaaaaacgauuucgaaaagaaacuuggcgugaagaaauuucaaagacaauaccuugaaauaucaagagacaauaacggauauaaacaagcgcuagcacaauggauagaauuuugcauuagauuccuaaaagcauacaaaaguacaacaauuuucgacuauucaagauuaagagaagccaaagaauaugaaagucucgaugcauucuaccaagacauaaacgccuuaacguacaacauaucauuugucccuauaucugaacaauacauaaaagagaaaaacgauaacggggaacucuuccuauucgaaauuuacaacaaagauuggucacucggaccuauggauaaaaauaggaaaagaaccaaaaaucuacauacucuguauuuugaacaauuauucucaaaagaaaaugaacaagaaaacuuccuauuccaacuaaauggagaagcugagcucuuuuucagaccaaaaacggaagagaaaagacucggguacaaaguaugggaugcuggugaaaagaaaugggucaaagcaaaggaaaaagaagacggugcagucauagacaggaaacgauacgcaaaagauauuauacuauuucacugcccaaucacacuaaaccguguaucugaaagcaagacuaaaagagaaauggacguagaaauaagagaaguccuauccucaacgcccgguguccacauaauagggguugacagaggagaaaaacaucuagcauauuacagcguuauagaucaaaacggaaaaauaauagaaaccgacacacuaaacaguauuggaaaagacggacgagguaaacccguugaauacgcgucaaaauuggaaaaacgagcacaagaaagagaagccagcagacgagauugggaagaaguugaagcaauuaaagaccucaagaaaggauacauaucucaaguaauaaggaaucucgcagaccugauaaucaagcacaacgcaauaauaguauuugaggaucucaacaugagauuuaaacaaaucagaggcggaauagagaaaagcgcauaccaacaacuagagagagcacuaauagacaaacuaaguuuccuaguuaaaaagggagaagaagauccuaaacaaacaggucacauacuuagagccuaucagcucgcagcgccgguaaucgcuuucaaggauaugggcaaacaaacuggguugauauucuacacccaagcaggauauaccaguaaaacaugccccgaaugugguuacagaagaaauauaaagugucuauucgagaacauagaacaagcaaaaacauuaauagaaaaucucgaaagcauaaauuacaauaagaaagaagauguauuccaaauaucauacucauuagagaaacuaagcucuaaggaucagaagaaagagaagaaagucuccaaugaauuauacgcaaaaacccuaaagaaagacauauuuauauugacaaccaaaaacgcauuaagauacaaaugguaugaucgauacucugaaaaagcaaaaguagcaaaaaggggaauugacgaauacaaaggcgaaguaaacgaaucagaaaccaagaaaggugugguuaaagaauuuaauuuaacagaauacuugaaaggacuacucaaaacguacgaaauagauuacgaacauggaggaauaagagaacaaauacuauccguggcgagaggaagagaauuuuauaaagacuuuuuauaugcgcuauuccuccuaacagaaaccaggcacaguauaagugguagaaacacagauuauauucaauguccagaaugcgaguucgauucuagaaaaggcuucaaagacauaaaagaauuuaacggagaugcaaacggugcuuauaacauagcgagaaaaggcauaaugauacucgaaaagauaaaacaauucaagaaagacaacgacggaaaucuugagaaaaugggauggggugauuuaucaauaucaaucgaggaaugggacaaauucacacaaaaagaauga

SEQ ID NO: 5791 - RNA, 4026 nt, Artificial Sequence
  Cpf1 variant
augaaugccgaaaaaaaaugugcuuuuaacgaauucacaaauuuguaugaacucaguaagacgcuaaaauucgaacuaaaaccuguaggaaaaacgaaagaaauaauaaaaaauuuccgugaggaacuagagaaaaacaauccaauacaauuggacaaagaaauaucuauugcaaaacaggaaauuaaaaaagaccuagacauauugcacagagaauuuguaagacaaucauuugaauuagccuuuaaagaaaauaaaauaaauuacgaaauauucuuugaaauauacagaaacuucaaaaaauucucaaagaacaaaaagagcgacgaauacauugcugcuaucaaaaaucugaaagaagaaaaaauaaaacucgugaaaaaaauagcagauuauuucgucaaaauggaccaagaauggagaaaauacuaucccagugaaaaaaaaagcuuuuuacucaugagcaacggggucaucaacuuauuaauagacaucaacaaagaccgaauggacuacuccuuuauacccaaggaaguuugugaaaaaauaaaagguaaaggcaaaauagaauuauaugaaaaguucaauaagcacuucgguuaucuauccaaauacaacacagcaagagaaaacuucuauucggacgacguaaaaaacucagcaagcguugcauacagggcgaucugugaaaaccuagaaaaauucugcgacaauaaaauaaaaguugaggcggacaacuuccccaaggaaaucaaagaaaaauuucucgaauacuucaauaaaauaacggauuuaucauucuacaaucgcugccugagucaaaauggcaucgaagaauaucauaaauucaaagacgaaaucaaucgaucaauaaaugaacuuuacccaaacaauaguaaaaauaaaccccaaaacaucccauacuuaagcaaacuagauaaacaaauacuuucugaaaaggacaaacaaaguuggaucgaagaaggauucauagacgaaaauaauuucaucuucgaauuugaaaaguuuauaaaaaugaacgacaaauauauuccaagcgaaaaaaaauuauucaacgaguuuuucauuuuccagaauaacgacgaaguacuucaaaaacucuuccuauuaaagaaaacaauaaauaacuuugcaaacaucuaucuagaugauccaaaaaacuugauggaccuaaugcccucaaaaggaacaaaaaaaagggauuauuuaaguuuauuagaaauaaaagaagcacuaaacagcuaugcagaaaaccaaaacauuggagaaacccagauauuuaaaauaaaauacgacgauguuauagauaaaacuaaaacuccuuuugaauguuucaugaaaauauggaaauacgaauaugaucuccuguauaaugaaggcgaugggaaaaagaauaucgaagaaggaugggaaaaaaucugcgaaaaauuacaaaauaaaaaagacgaauuuacaggagacuacgguaaauacaaaaaagaaaucaaagacuacugcgaaauggcccuaagcuuaucacaaaggauaaaacaucuagacaucagaauuaaaaaaagagacggcagcgaagacgcagacaacaacuuauuugaaggugucgaaaaacucgaugaguucuacgauaggcuauucgaaauuguagacgaacacaaugcauaccaauaccaucaugaauuucaagcauuccuaacuaaaaagccauauaaaacagauaaguucaaacuaaguuuugacaauccacaacuguuaaaagguugggaccuaaacaaagaaccagauuacuuuggugcccuauuggucaagaacgaaaaauauuuccuagcaguuuuccauaaacaauacgcgaacgaaauauuuagacaaaaaaauaaaaacucaacaguaaaaauuaaagaagcauaugacguguuuaacggaaauuauuauaaaaaagucgaacucaagcaaaucccaaaacuauucaugaauuuaccaagaauaugcuucgccaaaaguaaucaagaagaauuugggcuaacaauagaacuugaaaaaauuaaaagugaauuugacaaauuccaaaaacugaaaaaagaacgucaagauaacaacuuaaaauucgaucaggaaaaauuuaucaaacuauuagcauacuacagacacuguuuagaaauuagagaagauuggaaaguuuuuaaauacaacuucaaaccacuauauaaauacagcaacuuaggagaauucuacagggaucuagaaaaagacacauauaaucuggaccuagucagagugaacucugaauacgucgaaaaaaaacgaaacgaaggaaaauuauacuuauuugaaguuuacaacaaagauuucucagauaaaucaauaggaagaaaaaauauacacagcgacuauuuuaaaucguuauucuuaccagacaaccuuacaaacaaaaaaauagcauuagcggcagacgcggaaauauuuuucagagagaaaagcuuaaaaaauaaagaugaaauaauaacacaaaagaauaaaaucaaaauagacaaaaacaaucauaaaggagaaaaagcauauucgaaaaacagauacacagacgacaaaauaaucuugcaccuuccgauaaauuuaaauuucggcgaaaacaaaaaccacaaagacuucaauuacgaaauaaacgacucucucuugaaaaacaaccgagauauaaaaauaauuggcauugauagaggagaaaaauaccuacuauacuacucaguaauugaccaaaaaggcgacaucaaagaaaugggagacuuuaauguaguaaacgguguggacuacuacucaaaacuaguagcauacgaagagaaacgcaagcaggcaaggcuagauuggggggacauacaaagcauaaaagaacuaaaggaaggcuacaucucgcacguaauacaugaaauaugcgaucucauaaagaaauauaacgccauaguaguauuggaggauuuauccaugggguuuaaaagaggaagauucuuccgagaaagacaagucuaccagaaguucgaauuagcguuauuccgaaaguuaaacuauuggguugauaaaaacaaagaagaaggggaaaagggaucagcacuaagcgcauggcaauuaacacccaaugagaaagacuuuaaaguaagucaacuagaaaaagcuagacaauuaggaauucuauucuacacagcugcaggauauacaagcaaaacaugcccagacuguggcuuccgaaaaaauaucacacucaaauacgugaacgacaaacagcuaaaagaagaccuuggaaaacuaaaaauaaauuucgucgaagaucauuucaaaauaaaauauaaucuacuagauuuugaaaaaaauaaaaaaucagaaaaagccaaagacacgguccuaccuaaagaagaaagaaaaauaucguucguagccaacucaaaaguaauccggauaagguggcacgacauuaaaacuaagcuagccaaacgagaauuggacggggaaaagauaauaaaaaaauucccuaaaggaguaauaaaagaauaugacaucaauauaugucucaagagaauaauaggcgauaaaauugauuucagcaaggauuccauaacagaacaacuaaucaauggacguuucgguaaagacuucuacugggaacugauguauuuucuaaaucuaauccucgaaauaagaaacguaguaagcgaaacagaaauagacuacauacaauguccuguaugcggauuucacuccgaugacgguuuucgagggaauaaguuuaacggagacgcaaacggugccuacaacauagcaagaaaaggacgucugauauuagaaaaaaucaaucaacacaaaaaucuuaaagaacucaaaaccggagaccuaucagugaacauaguagaaugggacaaagcgguuaacaacugggacaaauuuguacaaggggauaacacagaaucaaagaauauagaaauaccugcaaaagaagagaugauaagcguagaaguacgugaguccuga

SEQ ID NO: 5792 - RNA, 4107 nt, Artificial Sequence
  Cpf1 variant
augaagaaagaaaaagaguucaaauccuucggagacuucacaaauuuauacgaaauaucuaaaacacuacguuuugaacuaaaaccgguagaaaauacacaaacaaugcuagaugaagcagacgucuucggaaaagacaaaguaauaaaagauaaauauacaaaaacaaaaccauuuauugacaaacugcaucgcgaauuuguggacgaaucccuaaaagauguaucacuaucuggucucaagaaauacucagaaguccuggaaaauuggaagaaaaacaagaaagauaaagauauugugaaagaacugaagaaagaagaagaaagacuuagaaaagaaguagucgaauuuuucgacaacaccgcgaagaaaugggcgaaugaaaaauacaaagaacuaggucuuaaaaagaaagauauaggaauacuauuugaagaaucggucuuugaccuacuuaaagaaaaauacggagaagaacaagacucuuuccugaaagaagaaaaaggggacuuccuuaaaaaugaaaaaggcgaaaaaguaucuauauuugacgaauggaaaggauucguaggcuacuuuacaaaauuccaagaaacaaggaaaaauuuuuauaaaaaugacgggacugaaacagcauuagcaacucgaauaauagaccaaaaucuaaaaagauuuugugacaacauagacgacuuuaagaaaaucaaaaauaaaauagacuuuagugaaguagagaaaaacuucaauaaaacagcagacguauucucacuugacuucuacaaucagugucuacuacaaaaagguauagauucauacaaugaauuuauaggugggaaaacacuagaaaacgggaagaaacuaaaaggcguuaaugaauuaguuaaugaauauagacagaaaaauaaaaacgaaaaaguuagcuuccuaaaacuacucgauaaacaaauacucucagaaaaagaaaaacucagcuucggaauagaaaaugacgaacaacucuuaguaguucuaaacucauucuacgaaacagcugaagagaaaacgaaaauauuaagaacacuauucggagacuucguagaacacaaugaaaacuacgaccuagacaaaaccuauauuaguaaagucgcauuuaauacuauaucacauaaauggaccaacgaaacacacaaauucgaagaauuauuguacggggcaaugaaagaagauaaacccaucggguuaaauuaugacaagaaagaagacaguuacaaauuucccgauuuuauagcacuaggcuaccuaaagaaaugccuaaauaacuuagauugugauacuaaauuuuggaaagaaaaauacuaugaaaauaaugcagacaagaaagauaaagauaaaggauuuuuaacaggaggacaaaacgcaugggaucaauucuuacaaaucuuuauauucgaauuuaaccaauuauucaacagcgaagcauuugauaauaaaggcaaagaaaucaaaauaggcuaugauaauuuuagaaaagauuuugaagaaauaauaaaucagaaagauuuuaaaaaugacgaaaauuuaaaaaucgcuaucaaaaacuucgcggacaguguucuauggauauaucaaauggcuaaauacuuugcgauagaaaagaaaagaggaugggaugaugauuucgaacuaagugaauuuuacacaaacccaagcaacggauauucacuauucuaugauagagcauaugaagaaauaguacaaaaauacaacgauuugagaaauuaucuaacuaagaaaccuuacaaagaagauaaauggaaauuaaauuuugaaaauccaacuuuagcaaacggauuugauaaaaacaaagaaucagauaauucuaccguaauacuccgaaagaaaagaaaauacuauuuaggguugaugaagaaaggaaacaacaaaaucuucgaagacagaaacaaagcagaauuuauaagaaauauagaaagcggggcauacgagaaaauggcuuacaaauauuuaccugacguagcaaaaaugauaccaaaaugcucaacgcaacuaaacgaagccaaaaaucauuuuagaaacucagcagacgaucuggaaaucaagaaaucguuuaguaacccacuaaaaauaacuaaacgcauauuugauuuaaacaacauacaauacgacaaaacaaacgugagcaagaaaauauccggcgauaauaaaggcauaaaaauauuucaaaaagaauacuauaaaauaagcggagauuucgacguuuacaaaagcgcucugaacgauuggauagacuuuugcaaggacuuccuaagcaaguacgauucaacuaaagauuucgauuuuagcauacuacgaaagacgaaggacuacaaaagccuagacgaguucuacguugacguagccaaaauaacauacaaaauauccuucaccccaguaagcgaaucauacauagaccagaaaaauaaaaacggagaacuuuaccuguucgaaauauauaaucaagacuucgccaaaggaaaaaugggcgccaaaaacuuacacacauuauacuucgaaaacguauucagucccgagaacauaagcaagaauuuuccaaucaaauuaaauggcaacgcugaacuauucuuuagaccaaaaucaaucgagaguaagaaagagaaaagaaacuuuguccgcgaaauagugaacaagaaaagauacucagaggauaaaauauuuuuccauugucccauaacgcuaaaucgugaaacaggaucaauauacagauucaacaacuacguaaacaauuucuuaagcgaaaacaacauaaacauuauagguguagaucguggagagaaacaccuagccuacuacucaguuauagacaaaaacggaguaaaaauagguggcggcucauucaacgaaauaaauaagguggacuacgcaaagaaauuagaagaaagagcaggcgaacgagagcaaaguagaaaagauuggcagguaguggagggaauaaaagauuuaaagaaaggcuacauaucgcaaguaguuagagagcuagcagaccuagcaauuaaacacaacgccauaauagugcucgaagaucuaaauaugagauucaaacagauaaggggaggaauagaaaaaucuauauaucaacaacuagaaaaagcacuaauagacaaacuaaguuuucuagucgaaaaaggcgaaaaggauccgaaccaagcaggacacauuuuaaaagccuaucaacuagcagcuccauucacgucauuuaaggacaugggcaaacaaacaggaaucgucuucuauacccaagcaagcuacacgucuaagacauguccuaauugcggauucaggaaaaacaauaacaaguucuauuucgaaaauaacauuggcaaagcacaagacgcucuaaagaaacuaaaaacguucgaauaugacuccgaaaacaaaugcuuuggacuaagcuacugccucagugauuuugcaaauaaagaagaggucgagaaaaauaaaaauaaaaagagaaauaacgcaccauauucagacauugagaagaaagacugcuucgaacucaguacaaaggacgcaguaagguauagguggcacgacaaaaauacagaacguggaaagacauucuucgaaggagaaaguguauacgaagaaaaagaagaaaaagaaauaggacaaacaaaaaggggcuuagucaaagaauacgauauaaguaaaugucugauaggcuuauucgagaaaacgggguuggacuauaaacaaaaucugcucgacaaaaucaauagcgggaaauucgacggaacauucuacaagaauuuauucaacuauuuaaaccuacucuucgaaauacgaaacucgauaucgggaacugaaauagacuacauuagcugccccgagugucaauuucacacagauaaaagcaaaacaaucaaaaacggagacgauaauggaucuuacaacaucgccagaaaaggaaugauaauucuugacaaaauuaaacaauucaagaaagaaaauggaucacuugacaaaauggguuggggagaacuauuuauugaucuagaagagugggacaaauucgcacagaagaagaauaacaauauaauagacaaauga

SEQ ID NO: 5793 - RNA, 4149 nt, Artificial Sequence
  Cpf1 variant
augagcaaaaacaacguuugggauaaauucacaaaucaauauucccuaagcaaaacauuaagauuugaauuaaaaccgguagguaaaacuagagaaaaaaugaacgagcaacuaaaguacgacaaacaauuacaaaccuuccuaaaggaccaagaaauagaagaugcauaccaauauuuaaaacccuuuuuugacaaacuacauaaagaguuuauaacagacucauuagacucagacacuaccaaaaaaauagacuuuucagauuauuuaauugauuacagagacaaaaaagaccuaacgaaaaaagaagacucauugcgaaaaaauauaggugaagucuucguaaaggcuggagauagguggaaaaaggagaaauacccuaaauacgaauggaaaaaaggaaguaauguagcaaauggcagcggaaucuugcuuacccaagauguauugaugcugauaaaagauuuaaauccaaaugaccaaaagauaaagaaaaugauagaggaaaccuucaagggauucuucaccuauuucagcggauucaaccuaaaucgggaaaacuacuauacaaccaaaguagaaaaagcaaccgcuguagccacuagaauuguacacgauaauuuaccaaaauucugcgauaaucuaguacaauucgaauguauaaucaaaaaaaaaaaaaacggcgaaguagacagaauugagcgaaaaagugaauaccuaaaugcuuaccaauaucuaaaaagcaaaggccggacaacucaaaucaaagaugcagaaagcggaaaaaugaucgaagcugaaguaaucaaugaaaacauguuuaguauuucauauuucuccgccugucucucacaaaguggcauagaagaauauaaucgcacgauugggcauuauaauuugcuaauuaaccuauacaaucaagccaaagaaggggaagaaaaagaccuaaaaaagagcgagaagaaauucaaaaggcuaccaauauuuaaaacguuauacaaacagauaggcuguggagagaaggaaccucuauuuuucagucuuacacacgauacaaaguuacagguacaagaaaauaaagaaaacuacaaaaaaccuuacaguguggagcaaauauuagaacaagccaaacuugcaggagacaaauacuuuaaaggaaaaaguaacgacgguauccuaaacacuauaccggaauuuagugauuacauauuacagaaagaaucuuacggaggugucuacuggucaaaagucgcaauaaacacaaucagcaacagauauuucgaaaauuggcacacguuaaaagacgcacucauugaugcaaaaguauucgaaaagggcaaaaaaggagacgaggaagacgugaaaauaccagaaagcauagaauuacagggauuuuucgacguuuuagauacacaagagggauggaaaagugaagguaucuuuuucaagaagaguuuaacugaagaguuaaaaaacaaagaagcugauacaaagaauaagaagaggagagaaauuguaaaagaagcaaaaagaccaucccaagcacuauuagcucuuuuauuugaugacauacaagaacacgcaaauuuguuccuaaaucaaagcgacgaaauccucaaacucgaaaaauauucugaaaaagaaucaaaagaaaaaauaaaacaauggauggauucggccuuagcaguuaaccgcauccuaaaauauuuuuucguuaaagaaucuaaggcaaaaggagaacaaauagauccuaucauaagugaagcacuaaaaguacuauucaauuccgaagacgcaaccugguucaaaugguacgacgcauuaagaaauuacuuaacuaaaaaaccacaggaugauguaaaagaaaacaaguuaaaauugaacuuugaaaacucgacgcuagcaggaggcugggauaucaacaaagaaucagauaacuacugcguaauauuacaagaccaaaaagguaaacaacaccuagguauaauagcaaaaaaagaaaaacaaagaggauauaacaaaauuuucgagagaacaccagagaauccacuauacaaaauagauagcggagaaguguggcaaaaaauggaauauaaacaaaucgcggucccgacaggcauuggaggcuucguaagaaaaugcuuuaacacagcacagcaauauggauggaaaugccccgacaauugccuaaauagugaagguaaaauuauaauaaaaaaugaugaagcuaaagaaaaccucgaagccauuauagacuguuacaaagacuuuuuuaccaaauacgaaaaagacggguuuaaauauaaaaauuucaacuucaauuucaaagaaagcgaagaauacgaagaacuaaauuccuucuucucagacgucgaacgacaaggcuacaaauuaggauuuauuacuguaaacaaaacaauaauagacaaaugggucgaagacggaacaaucuacuuguucgaaaucaaaaaucaagacacaaacgacggaaagaaagacgggcacaagaauaauuuacacacuaucuauuggaaagcacuauucgaagauguaggaaacaaaccuaaacucaauggaggagcagaacuguucuaucgcaaagcauuauuaaaagacaaacaagaaaagauagaagauaacuacggaaaggaaauaauuaaaaacuuuagguuuucaaaagaaaaauuuuuauuccauugccccauaaaauuaaacuacaaagcaaaaucguauucacacccaaaauacgcucugccagaaauaaauaaacaaacaaaugaauucuucauaacaauaucagauauaugcuuucuggguaucgacagaggagaaaaacauuuagcauauuacucgcuugucaaccaaaaagaagaaaucauagaccagggaacgcuuaacaugccuuucguugauaaggaugggaaaccaaggucaauuaaaaaagagaaauuuagauuugaugcaaaaguagacaaauggguaagcgaagaaauggauugcuggaacuauaaugacuuacuagacgcuauggcuaguaaccgagacauggcacgaaaaaacuggcaaaccaucggcacaauaaaagaauuaaaaaacggauacauuucacaaguggucagaaaaauuguagaucucgcgauagacaaaaacaggggcauaccauccuuuauaguacuagagaauuuaaacgcaggcuucaugaggggaagacaaaaaaucgaaaaaucaguuuaccaaaagcucgaguuagcacuagcaaaaaagcuaaauuuuguuguggacaaaacuguccaaaauggagaaauaggauccguuacaaacgcacuucaauuaaccccacccguuacgaauuuccaaaacaucgaaaauagaaaacaagucggaauaaugcuauacaccagagcagauuauacaucccaaacagaccccguaaccggauggcgaaaaaguauuuaucuaaagaaaggaagcgaagaauacauaaaaucccagauaauggacaguuuugaugauuucggauucgauggaaaaaauuacuauuucaaauacacaguagacuuaaucgauccaauaaaaaaaacaagcgaaaaaaaauucaaaaaacaauggacacuauacagcgggauuaacgggaaaagucuagauagguuccgaggagaaagaucuuccgacaaaaacgucuggauaaaaacguuacaagacauaaaaaccacucuggacgcaguauucaucggauucgaccugcaacauucacuacgaagccaaauaauaaacgaugggauuaugccuaaaaaaauagaaaacucacaauuuacagguugggaaucauuaagauucgccauagaaaugauucaacaaauacgaaacauaggcguagaaaaaggagacgaagauuuuauauuaucaccagucagagacaaaaaugagaaccacuuugauagccggaaggccaaagaaaaugaaccaaacucuggugacgccaauggggcauauaacauagcaagaaagggaauaauaaugaacgaacacauaaaaaaagauuuaaucccuuucauacaggauaaagaaugggaugcaugguuagcuggcagagagguaugggacaaauggcuaauagaaaauaaagacucccuaauuuauaaaaaauga

SEQ ID NO: 5794 - RNA, 4203 nt, Artificial Sequence
  Cas9 variant mRNA product
auggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauga

SEQ ID NO: 5795 - RNA, 4986 nt, Artificial Sequence
  Cas9 variant mRNA product
auggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauga

SEQ ID NO: 5796 - RNA, 3258 nt, Artificial Sequence
  Cas9 variant mRNA product
auggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauga

SEQ ID NO: 5797 - RNA, 4326 nt, Artificial Sequence
  Cas9 variant mRNA product
auggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauga

SEQ ID NO: 5798 - RNA, 3402 nt, Artificial Sequence
  Cas9 variant mRNA product
auggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauga

SEQ ID NO: 5799 - RNA, 4263 nt, Artificial Sequence
  Cas9 variant mRNA product
auggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauga

SEQ ID NO: 5800 - RNA, 3345 nt, Artificial Sequence
  Cas9 variant mRNA product
auggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauga

SEQ ID NO: 5801 - RNA, 4101 nt, Artificial Sequence
  Cas9 variant mRNA product
auggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauga

SEQ ID NO: 5802 - RNA, 4134 nt, Artificial Sequence
  Cas9 variant mRNA product
auggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauga

SEQ ID NO: 5803 - RNA, 3267 nt, Artificial Sequence
  Cas9 variant mRNA product
auggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauga

SEQ ID NO: 5804 - RNA, 3345 nt, Artificial Sequence
  Cas9 variant mRNA product
auggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauga

SEQ ID NO: 5805 - RNA, 3351 nt, Artificial Sequence
  Cas9 variant mRNA product
auggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauga

SEQ ID NO: 5806 - RNA, 3051 nt, Artificial Sequence
  Cas9 variant mRNA product
auggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguga

SEQ ID NO: 5807 - RNA, 3462 nt, Artificial Sequence
  Cas9 variant mRNA product
auggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauga

SEQ ID NO: 5808 - RNA, 4020 nt, Artificial Sequence
  Cpf1 variant mRNA product
auggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauga

SEQ ID NO: 5809 - RNA, 3999 nt, Artificial Sequence
  Cpf1 variant mRNA product
auggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauga

SEQ ID NO: 5810 - RNA, 4716 nt, Artificial Sequence
  Cas9 variant mRNA product
gggagagucccgcagucggcguccagcggcucugcuuguucgugugugugucguugcaggccuuauucaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5811 - RNA, 5499 nt, Artificial Sequence
  Cas9 variant mRNA product
gggagagucccgcagucggcguccagcggcucugcuuguucgugugugugucguugcaggccuuauucaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5812 - RNA, 3771 nt, Artificial Sequence
  Cas9 variant mRNA product
gggagagucccgcagucggcguccagcggcucugcuuguucgugugugugucguugcaggccuuauucaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5813 - RNA, 4839 nt, Artificial Sequence
  Cas9 variant mRNA product
gggagagucccgcagucggcguccagcggcucugcuuguucgugugugugucguugcaggccuuauucaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5814 - RNA, 3915 nt, Artificial Sequence
  Cas9 variant mRNA product
gggagagucccgcagucggcguccagcggcucugcuuguucgugugugugucguugcaggccuuauucaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5815 - RNA, 4776 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5816 - RNA, 3858 nt, Artificial Sequence
  Cas9 variant mRNA product
gggagagucccgcagucggcguccagcggcucugcuuguucgugugugugucguugcaggccuuauucaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5817 - RNA, 4614 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5818 - RNA, 4647 nt, Artificial Sequence
  Cas9 variant mRNA product
gggagagucccgcagucggcguccagcggcucugcuuguucgugugugugucguugcaggccuuauucaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5819 - RNA, 3780 nt, Artificial Sequence
  Cas9 variant mRNA product
gggagagucccgcagucggcguccagcggcucugcuuguucgugugugugucguugcaggccuuauucaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5820 - RNA, 3858 nt, Artificial Sequence
  Cas9 variant mRNA product
gggagagucccgcagucggcguccagcggcucugcuuguucgugugugugucguugcaggccuuauucaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5821 - RNA, 3864 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5822 - RNA, 3564 nt, Artificial Sequence
  Cas9 variant mRNA product
gggagagucccgcagucggcguccagcggcucugcuuguucgugugugugucguugcaggccuuauucaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5823 - RNA, 3975 nt, Artificial Sequence
  Cas9 variant mRNA product
gggagagucccgcagucggcguccagcggcucugcuuguucgugugugugucguugcaggccuuauucaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5824 - RNA, 4533 nt, Artificial Sequence
  Cpf1 variant mRNA product
gggagagucccgcagucggcguccagcggcucugcuuguucgugugugugucguugcaggccuuauucaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5825 - RNA, 4512 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5826 - RNA, 4813 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5827 - RNA, 5596 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5828 - RNA, 3868 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5829 - RNA, 4936 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5830 - RNA, 4012 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5831 - RNA, 4873 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5832 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5833 - RNA, 4711 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5834 - RNA, 4744 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5835 - RNA, 3877 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5836 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5837 - RNA, 3961 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5838 - RNA, 3661 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5839 - RNA, 4072 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5840 - RNA, 4630 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5841 - RNA, 4609 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 5842 - RNA, 4497 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5843 - RNA, 5280 nt, Artificial Sequence
  Cas9 variant mRNA product
gggagagcggcucggccauuuugucccagucaguccggaggcugcggcugcagaaguaccgccugcggaguaacugcaaagaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5844 - RNA, 3552 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5845 - RNA, 4620 nt, Artificial Sequence
  Cas9 variant mRNA product
gggagagcggcucggccauuuugucccagucaguccggaggcugcggcugcagaaguaccgccugcggaguaacugcaaagaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5846 - RNA, 3696 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5847 - RNA, 4557 nt, Artificial Sequence
  Cas9 variant mRNA product
gggagagcggcucggccauuuugucccagucaguccggaggcugcggcugcagaaguaccgccugcggaguaacugcaaagaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5848 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5849 - RNA, 4395 nt, Artificial Sequence
  Cas9 variant mRNA product
gggagagcggcucggccauuuugucccagucaguccggaggcugcggcugcagaaguaccgccugcggaguaacugcaaagaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5850 - RNA, 4428 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5851 - RNA, 3561 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5852 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5853 - RNA, 3645 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5854 - RNA, 3345 nt, Artificial Sequence
  Cas9 variant mRNA product
gggagagcggcucggccauuuugucccagucaguccggaggcugcggcugcagaaguaccgccugcggaguaacugcaaagaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5855 - RNA, 3756 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5856 - RNA, 4314 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5857 - RNA, 4293 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 5858 - RNA, 4439 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5859 - RNA, 5222 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5860 - RNA, 3494 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5861 - RNA, 4562 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5862 - RNA, 3638 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5863 - RNA, 4499 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5864 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5865 - RNA, 4337 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5866 - RNA, 4370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5867 - RNA, 3503 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5868 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5869 - RNA, 3587 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5870 - RNA, 3287 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5871 - RNA, 3698 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5872 - RNA, 4256 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5873 - RNA, 4235 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 5874 - RNA, 4420 nt, Artificial Sequence
  Cas9 variant mRNA product
gggagagucccgcagucggcguccagcggcucugcuuguucgugugugugucguugcaggccuuauucaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu
